United States Patent 8,067,671 (METHODS FOR GENETIC CONTROL OF PLANT PEST INFESTATION AND COMPOSITIONS THEREOF) - sequence listing, part 36

SEQ ID NO: 66501 - DNA, 4043 bp, Heterodera glycines
  misc_feature (9)..(9): n is a, c, g, or t
  Genomic contig location: Contig_ID=SeqID_7959; Location=841..4883; Strand=-
  SCN-specific regions: Sequence locations=1-66,88-448,471-756,794 -996,1018-1036,1062-1607,1630-1957,1993-2172,2194-2247,2277-2302,2342- 2350,2372-2994,3040-3514,3621-3840,3862-4043
  Gene Ontology: Mol. function=protein kinase C activity; Cellular component=rhabdomere; Biological process=cell surface receptor linked signal transduction
aaccaaccnttttgttctcattgcaaagatttcatctgggggactgaacaaacaaggctttcagtgccaagtgtgcactttggtgggtcaaaacgcataattaattaataacggagtcaaatgccaatcagcggggaatggttaaaaggcgaacggacactttaaaaagaataaatcagcagcaattaactaattaatgcgccaaatctaagggaattaattccttttggattttccaataatcatttttcttaatcactccttctattttctctgttcgtctcgtccattttcctctctttttccatgccttttatccctcccctcccttttttccccttttctcaggtcgtccataagcgatgccatgagtttgtcagtttcgcgtgtcccggcgcggacaaaggggtggacagtgacgtgagtttggagtgggaaggagcttaactaattttataattattataattcgaaattaaggacccacgacagcagcaccgatgggaggtgatcggattggatttgttgaagctgatgacccactcactcattgacattttgcccctcaggccaccacttattcgtcgcccaccttttgcgaccattgcggctctttgctttacgggctcattcaccagggcatgaagtgccaatgctgctacacctctggtcagtgccaaattgcccttcacaaaaaagctcgcacaattaggcgcatttcagttcatcatcgatgtgtcaaatacgtgccgaatatgtgcggcatggatcacacggagaagagggggcggatcgaccttggcactttcattcaggtgaaatgatatcgggggaaagaggacacaatgccaaagcgaaattcccattccaaggatggtgttcttcacatacacattcgagaagtgtgttgttgggttgacaatacattttttgctgataatatggtcagaaattcaggcacggaatttgattccgatggatcccaacggactttcggacccttatgtgaagctgaagttgatcccattcgaagatgagcagggaaaggccaagcaaaaaacgaggacgataaaagcgacgctgaacccaatttgggatgaacatttccaattgtgaggagccgatggcttaaagtggtttaatgccgtgggattgtcaatcagtgcccttcagcaagttggagccgtccgacaaggaccgaagactgtcggtggaagtgtgggattgggaccggacgagccgcaacgacttcatgggctcactctcattcggtattagcgaactgatcaaagagccgatgaacggatggttcaagcttttgaacgacgaggagggtccgtttcctttgcctttctcttccgccgtcacttcgctcactttggcaatttttcttccttcaggcgaatattataacattccgattccgcctgaggacgagaaggacattgagcggctgcagaagaaaatggccgatctgcacggacaacggaagggcgcacttggcgaagagggacgagccaaatcagtgacgaaacaacggcaaagtgcgacggcactcgagaaccgagtccagcgacacaaagaagtggtgaaggcggctgacttcaatttcatcactgtgctggggaagggatcatttggaaaggtgagatgcgatggaaagagcaaaatgatctgatcaggcggtctttcgaactaatcaggaggaatgacgccacctgatcagatattctttcgaaccgctgttttgatcaggcaaattgccatcttattctgatcagactatgatcatttcccttgtcaactatgcttttcccttaggtacttcttggggagcacaagcacttgaaagaactgttcgccatcaaaattctcaagaaggttttatcgcaaaacttccatttatctttccaatctttgactctcttcccaggacgtgatcatccaagacgacgacgtggagtgcacaatggtggagaagagagtgctggcactgcccgacaagcctccctttttgttggcactccattcctgcttccaaacaatggtcttccaatggcatttccgtcctccgtgccattgtttgattccccccgcccattccttttaggatcgtctttattttgtgatggaatttgtcaacgggggtgatctgatgtatcagatccagcaggtgggcaagttcaaggagccggtcgccgtgttttactctgctgagatcgcctgcggattgttctacctgcattccaagggcatcatctacagggacttgaagctggacaacgtgatgttggagagggacggacacatcaaaatcaccgactttggcatgtgtaaggagggcattcagggcgacaccaccaccaaaacattctgtggcactccggattacatcgcaccggaggtcgctgcaattggcactttttttaaatcaaaatggcattatgctgcaccctttcagataattctctatcaaccgtacggaaaatctgtcgattggtgggcttacggcgtccttctgttcgaaatgctcgctggacaacgttagtaattccattcgattggcgggcgctataattttggctttaagcgccgtttgacggggaggacgaggacgaattgttcacagcgatcaccgaacacaatggtaagtctgactgatctgatcagataattgatcattatgagcatttgattggccattttcagtctcttaccccaaatcgatgtcaaaggaatcggtgctgatttgtaaaggatttctgagcaaagcgccctccaaaaggttggggtgcagcgcggacggagaacggcaagtcaaagtgagttggcaaagcttaaaagcaattcacatcggttttgaactgattgtttggcattccgtcaaaggagcattgctttttccgtcggatcgattggcacaaaatcgaaactcgccaagtgcagccgccgttcaagcctaaaattgtgcgtttttcccaatgattcaattttttcgttcgcttttcgtcccgtttttcgtccgttcgttcattcgttttgtccgcattttcagtctaacaaattcgccaccgaaaatttcgacccgctttttctgcgccttccgcttaaattgacgccgcccgaatgggacattttggaggggatgaaaggcgacgagttcattttgttcgaccattttaattcgcaatatttcgctgaagcagcgagtgccgagagcggagcttatgcggaggaaacgctgcagagggactgcagccgaaacggcgacgacgcgatcagcttgcaacttccgatcactcccgaccattgagtctcggtttcttttcgttaagccaaccaagaatgaattagccccccccttttccatcggttttatagacttttactgttttcctcaattttgtgtttcgatggcactttacttgctataattcattcacttttgcctcactttttgtgtgtccttgccaattttgttttttttctccttccgctattcccaatccctcccctttctctctctctctctctctctctttctctctcgctctctctctctctttctctctcgctctcttctctcctctccttccccatctttctctctcttcccctctgtcatttcccttcattgtacattcaaagtcaaatttatacgtcataattcttaataaaatgagttttgctgtcttaattgcctaattaagcatccttttttgtaatttgtgcctttttggttctcattttcggcattggcgttgtcttttcgtcgctctgttcgatgttcgctttccttttttgtgttttattttgcccttttttctctcagcgatccgccgacgacacttccaatttcgactccgaattcactggcgaagcgcccaaattgacgccggtcgaccgattgttcctaatgaatttggaccaggtcagtggccaatgttcgcttttgcctctcattctctgattattcttttgcctgccttcagaacgaattcgaagggttcacttttgtcaacgcggaatttacgccccagggc

SEQ ID NO: 66502 - DNA, 600 bp, Heterodera glycines
  Genomic contig location: Contig_ID=SeqID_37422; Location=158..757; Strand=+
  SCN-specific regions: Sequence locations=1-85,107-116,138-298,321-600
  Gene Ontology: Mol. function=transcription co-repressor activity; Cellular component=26S proteasome; Biological process=embryonic cleavage
atgttggagttgctgaaccaactcgacggattccaacccaacgacgacatcaaagtggagtggtggagcaagccaatcaattcacattcattttgttttcatttaacgcaggtcattgctgcgacaaatcgtgttgatgtgctcgacccggcccttcttcgctccggacgttttgaccgcaaaatcgaattcccagcaccaaatgagaagggcagggaacaaattcttcgcattcattcgcgccggatgaacgtcgagtcggtgacagaattttaggaaaacaaattattcctcgttttcagcaaaaatgtcaactttgttgagctgtcgcgctgcattgaggacttcaatggagcacaatgtcgagcagtttgtgtggaagcggtgagcggataaacattttttgaggatatgcgtcagcttatctcatttttacagggaatggttgcacttcgtcgtgactccactaaaattctgcatgaggatttcatggacggaattttggaggtaattaataacaatttgagaaattttggaggaataagccaaaattttcaggtgcaaggcttgaagaagaataatctggtgtattatggctga

SEQ ID NO: 66503 - DNA, 716 bp, Heterodera glycines
  Genomic contig location: Contig_ID=SeqID_37423; Location=239..954; Strand=-
  SCN-specific regions: Sequence locations=1-388,410-716
atgcagtacaatgcttttaagccccgtcgtgaggcgggccagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttcggttttaattatgctgtacaatgcttttaagccccgcctgcggcggctccccttttgtgcactattttagtttttaaaattggttccggactttttggctttttgaaataaattgtgaaaaatatacgaaaattattttagcttttaattattctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtcttttgaaataaa

SEQ ID NO: 66504 - DNA, 529 bp, Heterodera glycines
  Genomic contig location: Contig_ID=SeqID_37423; Location=38..566; Strand=+
  SCN-specific regions: Sequence locations=1-60,82-508
gcttaaaagcattgtacagcgtaattaaaagctgatataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagaataattaaaagctaaaataattttcgtatatttttcacaatttatttcaaaaagccaaaaa

SEQ ID NO: 66505 - DNA, 51 bp, Heterodera glycines
  Genomic contig location: Contig_ID=SeqID_37424; Location=802..852; Strand=-
  SCN-specific regions: Sequence locations=1-51
ccattatcccatcaatttcccctgtaattcttcggataaataatggcgaaa

SEQ ID NO: 66506 - DNA, 950 bp, Heterodera glycines
  Genomic contig location: Contig_ID=SeqID_37425; Location=196..1145; Strand=+
  SCN-specific regions: Sequence locations=1-185,207-222,252-504,528 -670,703-950
  Gene Ontology: Mol. function=positive transcription elongation factor activity; Cellular component=transcription elongation factor complex; Biological process=histogenesis and organogenesis
atgatggtgatgcccaccccgttgatggaggagctgtacgagttgctgttgaccacagagacgacagtgatcgaagcgttgaagcccggcacttcaatgtccgcagcttacgaagcaggcattcggcattttcgcagcaaaaagcccgactttctgcaataccttgtcaaaaatttcgggtaactatttttgttgacaaatattatattttcacttgaattgaaattttgtttattttcagttttgtcactggcattgagtttcgtgagtcccaatttttgatcaacgaccgttgcgcgcacaaagtgcatccgaacatggcatttgtggtggcggtgggccttcaaaattttcccaaccaatcgacggaaaacggaaagaaaatgatgtccattttcctcagcgacaccattctgatctgcgaagtttgtcttttcctatgacccaacattttatatgaattttaaccgtgataagcccagagaagcattccaattaaagcacataaaaatggggaaaaactttttggtcgaccctttttaaaatttgcctgtcctatttataggaaagagaatttgcacaccgacatttcaggacggacccaacgatgtgctgacaatggtggccaagagccgactgcgctccaacgccattcgctttcgggaggacgagcagcagcagcaacaccaccagcagcagcagaaggcgaacagagacactcaagaaatggccaacggcgggcgcaacaaacggtcggtggtgttgcaggaacaaacgcgggtaaaatatgcaaaacaaggcataattatgattggtaatttgcataaattaaagcacaaacaaacaaatgaagagaagcggaaagagcgccagagggaattggccgagcaactgaacagagaagcgcgggagcgtctctcaatcaaatcgggcggagtggaggcacaaaa

SEQ ID NO: 66507 - DNA, 89 bp, Heterodera glycines
  Genomic contig location: Contig_ID=SeqID_37427; Location=175..263; Strand=-
  SCN-specific regions: Sequence locations=1-89
acatttacgaaaatgccgacactttgatcgaatcggagggatttttgcaaattgaccaaaaaatgttgtgcgaaattttggaacgcgac

SEQ ID NO: 66508 - DNA, 832 bp, Heterodera glycines
  misc_feature (784)..(784): n is a, c, g, or t
  Genomic contig location: Contig_ID=SeqID_37428; Location=449..1280; Strand=+
  SCN-specific regions: Sequence locations=1-184,206-235,268-478,564 -809,831-832
atgtcctcccgcgcttcggacgccatccaggagttacgaagaatggtcagtgatcagaaccgcatcatcttcaacttgcggtcgcagttgatagatcaaagggcggtagttttacaaaatcttgcgcgcatcgaacaattggaatgcttcacatcgaatgtaatttttattttaaaccccggggcagtttaaattttaaaaggtgagatgttgtaatgcacattttcgcaaatgctaatttttttaaatataaaaaataattattttgttaaggaccgtgctgggcgcggaaatttccgcctccgctacagtccaatggcagctgttgagctcactctactcgggcaacgtctcgaggatagagctcgtcgccatcgaatggcgataggcgcaatagcatcaacttccacttcgaatggagccaatggggccgggggctcggctgagggagacgcagcaaacaatgagaacggttggttaaaaaaataagttaatcaaagaaataaattaaaaaaattaaaaattattttaaaaaataaggttaaccaaaataaataaacaaagcaattcagacttttcaactccacgtacttcacgtgtaccgttgtccgccataagtataacatcaataatctcatatatttgtatctaatgacaaaaactttttagataatgtgccagctgatcaaaatgcgcatggaggaaatgcttcgggtgatggaaatggtaaataattttaaaataactcaatttcagtctgaaaatttcagtcccctcgtttggngcaacgattgaacgcacatggagagatctcgtcgacgttgctgcatga

SEQ ID NO: 66509 - DNA, 168 bp, Heterodera glycines
  Genomic contig location: Contig_ID=SeqID_37429; Location=197..364; Strand=-
  SCN-specific regions: Sequence locations=1-43,65-168
atgcattggccgagaaagtgtcggaaactgaggccaaattggaaaaacaaattgaaaatggcaagtattctggcgatgtgtctgctgttcgcagcggtgactttggcaacttcaaatggcagcgaagaaataattgccgacgcaaataacggagacttggcgatgact

SEQ ID NO: 66510 - DNA, 369 bp, Heterodera glycines
  Genomic contig location: Contig_ID=SeqID_37429; Location=584..952; Strand=-
  SCN-specific regions: Sequence locations=1-104,126-202,224-225,264-326
atgccattttttgtcacaggtggtggcaatttggcattaatgacaatgttgacatcaaacagatggaaaaagaaatcgaagatggtaaaaaatgcattaatatgcacttttttattaattattttctgctcttttctaatctgtaggaatgcgcgagaatcgaaatgcgatggccgagaaaatgtcgggaattgaggccaaattggaaaaacaaatttaaaacggtaaaaattcatttaattgaatttttatattttattttaggaatgcgcgaaacccaaactttgttgtccaccaaattggaaaaccaaattgaaaatggcaagtatttttatttaaaacataaattaatttatttaattaaataaa

SEQ ID NO: 66511 - DNA, 504 bp, Heterodera glycines; identical to SEQ ID NO: 60631
  Genomic contig location: Contig_ID=SeqID_37430; Location=82..585; Strand=-
  SCN-specific regions: Sequence locations=1-107,134-263,292-504

SEQ ID NO: 66512 - DNA, 324 bp, Heterodera glycines
  Genomic contig location: Contig_ID=SeqID_37430; Location=986..1309; Strand=-
  SCN-specific regions: Sequence locations=1-324
acaaaaaaatcgattttttcaagtgtccgtatagggtactcaaacaattatggcgagcaaaaatccaacgcagaattaaagtacaggctatagggaagctattcccgaaggattcggtctctccataaatatgggcgcatcggttcagggggactaccccgaaaacaaaaaaatcgattttttcaagtgtccgtttggggtactcaaacaattatcaggagcataaatccaacgcagaattaaagtacaggctatagggaagctattcccgaaggattcggtctccccataaatctgggcgcatcggttcagggggactgcccc

SEQ ID NO: 66513 - DNA, 281 bp, Heterodera glycines
  Genomic contig location: Contig_ID=SeqID_37431; Location=483..763; Strand=-
  SCN-specific regions: Sequence locations=1-281
atgccgacaatgaacaccaaggtgtacgagcagaaccacgcgctgtgcttctccaccgagccggtcaagcaatgcccgcgcggcaccacaacgaacggcggcgaagaagccgatcagcagcttagcggggaaaagccgaagcgtgtccactttgtgtgcatggaccgcgcggagtcggaggcgcgccgtctgatgcgccaactgcggcgcggacaacgctcggtcaaagtcagcagcgcccagggcgagtccttctcggaaatgatggacgagccgcagca

SEQ ID NO: 66514 - DNA, 1615 bp, Heterodera glycines
  Genomic contig location: Contig_ID=SeqID_7961; Location=2413..4027; Strand=+
  SCN-specific regions: Sequence locations=1-110,140-244,266-555,577 -752,774-1134,1156-1529,1551-1615
  Gene Ontology: Cellular component=basement membrane; Biological process=reproduction
atgttattcttattccctttgccccttattttgcttttgctcgtggccattgttttggtcagccagtgctgcggcggttgtgtgaaaaaggtgtgttcagaaaagaactttcgttttatcaatttaaaaatcccttttccctttttgcagaaaggcggcagcaaaacggacaagccgaccgaacaaggagaaggaccagcacctgaaggcggcagcaaagaacagccaactgacaagggagcaacagcagcaaccggcgacagcaaaacaaagacgaggccagggccaacgccgtgtcaagaaggaggaacgacttccaaaggcgacagcaaaacggacaagccaaaggcccaggaagaaggaacttcaaaaggcggcagcatcaacaccaagaacgcgccaaacgctcaggtagatgaagcaacctgaaaaggcggcagagcatcaataacccaacaaattcccaggtcggcccgacagcatctcgacgtccaaaacaaacatcaggcggcagccaaatggacaagctgaaagcccaggaagaaggaacttcaaaaggcggcagcagcagcaccaagaacgcgccgaatgccatggtagatgaagcaacttcaaaaggcggcagagcatcaataacctaacaaattcccaggtctcaacgaacgcgccgagtattgccaaaggaggaggaacgacttccaaaggcgacagcaaaacggacaagccaaaggacaagaaagaagcaacatcaaaaggcggcagcagcagcaccaagaacgcgccgaatgccatggtagatgaagcaacttcaaaaggcggcagagcataaataacccaacaaattcccaggtcacaacgaacgcgccgagtattgccaaaggaggaggaacgacttccaaaggcgacagcaaaacggacaagccaaaggcccaggaagaaggaacttcaaaaggcggcagcatcaacaccaagaacgcgccaaatgctcaggtagatgaagcaacctgaaaaggcggcagagcatcaataacccaacaaattcccaggtcggcccgacagcatctcgacgtccaaaacaaacatcaggcggcagccaaatggacaagctgaaagcccaggaagaaggaacttcaaaaggcggcagcagcagcaccaagaacgcgccgaatgccatggtagatgaagcaacttcaaaaggcggcagagcatcaataacctaacaaattcccaggtctcaacgaacgcgccgagtattgccaaaggaggaggaacgacttccaaaggcgacagcaaaacggacaagccaaaggacaagaaagaagcaacatcaaaaggcggcagcagcaccaccaataacgcgccgaatgccatggtagatgaagcaacttcaaaaatgcggcagagcatcaataacctaacaaattcccaggtctcaacgaacgcgccgagtattgccaaaggaggaggaacgacttccaaaggcgacagcaaaacggacaagctgaaagcccaggaagaaggaacttcaaaaggcggcagcagcagcaccaagaacgcgccgaatgccatggtagatgaagcaacttcaaaaggcggcagagcatcaataacctaa

SEQ ID NO: 66515 - DNA, 85 bp, Heterodera glycines
  Genomic contig location: Contig_ID=SeqID_37432; Location=994..1078; Strand=-
  SCN-specific regions: Sequence locations=1-62,84-85
gtttttttggactcaaatcggcaaaatgactttgacacacattcgcttttgatcagattgtatattctgtttcaaattaaggaaa

SEQ ID NO: 66516 - DNA, 170 bp, Heterodera glycines
  misc_feature (115)..(115): n is a, c, g, or t
  Genomic contig location: Contig_ID=SeqID_37436; Location=663..832; Strand=+
  SCN-specific regions: Sequence locations=1-170
atgtgcctgaatcgtgtggtattggggcctgaaattacgcgaaggccggcggcgatgccattctgggccgatttggcccagggcaataatgacaacagagacggggccaactggngagggagcgcggcatttcgaacattggctaagggagggggagtagagcccataag

SEQ ID NO: 66517 - DNA, 879 bp, Heterodera glycines
  Genomic contig location: Contig_ID=SeqID_37440; Location=15..893; Strand=-
  SCN-specific regions: Sequence locations=1-72,110-156,178-408,430 -455,477-572,596-879
atgtcttctctgctgctctccatcttctcaatggtctttttagtctgttgccatgcaatgccaagtaaattcaaataaataaaaaaatgtcaaattttaaatatttaaaccattcaatgtaaatgtttatttttccaaaaaggtatttaacaaaattatttattacatttaaattccacagaattcccgtgctgcccgggcagtcagcaagtggttgctgtgatgtccaaatacattgacactttctctgctgctgatgtggacaaatctacagtatgctcaaccgcgaaaaatactgtggatggaataaaaagtgatttgttctctcgcggcggatgcccaagcggaggagaagcacaaattgtgggcgaaatcgatcgacagctgaagagtaattaaacaaatttcgaaaataattaaagaaaatttttggagagatgtgaattttacgagagtataattaatttaaaaatattgactaaattaactcattaagacattgcaaaaatggagatcaattatgaggacgagtgtccatacaatttgggctttgcccgtgccatgttcgacttggccgctgctgctgctggccatgcgggcaccgacacaaaatggcaaaatatgaaaggacaatttgaacaagaaagccaagcaatcaaagcaattggtcaagaattgaacattacagttacggatgtgcatgttggacacccaagcaaaggcaaacaaaaaaatttaagtaaatatttgtttaaaatgatttccaaggattttccgcgcatcaaaatgtgccaagtccaagccatgtggttgccaaccctggccaaaagagttcggttggccatggaaaggatggcgaaccgttgtcatctgatttag

SEQ ID NO: 66518 - DNA, 284 bp, Heterodera glycines
  misc_feature (230)..(230): n is a, c, g, or t
  misc_feature (270)..(271): n is a, c, g, or t
  Genomic contig location: Contig_ID=SeqID_37440; Location=1358..1641; Strand=+
  SCN-specific regions: Sequence locations=1-13,35-131,169-284
atgacttttttcgtacatttctttcactttttaagaaaatgccgaaaaattgccatctgtgaaataccaattcaaatacggtatcaaaataagttatggcccaattgttttaaaatttcgaaagttttttgaaaataatttttatgattgtttaatttaattatttatgcagtttttgtcaaaattggttgcccccatcagtttttgtcttatgattttttttataatanataaacggaaaaaggatgacctaatatccctattaattgnngttgtcataacta

SEQ ID NO: 66519 - DNA, 2172 bp, Heterodera glycines
  Genomic contig location: Contig_ID=SeqID_7962; Location=2505..4676; Strand=-
  SCN-specific regions: Sequence locations=1-142,164-283,308-409,487 -609,631-663,685-712,741-909,932-962,989-1320,1360-1554,1593 -1858,1884-1900,1922-2172
  Gene Ontology: Mol. function=prolyl oligopeptidase activity; Cellular component=cytoplasm; Biological process=protein metabolism
atgttttataattccaccaaaaaatgtcaagttgtgccaacaattggggagaatgtgcgcccaattgcgttcaatgaattgcatgccaatgccaatgccttcccatttggccatcgcagtgccaatgtggcaaaaatggcgcaaatgggaaaaagtgagcagaaacattttatctccgaagaatggcaaattagtaaaatccgttttaattgtgctgtttcagcaataatggcaccatttgctccgttctccgagcactccaaacgaaaattgagcacaaattcagcagcagcagctgaagaagcgaatgggacaaaggcggggacggcgattgatccgcgggaatatccgcaggcaccgcggcgaaatgtggcggataattaccatggcattgaagtgatctttatacattaatttaatatataaattttttaaatttttcattttatattttaaattttcatttttttcttaattattttatttcctttctgcttttctcatttttcaggtccccgacccttaccgcgccctggagaacccggacgcaaatgtgacacggcaatttgtcagccaactcaaccaaatttcgcagcctttcctcgaggccagtccattgcggcaaaaaatgaatcaaacgttcgtttcgttttaaataattcgaattaaaatttttttttttttgccatttgaatttgccttaaatgatggcttaaaaattctaaaaattaaaatataaagatgcgatgcccttctcgtttttctttcaattcttctcaattcagcctcaccaacatgtggaattacgcagaattcttcaagccaagcttccatggcgatttgttctattattaccgtaacagcggcttacagagtagggaaaacggaaactgttaatcaattctctttatatttgaaatgccttttgtgatttttgaaggaatttagtgccctaaaagtggaaaatgttttctttctcttttaaggccaaagtgtgctttatcagtccaattccatggacgagccaggcaaagtgtttctggacccgaacacgctttccaaggacggcacgacggcagtgaccatggaaagcttctcgaaggacggcacagtgttcgcatacggtatctcagaaaagggcagcgatgcggctactgtgaaggtgggccaaacgaagcatttttgggttcattcacagatttttagtttaaacaaagcaatggtgatgagctgcccgatcaaattgctgacgtcagattttcgggactttcatggctcagcgacggcacgggactgttttattcggtaatggcacggtacaatttaataaattgttaaaaaagatttaaattttaaaatggcctctttcagaaatatttaaaacaattggagacggaggaattcaatttccattcgcttttcttccacaaaatgggcaccgactcggagaaggacattttggtggtaagaacggccgacaattttaatttgtcagttgattccatccgatgacgttaaggtgcaaggacgcaatcagtcggatttgctgatgtgattttaattatttttaattcattttaattctttttttagctatggccaagtgtcatcggatggtcgctttttgtttgtgtcttttgggggtaatgcgaacgaccaaatgttttactgcgatctgccggctgacaacaaccgaatcaccggtccactgaagatgaagccgctgtttgaccaatttgacgcggattatgaagtgagcaaaagttgttccaagtacatacatacagtatagctgtgatggtgtatattgtaaatgaaattatggtaaataaaataccaatcacttttttagaatcaattaaaacacaaaacagcacaatggtcaattcaatttttgaattaattaatcacttaattaatttgacatacaaatggacagatggtggactcagacgaacactcggcactgattttcaccaacaaagatgcgccaatgtacaaattgatcagagtgaatctcgagggcagcacgacacagaagccgcaagaggtcataaaggaggacccaaagcgaagaatgcgatttgcttaccccgtgaacaaagacaaactgttggtttgctacatggacaatgtgaaggtgctaatgaccaggggaccattattaagtaa

SEQ ID NO: 66520 - DNA, 103 bp, Heterodera glycines
  Genomic contig location: Contig_ID=SeqID_37442; Location=701..803; Strand=-
  SCN-specific regions: Sequence locations=1-103
gcgtgatgaaccaaaacgtggtggtggcggatcccaatttggagaattcggagcagctggactcgatggaaatgagacggcgccttttgaacccgaacaatga

SEQ ID NO: 66521 - DNA, 165 bp, Heterodera glycines
  Genomic contig location: Contig_ID=SeqID_37443; Location=382..546; Strand=-
  SCN-specific regions: Sequence locations=42-165
ttcattatttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgccttttt

SEQ ID NO: 66522 - DNA, 1222 bp, Heterodera glycines
  Genomic contig location: Contig_ID=SeqID_37450; Location=314..1535; Strand=+
  SCN-specific regions: Sequence locations=1-187,211-380,402-696,739 -916,938-973,995-1222
atgatattaaaattgaaagctccaattctgctgtattgttttgttcaatgtttaaggtgacaatctttaaattcttaatgatcgttgttatttttttttaaattagtgctgtcaaagtggacaatgccgagcaatccgaccaaccaactggcgattcttcctccggacaattcccaatttcgtatcctccaataaaatatgaaaacgatttggcctatgtggagaaaccgagtggcaacgagcgttgtctattctacgcggaaggactttctgtcgtcgtttttgccactaaaaaaagtcaatcggcgtgggcggactatcgctctgacaccaaagaaagtccgaagtataccgcgtcaattgaatgccaaggcaatatgaatgtgggcagcagctttgagtaatttacagttattgtaattcatgaatccataattctttaattttttcagtgtctatttgaaaattgacggcaaagcggaaggagttgtgagagctgacattggaaaaaaggacgcaaaaagtgtcttcactgtcgaaggagccgaatttatgtgtgtttcttctcttgtggtggtgacgctgtcccctccttcagactcaacttcaacgtcacacaagtcggcttttggcaattggttggtgccaccgtggaaagaattgaagtgaaaggctcttcggatttcctgaacaaagtaattttgttattatttttttattttttttataatattttaacaattcagaatttgaatgtcgacaaaaaatggactttggagccttcagttgttccatccacaaacattaacggcttcaaagattacagctttgcttgtggtcagaccaacccgatagtgtgggccctaaaggactcaaatgattacgcagtcggaattacgctgaacaatgtgcaggtagaaagaaagaaagaccatcaattataaaaaaaaacttcataaatccactcctttcattacataaattcttttcaatttatcttgttttggcctgtcaaaacggttggcagaaattaaggctctattgcagttcccacgagtataaaaaaaggcacgaccataaaataagttagcaatttaatgcaccatcactttttctagaagcatctcaattaaacattattgaaatcattcactagctctaagggtactttacagcacccgtttttaccaatttcgaacccctgacccgaactcgaacaaaa

SEQ ID NO: 66523 - DNA, 1475 bp, Heterodera glycines
  Genomic contig location: Contig_ID=SeqID_7963; Location=174..1648; Strand=-
  SCN-specific regions: Sequence locations=1-93,115-362,403-840,863 -1272,1294-1475
accgggctcgtcgaacaatgggttttggccaagaccggtcaacaatgcattgccactcggaaccaatcgacagcagcgttcgtttttcgatgactttttgaaatgcccttttttaaacatttgctttttcactattactataataataccccattttctagtcactgcttcgtcttttgccaactccgcccaagtccgaccgtcgactgctgccaaaacgagcaatgttccattcaatgcttcggttgggtcgattgatacctccgttgggtcaacagctccgggtttagtgattcaagaggactattcaatggacgaagccgaaagtgacaatgatgttggttttgattaatttgaaaaccattattttatttatatttatttgaaaattaaaaaaaaattggctatgatgacactttttggtagcgatttgtccgaactgtttgtgattttttgtttgtcagttatgcggacaaaaggccgagtctgagccaaaatccaatttttatttgatgaatatgccaattttttcgctttttaggcccgtcttcacaccgattcagcaaaaaccgacccaatgttaaagacggcttttgcgtccggtcatcagaatggaatcccggaacaaccaccgcttgatttgttggagccggacaacgaacctttgtcattgcaccaagtcaaactctcaaatatggacagacgtgctttcgattcggcaccaaacaaagaatttactccccacgaattggaattgcgtccccatttgtccttcttggaacggtaccgagaggacccaaattcgaactcatggtgagacatgaaataaaaaaggacaattacattatttatttgtttatttcatttagcatccgtttggaaaatgttcccaaaatggtttacgcggaacaactcgccgaatttctcggtgtccaattcgatgcgccatatgaaaacattgcgcggatgcaaaacggcgtcctttacattaatttggtaagcattttctcccatttggcaaaatttttctcttaaaatgattaattttcttaggcggttttttggttgccgatttcggacatttttttataaaaactaaattaagtattgtaaattttaagccaaacgaagcaatggccacaaaagcggcaatacggaacatgaacattctcaacggacatcaaattgccatcacgcagctgaaacgggcggagatggccgacgcaatccgtcagaatatgataatcatccgggaaatggtgggtgaattagtttcccttttttccatttcaattttcgttccttttcagtaccgggtttccgtcgttgcgcgtggcttccctttggtcactcagctgaacgaagttgttgcgctgttcgagcgctttaatttgaacaaagacggggccgagaagtgtacggtgaagccgagcgacaccgtctcaacatttcttctcacatttgcatcttcgcag

SEQ ID NO: 66524 - DNA, 3935 bp, Heterodera glycines
  Genomic contig location: Contig_ID=SeqID_7964; Location=156..4090; Strand=-
  SCN-specific regions: Sequence locations=1-285,307-926,948-1160,1182 -1347,1369-2011,2033-3352,3375-3544,3570-3766,3788-3935
atggaacaagtgattgccgatgcacaagctctcgccggtgctgcaaaacagcaaagtgcaccaagtggcgctgttcaacatttggggcagcaacaaacggccggagtgaaattcaccgcagatgataagtcagcgaaactagcagaccaatcggccaaggatggagcacaatggaaatttcaaagtgaaggtcattttcggtctttgggcgtgggggttgggaatgaagaatttcgaaattgtcagaaataaggaaaaccctctctcgccgtgcaccgcgaggtattcattgaactgccaaccacaccctctttttgtcatttggatctaatctcggagaaaaaaaataggcaacatctcataaagtgttgaaaattaatctgcctttttgcgtacccacaattagaattaaaatcgctcgcactcgccgtttttgtagacataaaacttgttaaaagattttgaatattcgaaccttctgactcaattcccgatacgaatttttgacattcaatcaaaatgtctcatgtctgcgtctccataagtgaagcgctccttctccttactcgccatttttactgacgaattaatattattttgacactcctttcctatggtacgaactttacccttggatttttaaatcaatacattgttgaatttaagtacctaagatttttctaaatagaaaaagtaaatactgtaccaataattgctggtttgtcgccccccccccccccccctcccagttgatatacaactctcatttaaaagatgaaaacatttctggggcttttcggggtagatttctgatgcgagatttaacaaataaaacatcaattactgtgtcagtttcgtggtcaacgacacggataagccacggaaacacgttttcacaatttcttaatcaaaaacagggggagggagaacaaaacacaatgttattccaaaaaatgtattgtacaatcagccggccacctatcatttggcacatcgtgtccttaagcgtaatacgctttttaaatttaaacgacattattagtcaaattcaaatgctactccatccaaagcatcggagttaatttactttcaatgcacacctttccccaccttgaacattgtcttaaatgtatgtaaattttaatgtttgttaacgcataaattttgacatgccttaatatataattaagtaccagacatctcccatttgttcttttctgtccttcgctttatgccttatttgtaagctacgcgccaaacggcatgcttatttgagcatgacagaatttttgtcaattgtggtataatagccaaaagcgaatggcttacatatggttaattaatgttccacaaaaaatgttaaatgattttacgtagttactgattccactgaacatatgatcagcgttttcgtattcaccgatcacatgacagccatttaagttgtcgaacgacaaaatcaaaattgtaacagacaaaaattacaaaaacaatagaaaattgaatatttctgttcaattcagttatgtaggagttcgttcttttttacattttcacattatttgtcttcagttgcgcttcctgctgtatcttcttcgccttccatttccacggcttttgctccacaacaaaccattgccccgttgtatcaacaattgtttggcggtgactcgtggaagaatcctcaacttcaactgccacaaaacgtgccatctcaacaattagctgcttcagggcaggggtcgcactcgcaattgctgttccatgagcaggctgctccgcccgtttctcagtcggcacccgtcccggtctttcccggctccactcagccgtcttttggcggagtccctccgtcgtcgttgggccgtttactcggttcaccaagcaaaacacaacagcaattgccaaacataccgcaacagcctccgggatttcctcctcctcttaacgtcccttcacagcctttgcaagcggctggtgttgcccaacaatcgcaggtccttttttgatcaaaattcaatttttgtttttacatgatacagaaaagcagcaggaagataataatattgtcatgttttgaatacagctgaagacattatttttctcacaaaatttttttttgaaatttaaatgataatttggcataaagaccgactgaattactaactgagtaccgggcgccgtttattgaaaaatactggaaatgtataaaaaatggtagatattctcattgttagacaattcgctcagctgactccccattgaaccgatccttattttttattcgttgaccaaagagaattaggtatgtaatgtttattaccttaaaaagttttaaaaaaatcacaagaattgggacttttcgccgtttagcctgtgactttttcaaattttagccacgtccttcgaatccatcttatgccggtgatgggtttttcaaccagcaacctgcggcaggctatcacaaccaacgttttcagactcctaatcagccaattcaagtttataaccagcaacaaaatagaccaacaggacaaggtggggaaatgaaaggccgatatttgcttcatcataattcctttgcagctccttctcatcatcaagctcagtttggcatgccaaatcaggggccaattgcaggacaatatcgtccgtctcgaccgccatttggacgaagaggtggcgcacacggaggagccgttcaacagcaatttggtggaccaacgcatggagttggaggatttcctaacgcctattctgagtcgaaaccgatgggcggagctcattatcagcaacaacagcactttcaaccccgacaaactcattatcagcaacgttttgaaggagggattaatggaccaaaacgaaaacggagcaggtaattgctttttttaattgacttttgcagtttacaaaatacaaaatttcaggtcaccatcgggtccgatggacccaagaaagcgtttttatcagggaccatcagctcatgggaatgaattcaagccatccgcgcaattttctccaaattctgccgcttttcaatcggagcctttggtgaaggaacgcgtttgtgttcaattgtcaaatgtgccatacaaagccacctttttcgacgtgaaacagtaagtgcattatatacatgctacattatttactgcaaaaaatttaaaggtatttatcaaccacgaatgctgaatgtgtgaaagttacccgcgtctatcagcctgatcgaaattattccgaccgttggattgttgaatttgacaacgagagggacgccagatcagtgatcagataccatggcgagattaataaccgaacaattcggtgagtgaaaaaacagtgaagctttttggcttttcagacctttttgcacactttaaatttcttccccacgagtatatccacttaaaatttctaggacggaacgaataacggcacggaaagcggacgagcaatacgcggtcatggagccggacgataaggacaggggagacaaaaggtcttcagacgatcccaacagcagaagagagcgcggacgaggggagagggcggacagagacaggccaagggagagggagcgcgacagagggaccaatcggagcagatccccgcgggggcgaaacggacgaggacggtcaaacgaccaaagccgatcggagaagggggctgctacctcatcaacatcatcatcaacggcagcagcaacaacgacagtttgggcaaaggaggagcggacgaagccgagtgatgagaagaaagaggaagagactgacagagacaaacaagccaaggaacaacagcagagacaacgcccagcccaacagcagcaaccgccggcagcggactcggccaatccgatgggcccactgaatttggtttcaaatgcagctgtttttggagcgttttcatttccggagaatcacgccaataat

SEQ ID NO: 66525 - DNA, 991 bp, Heterodera glycines
  Genomic contig location: Contig_ID=SeqID_37455; Location=141..1131; Strand=-
  SCN-specific regions: Sequence locations=1-211,233-346,368-730,797 -814,840-909,933-951,983-991
  Gene Ontology: Biological process=tRNA modification
atgaacgtcttccggtccgccctgctcaacgcgggcttccgctgctccatctcccactgcaatccgcgggcagtcaaaacggacgcgccgacctcttttctgtgggacgtgtgccgtgaatgggtgagaggagcacgcggagagtgccgatgcaaatgatcagtccgttccattttgcaggcaaaacgaaacggaatcacagccaaaggaatggccgaggcgggggaggacagtccgcgcagtcgcattttggcgaaggaaacgaagtccgaccgacccattccatgattattattagtgaacgtatgttttttaggtgtgaaatcaacttcagcactcatcccggctgcagaacaaagagaccattccaagccaacgacaacaaaccgaaacatttgttaccattggacaacgggtgaattttatgtcaaaattgagttaattaatcaaatgaatggaatttccatgttgagcatttgtttgacacgggagaacgagacgagtcgcaagtcgtccgtctcttcttcgcagtcttcgcggactcctctcctcacaatcagtcaattaccgaagactcccgaccattattgggacatcagattcccgactcatgacgaacagcgccagaggggttatttgaaattcacggattctccgctctttaaaaaaactgcgaagcgccgtttattgtaatgattggcttaatgttggctccctaagaatttgagtttttgcattattttgtttatttccttttttattctactttttattgttatttttgttgtttttatatgtcatgtcacaaaaaagagatttgtgtacctttttaatgggtttattatggacctcatcaatatttccttttaaataattcttattatttattgttgagaaaaaagttattttttaaggaaacaaatgacaaagttcgaagagaccaaatcaaaattagaggcagaatttgaaaagcttcgaaatttggaaaaag

SEQ ID NO: 66526 - DNA, 351 bp, Heterodera glycines
  Genomic contig location: Contig_ID=SeqID_37456; Location=4..354; Strand=-
  SCN-specific regions: Sequence locations=1-20,51-351
atgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaataccgagctcacgcagctactccgagcatctcagcgcactccgcctgcaaatgccccattcgccactgaacagaaggacagcaaaccccagtctggaggctag

SEQ ID NO: 66527 - DNA, 56 bp, Heterodera glycines; identical to SEQ ID NO: 52733
  Genomic contig location: Contig_ID=SeqID_37457; Location=658..713; Strand=+
  SCN-specific regions: Sequence locations=1-56

SEQ ID NO: 66528 - DNA, 674 bp, Heterodera glycines
  Genomic contig location: Contig_ID=SeqID_37458; Location=864..1537; Strand=-
  SCN-specific regions: Sequence locations=1-36,59-158,180-306,328 -444,466-571,593-618,640-674
gtccgaagaaaatgccagatttatgtggaatgatcatgagattcagactcaaaaaatatgtactaattggcgatatcgagaaagcatttttacaagttggtttagacacaagtgacagagatactacaagatacttatggattaaaaaagaaacaataaatgaactcaatttaactaaaagagatgtcgaaatgaaagacattgaaattcgaagatttaagagactaccatttggtgttaatgcttcaccatttttgttagcagcagtaattgaactccatctatccaaaatcgaaccaatgtatgaaaatttcaaaaatttaaatacacatgacactgatctgaatctatccgataaaaaagataaattcgaaaaattatgcagagaattagctgaaaatgcatatgtggatgatttcgtaatgatgtgtgaagatcataacgagataaaatttaaacatttttggatcaaagaaatttttaaaattgcatcaatgaatttaagagaatttatttcaaatcatgaagaatctaacaacgaaatacaaaaaattgaaggttctgaaataccaaaattgagcaagcttcttggaataaaatggaatgtcgaaaatgacgaattaacaatcccaataaatattccaatcatagccaagggaacaactaaaagaaat

SEQ ID NO: 66529 - DNA, 1652 bp, Heterodera glycines
  Genomic contig location: Contig_ID=SeqID_7966; Location=496..2147; Strand=+
  SCN-specific regions: Sequence locations=1-1539,1561-1585,1608-1652
  Gene Ontology: Cellular component=extracellular space
gttcgcctttgctttgctcaacagttcgtttttgccaactccctattaaagctgatttcccttcagtttgctacgcccaattggcccctccgacgacgcgaaactttcgctgcttttccaacggctgctgtgaccaacacggtgagttgggtttggtcatttggagtacgaagttggcattcgttttcttggcatgacataatgccattataagaatcgaagcatttgatgagtttcccccccccccctcccctcagaatggtgccgtttctgggcatccatcggcgaatgcctatcgaacgcagattggatggcaataaactgtcagttggcttgttcaacttgctcccgcgcgaattccgcgtccgcccctccgacgcgtcctccgccgcctcccgcgccggctgcgactcgtccattcatcacagaagtaatcacaacggcgacaatggcaagcgtaacggcgagaacatcggcagagaggaaaaatacagtaaggaggaaaagaacgaaaatacggtaaccagaaatggtggaagatacggtagcgaatagaaagaaaaatatgggtataaaagtcaaacaaacttaaaatgtgaatctgtttgctttggctttccattgttcgcctttggcagggtccaatcgcgggttcctgcgaagagatttcacgcaatccgtccaccgctgccactcaactggccaagtcggggctgctgaatccgatcgaagagtcgcgccagagtctgtccctggacgacatcacccgcgcggtcagctcgggctgtgtccccgaggtttgtgccgtggcacgtcccccgccccccgtcgctattttgccaatcttcgtccgttgttcagtcgtcccccggggactgttcgcgttcgctgtgttaccatctctccttccgaacaatggatggaatgtgcaacaacctcaacaaaccgttgatgggggcttcttttcgcccttatttgaggtgagattggagaaaagaacaaaaaaataaggcagaaaaagaaacgaaaatggacaaatttgattaaaatattaaagagatgagagagagagaagaagaagaagcttccccgagaggaagattaatggacctattgaaacgacaatgatcatatatgcttgagcaaatcgggaattgaatgttggtagtttagctggcagaacactgtctggaaagccagaaaaagtcggcttaaagccgctccaccccatagtttttcccttaaagacttcccatgatcgctcttatattcacggcttttggttggaatgggaaaagcttttcgccattctcttctttttccgttgccattctctttctctttagacatttgccggccgaatattccaatggcttctctgagccgtccggtcggttctccgttcggccttgcccccatatttctccaatgttcatttggcaggtgtgggcaaaccgaacgcgcgcgaggcgtcccgtctgattttggcgagtgcgcaagtcgtctcccacgaccaactgaactcgctgctgatgcagtggggacagttcatctcccacgacatggccagaacggtcagtgactgtcctccttcttcccctcctctctctgatcactttttccgtcgcttcccccactgaatgatcgctttt

SEQ ID NO: 66530 - DNA, 923 bp, Heterodera glycines
  Genomic contig location: Contig_ID=SeqID_37462; Location=27..949; Strand=-
  SCN-specific regions: Sequence locations=1-786,815-923
atggcactcggaggatggaagcgcaagcgtgctcgactccgttctctacaaaacctgaaccgcctgttcgtccgcccagcgctgaccaaagaacaactcaaggaagaatatgaagcgcgcgtacgtccgagtcgaaagacggcggttggttgggcctcaacttcaagatggtccaggatttttttggcggcttccctgtcttcctgaacacgttccgatgggcgaatggcattgctttccgggaggccaatgaagaccagggtgcgttgtcgttcttgctccgcgagtgcgacagcgtttgggtccaggtcctgtgcaggtgccattgaacgttttgcgcgaggcggagtgatgtttgatgcgttggttcgcttcatgtcgaataattagcaagaataattgttttttgcgatcttatttggactacagagagacaaattaaattaagtatgtttgaaaattaataattttagacctattttaaggtgtaaaaaaagtttgtacggggcaagggtggagcgcgactgcgacgtgcgaaatttttttgtttgcacgatccgcgggatttttctgtccgcgctccacccttggtacggggtgtcatgacaactggtactaaggcaactcgtacaatttgtttagacttggcctaagctttaggcttaaaagtctaagctaggcttattctttattatgtaaattttttattgtaagagttgccattgacttgtgtacggtacatggtcatcatgcgaatttctacataactacagtgatgccgaaaagtaattaagaaaaataataatttttttttctcttcattaacttttagcaccaattttcagaaccaattttcgaaatcagattccctccaccacttccttttgtactttttcacatgccctgtggacattgccatttag

SEQ ID NO: 66531 - DNA, 150 bp, Heterodera glycines
  Genomic contig location: Contig_ID=SeqID_37464; Location=1..150; Strand=-
  SCN-specific regions: Sequence locations=1-150
ccaggactcaaatgtcccgctgaggccaaaaattttttctatttccgggaaaaaatcgaaatttttccaaaaaaaataccagtcgatagagctcgaaaaactatgttttggaagtggtctccgtttttctgggaaaattcgttaaaaatt

SEQ ID NO: 66532 - DNA, 504 bp, Heterodera glycines
  Genomic contig location: Contig_ID=SeqID_37465; Location=140..643; Strand=-
  SCN-specific regions: Sequence locations=1-61,83-107,129-504
  Gene Ontology: Mol. function=DNA binding; Cellular component=nucleus; Biological process=body morphogenesis (sensu Nematoda)
atgaactcgacggtgtggcacactttgaccggctttgtgatgtatttgggcaagtccggcaaatgtaaaattgacgagaatgagaaaggtgtggcggatgggattagttttttcactttttagcaaatttttgaggttggcacattcaatacattgaccaggaggaggagttacgtcgtcaaaagttgcagcagcgcgccaaacaggaaaaggacgacgaggaacgaatgcatgaacaattgcagagacaaattgaaaggcaagcggaaggcgggggatggattggttgaccaaaggcatttaaatgccgaaaattcgtatgaaaagccttcccctttagagccaaggagaagcagggcacggaggacggagacgaagtcgccaaagagccgcaggaattgattcgcaacgatgacacgaaaatcgcattttccgttggcatgaagaagccgatgattaccgacataaagccaacaacgacggcatttttcaaaattggcgggg

SEQ ID NO: 66533 - DNA, 56 bp, Heterodera glycines; identical to SEQ ID NO: 52733
  Genomic contig location: Contig_ID=SeqID_37467; Location=431..486; Strand=+
  SCN-specific regions: Sequence locations=1-56

SEQ ID NO: 66534 - DNA, 814 bp, Heterodera glycines
  Genomic contig location: Contig_ID=SeqID_37469; Location=144..957; Strand=-
  SCN-specific regions: Sequence locations=1-141,165-321,377-390,412 -533,571-814
atgacaaataaatgtgaaacgacggaaaagggccaactgtcagccgaagaacgaatggccaaacgattgacacggaaagagtgagtcaaacgatgacatctgatcagagtgatcactcctgaaggaattttgggcgatcgaaaaatcttaaattaaaatgagtattcgaaggaaatttttgatgggagctaaaaagatttaaatggatgaattgccagtgattttcgagagtaaaaactcgagaaaagtctcggttatttgtgcttccaagcaataatttaaaacgtttttgactttatcgatttccaaaatgatcaaagcaaaaaaaagaaaattaatttaaaaattaataaatttttcgtttatttaaatttatcgcaaaattcttctaaatttgttaaatgcgtaaaaaagaattgctccatcttttgattcgctgctcaatggttgttgctcaatgtgccgtgttggcggtgccttcggccgtttcgtccatttccgaaatcgccgttttgggccgctcgaacttttggcccttaaacaaaaattaaaatcaacaacaaaataatatatctaattaaaatcaaattcactgaaagcaagttttattttattttatttgtctttttgtagagcctggaattttgaaaaaaaacccggaacagggcccggatttatgaatcggacccggacaggattccggatcaaaaagtcctattttaacaggactccggaccattttacattttccaaaaaaaatacagggcccggactaccggactagggccctgggaaaccctggctgataattaaa

SEQ ID NO: 66535 - DNA, 836 bp, Heterodera glycines
  misc_feature (796)..(796): n is a, c, g, or t
  Genomic contig location: Contig_ID=SeqID_37470; Location=27..862; Strand=-
  SCN-specific regions: Sequence locations=1-326,348-713,753-762,785-836
atgggtaagtgaatcgtacaatttcaatggaattctgctcaatggaacgcaaaaattccgtctccaaatgtgccattgtgtcgggaaaggccccaattaacacggaatcagctgaagcaatagatgtaattcttgatttgtcgttaatttccaactgtttttgttccaggaattgaaaatgttgctgccaatcttatcggaggggacaaattgcaatggacggccgaggaaaaggaacaaatcgaccaaatatggcatttcatcgggcgacactaatgaaacggaagtgcccgtctttcccgcgcgggcaactcggccttaatggaccgtttacatttttgatgaaaattatttgcctggtaaacttaccgactctgtgcacaaagagttttgctttgggtgggaaatggaaattgacggcaaagtccaacaagggaatgtcgacgccacgcgcagcaatgtcagtgacaaccaacagaaagcattcgccgtttcgaaacctgaaaaccaaaaccctgagcggttgactaatttgaagttggttttgtggtttcgacctggcaatgttctgcttgcgagcgcccgggtccaactgactgaacaaataggccgggtccaaattggcttcttggaacacagcgaccacctaaacaatcgtttatgactattcccgcctgaatttttttttgttgaaaattttgtcattttcggagaaattttttgaaaaaattaataatttatcataaattttacataatcacgaggaaagtttttagtttcttataaattccgacgnatttttttgaaaagttctatcattgtttgatttaaataaa

SEQ ID NO: 66536 - DNA, 849 bp, Heterodera glycines
  misc_feature (811)..(811): n is a, c, g, or t
  Genomic contig location: Contig_ID=SeqID_37470; Location=217..1065; Strand=+
  SCN-specific regions: Sequence locations=1-299,321-645,667-735,757-849
gtggtcgctgtgttccaagaagccaatttggacccggcctatttgttcagtcagttggacccgggcgctcgcaagcagaacattgccaggtcgaaaccacaaaaccaacttcaaattagtcaaccgctcagggttttggttttcaggtttcgaaacggcgaatgctttctgttggttgtcactgacattgctgcgcgtggcgtcgacattcccttgttggactttgccgtcaatttccatttcccacccaaagcaaaactctttgtgcacagagtcggtaagtttaccaggcaaataattttcatcaaaaatgtaaacggtccattaaggccgagttgcccgcgcgggaaagacgggcacttccgtttcattagtgtcgcccgatgaaatgccatatttggtcgatttgttccttttcctcggccgtccattgcaatttgtcccctccgataagattggcagcaacattttcaattcctggaacaaaaacagttggaaattaacgacaaatcaagaattacatctattgcttcagctgattccgtgttaattggggcctttcccgacacaatggcacatttggagacggaatttttgcgttccattgagcagaattccattgaaattgtacgattcacttacccattaattttggtttttcactttggcactttaagatggatttgcagcgtaaagccgaaaatgcaatggccaagtatcagcggactcggcaacaaccatctgctgagtctgtgcgtagagtgaaggccgagttcagacacatttcgccgggcccacacccattttttgnggaccccgttctgtttccggatttggcattggaacaac

SEQ ID NO: 66537 - DNA, 378 bp, Heterodera glycines
  Genomic contig location: Contig_ID=SeqID_7968; Location=1840..2217; Strand=+
  SCN-specific regions: Sequence locations=1-14,188-205,282-294,376-378
  Gene Ontology: Biological process=N-linked glycosylation
atgaaaatagcattggggaaggaggagagacggaagagaaagagaggaaaaggaaaaattcgaagcaagaagagaaagaggaggaaaaggatgaaaatagcattggggaaggaggagagacggaagagaaagagaggaaaaggaaaaattcgaagcaagaaggaggggagaaagaggaggaaaaggatgaaaatagcattggggaaggaggagaaagagagagagagagaaaaaggaaaaattcgaagcaagaaggaggaggagaaagaggaggaaaaggatgaaaatagcattggggaaggaggagagacggaagagaaagagaggaaaaggaaaaattcgaagcaaggagggggagaaagaagaggaaaaggatga

SEQ ID NO: 66538 - DNA, 846 bp, Heterodera glycines
  Genomic contig location: Contig_ID=SeqID_7969; Location=245..1090; Strand=+
  SCN-specific regions: Sequence locations=1-375,414-709,731-746,768-846
atgacggggattgagagaacttttgacgccttatatgtgccattctctccatatttatttgctgcttgctttttgcccgcggagtccccttgcctccctcgtgtcattgagtctcttcgactattctcatcgatcttaaccaattggtttcaatccattcatttggtcggttgcccgctgcgattggtgacgattttgatgggccaaattcaacaatttctgctggccaagcattgtccaaatggttgcactctccgagaaaagatggccaacccaagcaattgcattgcgaagatcacaacgaacaaacgaacactgattggatcaacaatttcaaggaggtgtggtccggggggggggacaaaacgtagccgcaaaattttattttaattaaaaaaattatttaaaatttagttatctagcctaaatcaaaaaaaaatagataaattcgaaaaaaattattaagaaaattcaaggaaatgtaaaaaagtcgtttttttatttttggaaattcagaaaattagtttttatacgagacggcgacgttttaggggtgtacccggtctgtggatggcattctgagttattttctgaaacccgaccccaaaaaagttataaatcgaaaatttctgaaaaattccgaattttatcaaaaatttcggaaatccgaattctgtgccatccctgctggtgtggctccacatttttggcaaatgactgatttttgttttccaaattgtttagcattttcttcgtgccaatgccatttcttccgtcagttacgaaattcatttttctgttcgtgcgccgtcaatgccaatggtgccatatacaaaaatagttata

SEQ ID NO: 66539 - DNA, 796 bp, Heterodera glycines
  Genomic contig location: Contig_ID=SeqID_37472; Location=541..1336; Strand=-
  SCN-specific regions: Sequence locations=1-83,105-796
atgctgctgaagagtccgccgccttcgatgcatgcattacggacgagtcgccgtcgatctgccgatttaaatgcttacatttcgccatcaggcgaaaggacggtgtccagctcgagcctactcaatcgtacgttcttgactcatttgattttattgatttgcatcttcacaggttcacccgtttgggctgacctcgccgcgaccattcgaaatccttccgtttgtccaattcgaccgttgtcaaaggcaatttcattggatcgttctgtcgaacatacaaaacggtccacttcaattgatgtcaatgcgaacgaatgtgagaagaaacgcgaagataaagacaaggtgaccgtaatttcgacgaagtaaaacgagtcagttttaagaaattaacggatccgatgcttcggtctcgccaaagtgcgttcacaggacaaaagggaaaaccccgaagattttgtggccgtaaaaaatgcgcatcggaggtgcgaatctaacaattcgtaagcaaaaatatggtccaaaattccagaacgaactaattgatggcggtgatcagcttcagagttcggccaatttttacctaagccatcattcgaccacttcgtcaagtgtttctccttcgtctttctgtccatccaaagattctcacaactcttctggaatcgaaggcccatcatcggctgattcggagagttttaatgcaaaaacaaaacaaagcgctgacagagccacggaaaacgtgggacaaagtcggggaaatgtgaaattcgatgatacaattatgaagggcaat

SEQ ID NO: 66540 - DNA, 702 bp, Heterodera glycines
  Genomic contig location: Contig_ID=SeqID_37476; Location=97..798; Strand=+
  SCN-specific regions: Sequence locations=1-613,635-702
atgactagccgagaatgcatcgtggaagtgaaggtgagtgagcagcgtattgctaaacaatccgttaacattggcactcacttcattaattgcctcattagcaatcatccactttcttttaacaattcttttccattcattccactaattgcgtcattatcgcttaatttgtcgttcctttgcctaacctttctaattcgttcgctttatatttgatcatcctttctcttcttcgcaggtcgcctacctgcagtttctgctgcactgttacatcgacacggacatcgaactgaaggacgccagcaacggcgagtatttggacgccattttggaggatgccatcgcggatatgggcaaactgagcacgcggctgcgccagatggactaccagccgaagtttgggccggagatcgtcgcgttggagcggtacgtctgtcagacggtgacggaagtgttggtgcgcgtgtttgagcccgcctcttacggtcactcggcacacattgacattcgcgtgggtcatttggacaatggcacaccgaaaagaggcgcatttgcccatttagcagcagcaaaaacgcttttcgaccataatgcagcggctgagcgagttgcagaacggcgtgctgagggggcgacgccactcgaactgctccaagaactggtaccgtattgtggaatgtgcgaaaagactgacgaaatacg

SEQ ID NO: 66541 - DNA, 396 bp, Heterodera glycines
  Genomic contig location: Contig_ID=SeqID_37477; Location=239..634; Strand=+
  SCN-specific regions: Sequence locations=1-246,268-309,331-396
atggagaagatcgtctacttcaagctgatgcaaattgtgctcactttcgcattcatttggcaactcatgtcacttcacgaattctgcggcacttttgccgacccaaaagtcaattcatttaccaaatttcactaatgatacataatgatgtgcttttttcaggcctgcatccatgacatctctgtgggccattgcaaacgctttgcgttcatcggaaaggactcaaaaagcggtgaattcggcgttgtgtttgaccatcacaaatggcacgaccaactgtcgatgagcagcaccaatggccgatcattcgaagaacagcaacaccaattcatggacgaattggccacgaaattgccacccgctggacgcctttgcattccgataacggtgaactag

SEQ ID NO: 66542 - DNA, 363 bp, Heterodera glycines
  Genomic contig location: Contig_ID=SeqID_37478; Location=355..717; Strand=+
  SCN-specific regions: Sequence locations=1-293,316-363
atgtcggcacatccaactgcgtgcggtccgttggcgagcagcggcaacacattgccaactggcggtggtggcggtggagaagtcgtgccattcggaggagttggcggtggagaagtcgtgccattcggaggagttggcggtggagaagtcgtgccattcaacggtggtgacggcgatggcgtcgttttggacggcaataatcccataacaaatattgatatgaaaaatttaaacggaataaattattttcgataaaaatggcacaacaaacacctctctatcagcagaatttgggttttttggtttgggaggagaagtccacgaaacggtggacccaaccaatttttgtcaaagtcgaccaaa

SEQ ID NO: 66543 - DNA, 938 bp, Heterodera glycines
  Genomic contig location: Contig_ID=SeqID_37480; Location=21..958; Strand=+
  SCN-specific regions: Sequence locations=1-210,233-938
atggcaataattcttaatggagaattccatcgtcgcataagcagcatgcaagcaggcacgacccagattcctggcttcggtcagttgtacattctggacccagtcgaagccatggagcaacgacgaaaaaatcccacattcacgggtgaaaaaattacgaacgaagaagagtttgtgcagggtcatcagcttagtgatgagacccttgaagttttggaacaaatgatccaagaaaatcacccagcagcatctgcttataagcaggctcgtgaacagctccaagagttgttaaaacaacaaaggactgaagagcttcggttcttcagaatgactttgttggatgagcgctctgctccgggtgctatgaaagacccgaagttgcatccccaccagataatcaccccctcaacgggtgaagggatgttcgcgattcatgcggatctcaacggtgccccggcaccaaaagggatatgggtggaaaacaagcaagggcagctgaacgaaattgctcctctcagtccatggactgatagcttaacctatccattgattaagcctaagggcgacgatggatataaaattggcattccatatgccaaacccgcacaaagaaagcggaaaagcgacatgtctgatgatatgtttgacaatcaagcaatgtcagatgatgacatttgcgataccgagtcaattgcatcgtctgggtctgaagcatcgatgcagtcagtgaccagtcgctatgacaaatcaaaaagatttgtctccctgcgcgattattgcaaatatcatctcgcaataagggatgaaaatttggagtggcaataccatcacattctttcatgtggcggtggtcttggacagcgctgggtcttagaccaagcgtccaaaatgactggcaaattgccacttttttgcgccgtccagacatggacaggcgc

SEQ ID NO: 66544 - DNA, 1114 bp, Heterodera glycines
  Genomic contig location: Contig_ID=SeqID_7970; Location=224..1337; Strand=+
  SCN-specific regions: Sequence locations=1-36,68-98,120-636,658-1114
atgtacgttaaccccaaaaatattctttttctactccaaaaatattttgaaaaatataatgaagaaaccccattaaatggttctgaaattgctattgccaaaaattttgcttctgaaattgaacgatgcctcaaaaacaatgaagaattggactttatggaagaattggtgtttgatcaaaatgccgaatacgttaaaattgaagggcaattgagcgattccgattttgattataattccgaagaggaaattgatcaaattaatagttctttcggatcaggtccattgataaatatcttatttaaaaactcaaaattttaaattcagaaaattcaagcggatcaagtttttttacgtctcctgttaaaaaagtgcctcgagatgattttgcatctttttcggacaagaaaaaggcccttcaattttatcgttcggctgataaggggcatcgttcattatcatgtatgaagtcgacttataaggccaaaaatatatatgcagtggcgaacaccagtcatattatgaccaaacaactgatggttgaatgggtggacaaagttctttgtcctgctcttcgcccaaaccaaaaatcgcttttgatcgttgacagttggactgggtggaacaattttcatccaaaaaatggaattgaattggctgttaaacaaatcccaaagcatggaactggaatttgccagccattggatgtctatgtttttcggtatttaaagggtcaattttcaaatacaaaaaaatttagaatttggaaagaatttaccagaaaaattacgcagtttgtttttgtttatgacataaatatcaatctccacgaccgcgacaacattataaaattacagtcattaatacacaatcagctccaagcaaaaaaatttaacaattggcttaattttgcatggcgcaaatcagggttttatggtgatgagcctttcccagaattcattcacccagtaaaatattgttttgaagtgcccaaacacaatgacgaatgccaaaaattaaattgtgacaataacattttgctccgttgtgctttttgtgaaatttttttatgctttaaacatttttttaatgattatcatttatgtgaaaacga

SEQ ID NO: 66545 - DNA, 2565 bp, Heterodera glycines
  Genomic contig location: Contig_ID=SeqID_7971; Location=756..3320; Strand=-
  SCN-specific regions: Sequence locations=1-396,418-446,468-743,767 -910,932-1311,1339-1530,1558-2387,2409-2565
  Gene Ontology: Mol. function=SH3/SH2 adaptor protein activity; Biological process=protein localization
aaagacggtgaggggagcgcaacaaattgacgacgacttcgacgaccgattggtccgaagaagacgaggaagtgactgtaattttttctcatttgtttaattattctatcatggggagagtattggaaaaccaaattgggcattgttaattaattgaattcatcggaggcttcaaacggtcgtcagccactgaaaggagtgtctgaagaaggtgaagaaattgcgaattccgaattggatgagaaaactgtggttgaactgaagaagcaaacttcgttcgatgcgcaaagccaattggaagcagtgactgagcaaattgcatcctcaaaaagtgacgcggaaaaggttcgaacttcgaagagtgaagtcgtcgtcctttgcttgtccatttgtcctccatttttgttgctgtaattcttcggctttccctttcattaatttttagcttgtgttggtggttggtcttttctctttttttccatttcgttgactttgggtttttcaggagttcaccagcgcacgttcctttgactccgtccaaaaatcggccggtgctgtcactcgcagtcgctccacggggcccgaagtcgcttcaatgtcgagccagaagcaagcggcctctgttggagcggccaagatgaaaaacatcaacaggtcgagagtcaccgttggctccggggggggggggggcgactcaatggatcgaattacagcaattcaattcaaacccatttgaattaacagttcagcattttctgatcttttcctgatccccaatgctcctttttcaatgttttgctttagattctccaatttcgtgaaaagtggcatggaatcgtacattctcgccactacgaaattcagtggacaaccgggggaaagccatgaaataattttggtgggttcttcattaataaataaatgttgttgtgaactgacaagaggaccttcacagctcggaatgttcctttgtgagtgtgccctgaataatttattacccttcatttaggttggtgctgaaaggaaatggaaatgtgccgacgattatggctacacttgcatggttacgaagccaaaaaaggaatccaagctgaaggggctgaaggtgtgcctttctttccctattccctccgcccttttttcgtcagagtttcatcgcgtacagtctcacctgctctttgaccggcatccaagtcgctcgtcgctacaaacatttcgattggctccatgagcaattgtcagccaaatatttgccaattccaatcccaccattgccagagaaacaagtggcaggtggcttagaaccaggccaactgtaataaaaatatattattggaaggcctttacgaggacgacttgatccaacaccgtcgttcggtcctccaactttgggtcaacaaaatctgtcggcaccccgtgttgagtcaagtggggcaacaaattgaaaacttattgttggaatcacctaattaaactcattttcagtcgggagtatggcgtcattttattagctgcacagatgaggcatttcgaagttgactttttaaaactaatctgatagttttgagaaccaatggaagaaaggcaaacgattggctgaaaaagacgaatatgttggaggtaactttttcaattgcatcacagcaccgactgagcagctgaatttgcaagatttgtacgaaagacccacacgaaattcaaaaaatacgggtttttagcgaacaacaaattgagaacttcgcccgaagttcgcgaagtttggaagaaagttgcaaaattttgtacgaacgaatcactgaggcgcagaaacggctaatcggacgtaaaagagcatttgagcattcatttaaatttacaaatatgtattgttaagcacacaaaagcaattggcagaaattggcgcagtccttcgaattggtggggcaatcgctcgacatggaccaatcacagcgaaatggcaaggccgacgacacttttcactgcaattccgacactttagcgaataatccggtaaaatcggccataaaagtcagtgcgaacaatttgcatcggattggctctcaacacgaagaccatggcaaaaaggacttggagcagttggttggagtttctctacgtcagcaaaggcgtgtacgcgtccattccggacactgtgaacattttcaaagtgactgaatgatcttttggcattgtgcaaaatatttcttattctctcagtctgtcctcacaaaaatgcacgaaaataaacggctgcaaaaggaaggcaaaatctctgatggcgacgttatgctattcgtgggccgggtggacgtgtgcgcctatgccatgtgaataattaaattggccttcttatgatttgaatcacttcgataggcttgctgaatgacgcaccaacaggaagagagggacttggacctcgccatcgcattcggctcttttttctgtgaatcacattagatgggtttatatatttttacgatatttgctctttccttaacagcacaacaatccgccttctatcacaacattggcaaccaattctctcaattggccgaactcttcaaa

SEQ ID NO: 66546 - DNA, 1049 bp, Heterodera glycines
  Genomic contig location: Contig_ID=SeqID_37482; Location=461..1509; Strand=+
  SCN-specific regions: Sequence locations=1-311,333-382,416-486,514 -1049
  Gene Ontology: Mol. function=acetylcholinesterase activity; Cellular component=synaptic junction; Biological process=synaptic transmission, cholinergic
atgggactgctggaccaacagttggcactgcgctggatcaacgacaacatcgcacagtttggtggcaacccgaacaaagtcacacttttcggtaaggttttttttggcattgtgccgcatgagaaaaattactatttttttttacaaaaatatgaaaatttgagcgattctatgccaaatttgaagttcaatgactaaggtcggaaatttatgtaaatattttgttgaaaacactccaaatttccaaaaaaaaaaacgttattttcccgtcaccaatgatcagcagctgatcattagggatcgaatttcaagtttttgtggttggaatttcaaaaaatatatgctttttattactctattaaaatagcattcaaaataaatttatatatatatatatatatatatatatatatatctactagcttatagaattatggaaaattttactccaaagcgtttgaaaatatttattattaaattctattcctaaactgaaattttaaaaagaaaacttggaaatatggagatttttcgggcattataatcacactttaaataaatacagtaggaaaaggaatactgtaaacatgggaagatttccgtatattaaatgcacacgaacaatatacagtaggaaattaattatttataaaacgatacagtaggaaaataaatactgtatataaacaggggaaagtgccggcggcgcgtcagcggcggcgcatttgttcgcgccggacagccaccgcctattccgctcgttgatcgccaaaagcggtgccatcgtgaacaactgggccacaaagccgaaggtggccatccgcgacatttcaatgcgactcgcgcaccggctgaactgctcgatgtcgacgatggtcgactggaaacggcgccggaggcaccggcaccgaccgcgacgacaacggcacgacaggcggcgcagaagcggaccgtcgccggacaacaacagcgatgacgaggagggcaccgttgcggtggctaatcaagtgatcgcctgcatgagccgtgtgcctgctcagatcatccag

SEQ ID NO: 66547 - DNA, 84 bp, Heterodera glycines
  Genomic contig location: Contig_ID=SeqID_37484; Location=381..464; Strand=-
  SCN-specific regions: Sequence locations=1-84
ctacgcaaaacaaattttttacatattttttggttggggattatcccaatggtcccatttttcgcataaatatgaattgctaat

SEQ ID NO: 66548 - DNA, 1059 bp, Heterodera glycines
  Genomic contig location: Contig_ID=SeqID_37485; Location=40..1098; Strand=+
  SCN-specific regions: Sequence locations=1-11,38-116,139-172,194 -214,236-296,433-435,500-551,577-604,669-856,909-1059
atgggtgtgcattttgttgttgattttgttgttttgtcacttccgtccattccaaaattgaattttggggcgcagaatctccgaccaattttaaaagttttggagaataaattacaaaatttgatctatgagactaatttgattgaagaatatgatccgaaaaagagagcacatttgaaatggaagcttgaagaagagttatttttagacggtaattaaaaactaattaaaatttactaaggacgatcgacaggaattaaattaaaataatcaaaacgattagaaaaaatacgaacaatattaatttattaattatttaaaaaaatattggtcgaagaaaagaaattaaatttttgttttatttttaaaatataaaatatttaataaactttatattacacttttacaattgaataatattttttattatttgaaactgtaaaacatagaaaaaatagagattatgaaatttaagttcttcatcggattcgtctgtgtaaaattattctaaatgagaatgaaatattaatgacagcacattaaaatgtgtcttttttaaaatatttttgcaacttcatttaaacattcaaaatggaatagtgacaaatttataaaaaaattttgtctaataaataaaattataatttgaaaaaaagatttaattttaagacaccgatgaagacaaagtgcaacgaattttgaaccaaattgacaaaatgaataatgaagatgcatcgaaaaaatatcatgaattgaacaatgtttccaatgaaacaaaaagaatgaatcaaataaaagttgaaagtaatcgaaagacaattgaaaaaatgcgagcaaatttgaacgttttacggagtaataataattaaaaaatgaaaatattatttaaaaaattatttaaaattttagggcactcttacgaactaaaaattctcgaatttttgttacctaaagaagaattatcccgattaaatcatcttcttgatgaaactgtgatgattggaggaacactgacaaaattcagagcagtttatgctattttggaattatgggcaaaaa

SEQ ID NO: 66549 - DNA, 301 bp, Heterodera glycines
  misc_feature (116)..(116): n is a, c, g, or t
  misc_feature (205)..(205): n is a, c, g, or t
  Genomic contig location: Contig_ID=SeqID_37486; Location=1..301; Strand=+
  SCN-specific regions: Sequence locations=1-72,158-164,187-301
ttaaattttcatttttttagcttttttcgaaaaatttttgtcttttttcggcaggcactgcctctgacaatgttttttatttattagaaaaaataaattgattttttttcttttgnatttattttaattatatttcattcttaaattttttaataaacattttcaaactttcaccttattaatttaaggcgaattttgccttttntaataaattctcttgtgaaaaggcaaaaaaataggctcttttaaatatgcctatttaaattactttcattgctttcctttgcttacgaccatacca

SEQ ID NO: 66550 - DNA, 352 bp, Heterodera glycines
  Genomic contig location: Contig_ID=SeqID_37486; Location=382..733; Strand=+
  SCN-specific regions: Sequence locations=1-40,71-126,209-215,238 -242,273-352
ggaatcgaaggtgttgtaagcttttttcctttttcacttgtaaatttatttaaattttcaattttttttagctttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctttcctttgcttacgaccatacca

SEQ ID NO: 66551 - DNA, 307 bp, Heterodera glycines
  Genomic contig location: Contig_ID=SeqID_37488; Location=74..380; Strand=+
  SCN-specific regions: Sequence locations=1-137,161-271
atggttgccgcaaaaaaattccttcggattcttccaatacagaccgagagctaccgattggtatatatttcgaccattttcggcttgggccatatgatcaatatttactaaatattttccttaatataaatattttcctaatttccatttccttttacatcccttatataagcccgatcatttttttatgtcagattttttgaaaaaaataataaatatcagctggaagacgaacaaatatacctctttggacttttgtcaatcgccaaagaatttattttatttgcaaatatttaaatattattaa

SEQ ID NO: 66552 - DNA, 490 bp, Heterodera glycines
  Genomic contig location: Contig_ID=SeqID_37490; Location=286..775; Strand=+
  SCN-specific regions: Sequence locations=1-30,52-490
atgtcggcggattacgccaaaagagtgattgaaaatgagcaattgaaaaatgatttgacaaacggacgaacggacggacagcagaggaataagccaaaacgccaacaaaaagaaaatggaaatggaaatgtgatcaaacatcactttggtgggagtttaaaattttgaaataccccaaaatttattgggttttgtttgaatttcaatttcccaaaatttcgtcaattaattggtaagcataaaatttaattatccctctgctgcttctgtttactcagtccatcagtgacttcctttcccttttccaacttcattcattatgaaagtcaaaaattaatttttaatcctccctcaaattgcgccccttttgtcagaaataaacggagaatacgcaattgacccattggtcttggggcaatttccccctaaatatgtccaaggctccaacaacacttacccccacaactcaatgtccaatgaaaaaagttga

SEQ ID NO: 66553 - DNA, 76 bp, Heterodera glycines
  Genomic contig location: Contig_ID=SeqID_37491; Location=488..563; Strand=+
  SCN-specific regions: Sequence locations=1-3,25-76
atgaatttttatattatattttttcttgtgattttttccacctttttttgtcagctgctgattgtaggagcaacag

SEQ ID NO: 66554 - DNA, 139 bp, Heterodera glycines
  Genomic contig location: Contig_ID=SeqID_7974; Location=333..471; Strand=+
  SCN-specific regions: Sequence locations=1-41,63-139
gtggaattcgattttccaatgaagaaaagatgaacaaaatgaatatttattctaaaatgaagaatgaaaaaccgtctttaagttacaaataaattgctcaatttttgagagtctcattagccaacagatggaaaaaaga

SEQ ID NO: 66555 - DNA, 1418 bp, Heterodera glycines
  Genomic contig location: Contig_ID=SeqID_7975; Location=169..1586; Strand=+
  SCN-specific regions: Sequence locations=1-37,61-258,280-340,363-1418
atggccctggttcgattcgacgaagccaaatctaaccgaggaaaaattctgctttctcgccttggtttcgagtattccttcgaaaacttttcccgtcttgaggaaggctgggagtattggaaatgcccacggcgtccgccatactgcccgggtcgcgcgtctgtccaaattccatggcttgtcgatgaaaatggaagtcgttataagatgggccgcataactgccgaacacaaccatggcgcaatctttggacaacttgctgtgagccaatttggcactcttataggaagggttgctagaactattattttaggagatttcaaaaattaatttgtatgtgttgccttgaaaatttattttaaccctgggtcccctggtttggtcctgatgtaccctacataatttcgttctactttgtgaagataagacaagcaaacaagcaaactcgggaagaggcccaacgcgactttcccacgacgagtcgcaatattgtgcgcaatgttcgggcgaatctttcggttgatgctcgtgtgaacgcaccaagtccagtcaatatgcgcaataactacaatatagcaaaacggagacaccaagaagagctcacggaaaattaaaatgattgatagggagggaaatgcaccaaaataaagtgaaaaataatataggtcggagatgttggccttgatgttttgcctgttgaaaacatcgtactgcctgatgctcttctaaaccgcgtcatttgcaatgaaatttttaacggccatcgaatgattgttttctgttctgcatctgctctcgaaattcttcgacaatacaacaccgaatgtgccattgatggtacattcgaagtaaatatacgggggattttggggtcactgatcacgaatatgacatccgtttttctgcaaaatgggggcagacaaagttttacccaaaattgttaggcaaagaatccttggtactattttaaattggcccgcttaagtcatgcccgcgtggatttgcacagttatacacaatgagcgctatcatcgaccattgctcagttccatgcgtatatggtttactgccgaataaggaaggggcaacatacgtgcgtttttttgaagcaatcagagacagtgttggaaacaattgggcaccgcaacgtctaatgagtgacttcgaatcagcagccatcaattctacgcgaattgtttttgccaactcaacccaaagtggctgcctttttcattttggccaagcaatttattgccgaattcaacgacttccaaatcttcacactcaatacctccaaaatgttgagcttcaacgaaacatccgatcacttcaagctttggcatttgtacctgtcgaccttgtttataactacttttgcatcttggtgtcgacgctccatccaactgctgagctacagg

SEQ ID NO: 66556 - DNA, 476 bp, Heterodera glycines
  Genomic contig location: Contig_ID=SeqID_37494; Location=575..1050; Strand=+
  SCN-specific regions: Sequence locations=1-4,26-91,113-126,148 -283,305-476
acaacttcgccagtcagcaccgccggggcgggcgacagtttgccgaatgggacaacaacaaccgccgccaccgctggcgacgtcacccccaaaaccggtggtggaggagatgaggacgagaaaatggaggaggactacgtggggggagcagctgcgggcggcgccaccgctggcagcgtgccgccgaagaagacgtccaccggtgccgccgctactggttcagcaacggccgctggtgcaaagccaacagctgccgccgagcaaaggttcaaaatttcatcactggggagcaaaaagcaggaatttgtagccgtttttcgccaaaaaattacaaattttcgccattttgtctaaaaattcaaaaataagacaatgggagtcttgacatcgccggaaaaatttggaaatttttacacattttgttaggaaaattattaaaaaattacaggattattttatttacagtagtatggtaa

SEQ ID NO: 66557 - DNA, 405 bp, Heterodera glycines
  Genomic contig location: Contig_ID=SeqID_37495; Location=302..706; Strand=+
  SCN-specific regions: Sequence locations=1-109,157-178,200-405
atgtttgagcaaggtatagcactggaagtaattgaacgaacattaaatgttccaactgtggaattgaaatgccgttttgcacgactttgtaagaaaatagcaataggcgttataaattaaaaaaataaatttaacattttttaaatataattattagggatgggaattttatgtaacacatatttttcctggattccccaaatgctctgaatagtagaaaaaaaacacattcttttttgtgtttgcgaacaaaaatcgggacttttatttatatatttttacatatttcgagctttttagcatatttacacatttcgggctttttgtacatattttggactttttagcaatttctccataaatttttgagaatttttaaaattaatcaaaatttcttgtgaaaaa

SEQ ID NO: 66558 - DNA, 576 bp, Heterodera glycines
  Genomic contig location: Contig_ID=SeqID_7976; Location=2380..2955; Strand=+
  SCN-specific regions: Sequence locations=1-576
atgtttgtggtcaaacagacgcgaaatggccacgaaagaggcggcaccgaacaacagaacgtacagcacaacaaaaaggtcggtgatgaacagacgacgaaagcagggcaaaatgcgacaatggatgtaaatctgagtggaaagacaaatggactacgaccgtacgaatactccaacagttcgatgctaatattggtacggtatggcaaagcaacggtaatgaaaaagagatacgataaggaaggtggcgaaaaagaaggcggtggaggcgtgtcctgagtagaaactgcgacgggagtccaatattttggcgttgttatcgtccagcctttggcaggtgtacaagtagaagaaatgggtcgagtcgttgtttgtctgcagccgtccaccccgtttttgtacttcaagtccgttgggtaacactgctcgatgaagtcgggtcgcaatccgcccaccgacagcttcaccaggttgacgcaaaacaggtcaacagcaatgccgagcagccaaattgctaaaaagttgttcatttaaactacattccatttgacacgaaaaaacaacaaaagcacacaa

SEQ ID NO: 66559 - DNA, 239 bp, Heterodera glycines
  Genomic contig location: Contig_ID=SeqID_37502; Location=156..394; Strand=-
  SCN-specific regions: Sequence locations=1-116,138-239
atggacggcgccgcacttctacccgcttctgacaaccccgtaagtgcagctgacaagctcagacaaaaaaaaataaaaccataacagcagaattaatgctcctaataaacttgaagactgtattttcttaatcttaatgtgatttttagactatcaggtcctgaagaaaaaaagttctagtttgaatccgattttggacatagacgcaattgtcgaggctccaaaaacttaacaataaa

SEQ ID NO: 66560 - DNA, 767 bp, Heterodera glycines
  Genomic contig location: Contig_ID=SeqID_37504; Location=225..991; Strand=+
  SCN-specific regions: Sequence locations=1-254,287-297,320-466,488 -577,599-767
atggattggattggacggatgaatcatttgcaattcaaaggatcgatcaatcgatcaaaaaggactttggtcgaaaatgctctcaaatcagaatcttgggcttatgtaagtaaaggaaacctcctaattgatttgtatatttttgaatctgttgacagattccaaagattgcattatttttcgattaattattgtatcatagaaaattccatttgttattcattttccttatgtgtgttcaatttataggttggtatgtctccctttttatttctttacactattataattgtgatgagagtttattggaacacttaatttgatgtcatttgcataatttattcaacgaaaatgtcttttgcctatggaaagtccattcagcagaatggtggtcccaaccgtgtcacattcattctgcgaaaaggtgcaattttcttcactgggatggttattggaacagtcgttgtttttgtatgttttcaaaaaagaatttgttcttcaggtttaaacattgttgttgcttcagaaggcatttaagccaacgcgtcccttcgacgaagcggcagaacgtggaaaaagggagctgttggagaaatacacggaggagtacaacgcgttgcaggaagagctgaggcaggcggaagagcagcagcggaacggagggatgccgaagaggcggaagcgagaaaggcttagccgatgacaataataatgatcaatttgggtggaagggttgtaaatcctctgaagtaggatcacactgctaa

SEQ ID NO: 66561 - DNA, 144 bp, Heterodera glycines
  Genomic contig location: Contig_ID=SeqID_37506; Location=422..565; Strand=-
  SCN-specific regions: Sequence locations=1-144
atggagaaaaaaattcttattaagttaatattagggttggccgggtccgggtacccgaccgggtccagacccggatacccggtcttttcaatacccggacccggtctcggttttttgaaaatccaatacccggtacccgacccg

SEQ ID NO: 66562 - DNA, 1290 bp, Heterodera glycines
  misc_feature (17)..(17): n is a, c, g, or t
  Genomic contig location: Contig_ID=SeqID_37509; Location=6..1295; Strand=+
  SCN-specific regions: Sequence locations=1-6,99-117,140-255,296 -611,633-701,723-1052,1075-1290
atgagcaaaggagaaanaagcaaaaacagcaaaaaagaagtgaaaagagaaaaagaaaaagcacataaaaagaaatatgaaagggtagaagaaaaaaattgttatgaatatttttacggaaactagaccaaattttccaaaatttagaatcaaaatttagaagacttgcatctttttatagagaaaggaaaaaattcagggtgatgtgaaaagcacaaatgtgttgaaatggggaaaatttcctaaaaaattcttagggggtttgaaaaattttttgttgttgttgttgaattgaatgaacggacagaaagagtaaaatttgtaataactaaacgcaaaaagatgagaagtaggtaaatcataaaccccataatttgtgatttcaaaaaacgaaaaatacacccctaaaaatcgaatttttgacttcagccgcccccccccccgaagccaagggtctggctaagcccttgctgctgttgtctgatttgtaactataaatattgattgttcctattttttggtctgataccgctcgtatagagaattttaaacagccgagagaagagtgacaggacatttgaacagtagtcagttcgtcagtgaacatttgcacactaagtcatttggacagaagcggacaattgggcattacgacagcgaatggaagtttatttattgttataaattgcttagcattgaaactttattattattctttttaagattgcttacaaattagcattgaaactagatatttttgaggtcctaagaatttgaaaaaaatttcattgctaaagaaatttataataaatacggcttaaacaaactgaataccaaaaaatttggttcttgcgactattttagaccctcgatctcgattcacatttaccttgacagcagtcggctgaatcagtacagactggtttgataagtaaagttgaaagttaccacgcaaagacagatgtaattggttttttctacttttttaacttttttcaggaaaacgatttacaaaattgatgaaaaagaaagcagtggttcaagttctgggatattttttcttgttttgaaaagacgcaaaattttatcaactatttaatactgtttataatttaataccctcctcataatgattaatttaaggcaccatctccaagtccatctgccgtgaagacaagacaaaaagccgaagtggaattaaatgaatatttacgggatcaaaaaatcaaatccagggccaacccatcattatactgggaaacaaattcacaaatggccattgattggtga

SEQ ID NO: 66563 - DNA, 361 bp, Heterodera glycines
  Genomic contig location: Contig_ID=SeqID_37511; Location=334..694; Strand=+
  SCN-specific regions: Sequence locations=1-7,29-183,205-361
atgtacggcacttcactggaaaatgccatcgctagcgactgctctggcgcttataaggtaaggcccatcgcgagaaaaattccggggatgggagaatccgctggacagcccctctttcaatttttgattataagagaatatgtaatgtttgttatacaataaaaagctacatttaaaaaatcgtcgtattttgacattatgcaaatgatatttatttaacccaatttataattgtaagaaagcgatttcatgaagcgaaaacattgattttccaggatggtttggtcgctattgtgaagggatattaccactgattgcttggcactgctgtgaagaactttcaaacgataaaaaagttaaa

SEQ ID NO: 66564 - DNA, 1240 bp, Heterodera glycines
  Genomic contig location: Contig_ID=SeqID_7978; Location=2088..3327; Strand=+
  SCN-specific regions: Sequence locations=1-70,176-204,352-1159,1181 -1209,1231-1240
atgtttaaacccacaataaagttatgcgctaaaacacgcaaatactccaaaatagggttgcaaccccgacgtcggggttggaaaattcggggttcggggttgtcggggttggaagtgtcggggttcggggtcggggttgccaaatcgttcggggttcggggtcggggtcggggtttttcaatttttgccttatgccaaatagtcaaaatttttttaatattttttcggaaataatatttattaatttccataataatatttgtattgtttttatatttttttatttctttttatcagaaattttgtatagaattaattttttttttcttgaaattttaaaattttttattacttttttgttttccaaaacatcttttttcacgtcgctcttttctaaagacttaaggagaaagggtacggcgtccggcggtgccgataggcgccgccgggaaaaaatttggttagatctgttaacagattttgtccaaaatatgctaaatttttgcgattttgagccaatttttttaataaggtttatgactttttgggccctgtgatgccgataggcagcgctaaattttggaattaagctttattttctaagatttttcaccaaaaaaatttatgaatttcggtaaatttttgtttttcttcgatatgtattttgtcaaaatatgccaagattggtcgatttctatgagtatttaatttaaaaaaaaaacaatttgtcacaaagaaaataattaaagaagaaaacgtcaaacggtatcgaactcacgacagaaagtaatgtcaatggcactaacctctacaccacattccaaatgtccgaaattgagcaaatcttctttatttaataaaaatttggcaaatggttaaaaaaaattcaaatttcgtctaacttttttgcattttctcccacgaaaatgccattcttaggggtgtatatttaaccccgaccccgatcggggttaagggtcggggttcggggttgtcggggtatgaagcgtcggggttcggggtcggggttttccccgaaaatggccaaaaatgtcggggttcagggtcggggcggggttgcaaccctactccaaaacattgccgacttcataattttgcacttttctcagtattcgctcatcggttccttgtaccttggcctttttgatggaccttcctgacctctaacatattcttcataatctgatctaaacctttctgaatttttcttaaatcgtca

SEQ ID NO: 66565 - DNA, 1411 bp, Heterodera glycines
  Genomic contig location: Contig_ID=SeqID_7978; Location=3443..4853; Strand=-
  SCN-specific regions: Sequence locations=1-611,697-1301,1323-1411
atggtcgactcgccgacgccaactcgccgatggttgactcgccgacgccgactcgccgatggtcgactcgccgacgccgactcgccgatggtcgactcgccgacgccaactcgccgatggttgactcgccgacgccgactcgccgatggtcgactcgccgacgccaactcgccgatggttgactcgccgacgccgactcgccgatggtcgactcgccgacgccaactcgccgatggttgactcgccgacgccgactcgccgatggtcgactcgccgacgccaactcgccgacgccgactcgccgatggtcgactcgctcgccgatggttgactcgccgacgccgactcgccgatggtcgactcgccgacgccaactcgccgatggttgactcgccgacgctgactcgccgatggtcgactcgccgacgccaactcgccgatggttgactcccgactcgccgatggtcgactcgccgacgccaactcgccgatggttgactcgccgacgccgactcgccgatggtcgactcgccgacgccaactcgccgatggttgactcgccgacaacacgactcgccgacgccgataaattgtgcaaaaaaaattctgggaaattttaatttttaaaagaaaaaatttaagaattattttaattttttaaagaaaattaaattttttaaacgaaattttaattttgccgtatagataaaaagacaaaaacataagcaagaaacaaaatcagtgcaagtggaatggtgcaattttggagatgtgaaattcgtggctgtcgtggtcgtatatggacgaatttggaagatggctctttagtttcagagcacggaaaacatatttgttcagaagccggcgatcctgtaaacgttgaattggcaaaaattcatacagcatttcatggacggcacattttcggcttctcctccgctttttcaacagatttatttcattctttctcgacgtggtgacttcgtttttccggtgttctcttttgtcttcttcgaaacaaagatgcagctagctacatatgcgaaacttttccaaatgatcaaagatatttggccacaattcaagagcacagcattcatttgacaatctgcgaatttgctgacaccaagattagatgctgttttttcacctcatacaaaacttacgcaaacatttgtcttcagcacatcttttaggtcgttacaatacggatgcaaattttgcacttcattctcgaatgattactgcgattgcattcattccggaagaggatataattcggtccttacaggaactcgaagatcatactcttgatcattatccggaacttgcgactatttttgaatggtttactaacacttatgttggaagaggaacaagggcacctccaaaattttcctatgatatgtga

SEQ ID NO: 66566 - DNA, 457 bp, Heterodera glycines
  Genomic contig location: Contig_ID=SeqID_37514; Location=428..884; Strand=+
  SCN-specific regions: Sequence locations=1-105,127-237,259-431,453-457
atgagaattttcattgtaaagatcacctccgccgcaaaatgtgtcgaactgtttggtgtgtgcaacaattaccgtgtcgactaccgatcgtttgacgcacagccaattctcggcttggaaccacactttcatacggtaatggagttggccattggcacggcacagttcagccactttctgctcgagatcagcaatggcgtgacccttctcgagctcaatggccaactgggattggtaaaaaataatgtaaataattttagggtgacattactcacattttcaaaaaatcttgtcacgccgtcaccaactcgcactgctcttggacaaaaacgtgccaaacttttcgggtcaaacacctaaatcttaggagaatgagtaaattgtcgtcaagactctcgagagttttatctgattttcaatttataatatcggaaaatataaatttcacttcacccaa

SEQ ID NO: 66567 - DNA, 677 bp, Heterodera glycines
  misc_feature (23)..(23): n is a, c, g, or t
  Genomic contig location: Contig_ID=SeqID_37520; Location=184..860; Strand=-
  SCN-specific regions: Sequence locations=1-166,189-677
atgccaacttgcccgctaatccnccactgggttaggggcaatgtagtagaactaatagaaaggagaataccgtctaccaaaaaaggagttgaaaggtgtgaaaagcaaactgtaacccaattgtgcaaatttattattaaaatgcacgattttgttttgtcggactataagctaaaaattgattaaaaaaccatttcaatgtccgtgaacggcatcagaatgatgggcgtctgtgcactgtccacaaagaatgggcagcgtttgatgtcaagcggcggcttcatcgtgtttctgcccatcatcgcaagcaaatcctgagcaagtgatttgttagaaatcggcaaaaattaaacagaaatcatggccaaaatttttttcaaggtttggaaattgcgcgccgaatttttttgagtatgaaatttcagagagaaaagtcgaacaaatttaaaagagaccgacggaatggactgatcagcaagaatgtcaaaatcttttcaatttattgtaagaaaaaccatgaaattggtaaagtttttaggcatacttcacgtccgtaactgtgcttggcaaaaatggggtcgcaggtctaaaaatggaaacagttaaatgcttgtaagaataaggtttgtcaaaaattaaccaaagattatggaaagtagagggaattttataataaa

SEQ ID NO: 66568 - DNA, 965 bp, Heterodera glycines
  Genomic contig location: Contig_ID=SeqID_1033; Location=191..1155; Strand=-
  SCN-specific regions: Sequence locations=1-85,108-724,747-965
atgagttcgccaatattggatataattcacgggttagttaatcggatagaggttgaattaaacagagaaattccgataaatcccggtcaaaatgcaaccccaaatacaatccaaagacatttatacagagcaaaaaatgcttgtgatgagttaagcgaaattttggaagaaattcagggaaaacgcgtagaaatggcagaaagtttgcaaaaaattgcagttgcagcgcgcgaaaataaggaaagagtttatgtagacttttgtacacagcttgacattgaggcaaaaattaatcgagcagtgattaagaaaaatgaatggcaaaacaaaaaagaacaattggaagatatttttgacataaaccctcaaaattcgctaaacagcacaattcttactccaagaaatcagccaatcaaaagagtgaaaattctacaaatacaattgaaaaatttgatgggtcagttgaaaaatggataccattttgggagacattcagagtacatgtccacgaggatgattcggttaccaaaattgaaaagcataatttattagagtcaaatttagaaggggaagctaaggagctaattgagggaataccaatttcggaagatggttaccaaattgcaattgatttacttttggaaaaatacggtaaaagtacaaaactaataagggcactcaatcaagaaattaatttatttccccaaagtgacactgttgaagaagatgaaaaattgtacattaaatttgaaaaaatttgccgacaattgtcaagtttaaatcaagacatggatttatcccctcattatttatcgcttgaagggaaattatcacctttagttttggacaagtatttcgttataaaagatgccgaagataatcaaaattggaatactaccaaatttagaaatgctctatcgagagcaattgagcaaattaaaaacagacaagaagtgagacaaaag

SEQ ID NO: 66569 - DNA, 4474 bp, Heterodera glycines
  Genomic contig location: Contig_ID=SeqID_1034; Location=922..5395; Strand=+
  SCN-specific regions: Sequence locations=1-645,668-996,1018-2092,2115- 4413,4450-4474
atggaccccaatcagcttaaactgattttggaggctgttttgaaggcatcggcgggacaagtcaacaattctgcggcattggcgacatcaatcgatgcgcgcctttcgacatttgattatgaccctgagttagggcatacatacgacgtttggctcaagcgctatgggcagaccatcgcccaggatggacaagcactcagcgaccagtcaaaagtccaactattgattggcaaactgggcgaagtcgagtacaagcggtacatcgacagcatcgcaccaaagtcgcagaacgacttcaactgggatgagacgaccgcaaaattgaaacatttgttcggtgaaacccgatcattgtttctccgccgttttgattgcttccaaattcgtcaagacgcgcatcaggacgtgcaaagtttgatcgcattgatcaactcgtcctgcgaaaatgccgatctgtcgctgagcaaagaggagctcaaatgcatgatactgatcattgcattgcgggacgaattcaccgatctgaggcaaaaatgccttcagcgcttggaagacagtcgaacgagcggacggtcgacctcactgcaagagctgggagaagagtgccgcaaataccaaatcataaaggaaagcgcgctctccctcggctcaaatccctgcagcaccagtgccatccgagccaaaccgcagcagatcaaggacaagcagaagcccaaaacgaagccgcagcaaagccacaaaggccaaaatttcctgccgaaaaattcaacggcacctaaaggaaaagtggaccaacgtgatcagccctgctattcatgcggaggcaaaagtcactggcaaaaagactgctggttcaaaaactcgacgtgtgaaaaatgcggacggaacggtcacattgcgaaagcatgcaaaagcggcacagagatccgacgtgttcgtgcagtggccactgattccgtgaaggacacgcacattcacaccgtctcaattaagccaaaatgtatggctattgaaggaagcagcaacaaatggtgggaagtgatcatccaaatcaatgggatggatcacccaatgaatgtcgacaccgctgcccaaatcacggtgatcaaaacggactcatggcaaaagcttggcaaaccaaagctaggcaaaacggccatcaccgtcaggaattgcaatgaaaaagcattctcaatcgaaggcaaattcaaatgccaagtttcgtacaaaggacgaacggcaagcctgattgcttacgtcagcgacgaaatccatcaggatttgctcggcatgccttggattgaagaattggaaataatcccgaaggaattgatgtttccaaattcgtcgcaaatcgtcaattcactgccaacgaagccaatttcatcacaaatcagtgatgaaaagtcactcatttcggcacttcaaaccaattacgccaatacttttggacctgaacttggccattgcaccaaattcagagctcatctgatcctgaaaaaggaggcgaagccggtctactgcaaggctcggcctgttcctcatggagcattggatgaagtcaatgccgaaattgatcgtctttcgaaaattggcgcaattaaaccgattgagttcagccattgggcggctccgattttggcagtgaagaaaaagagcggaaaaacgcgagtctgcatcgatttttcgaccggcctaaacgatgcgatcgaactgcatcgtcatccactgccaaggcctgaggacatctacaacgcagttggcggcgctaagtttttctcacggctcgacttgcgtgatgcctatctgcagttagagttgtcggaagcctcgaaaaatctttgcgtgctcaacacgcaccgaggcctgtttcagtgccagcgtttgccgtttggagtcaaatcggcgcccgcgatttttcaaggattgatggacaaaatcatcgccggaattccaggcgcattcgtctatttggatgatgttgtgatcgccaataaatcactgaccgatcacacctcaacaattttcgcggttttcgacaaaatcagtgaatatggccttcgaattcaattggaaaaatgcagtttcctgcaaaaggaaacgcttttcctgggccacattatctctgaaaatggcattcgacctgacccatcaagggcagaagccattgagaaaatgccggcaccgaccgacaaatcaacgctccgatcattcctcggcgcactcacttattacggcaaattcatcaaaccgatgcgtgagctcagaggcccgctggatgaattgcttaagaaggaggccaaatgggaatggggagttgagcaacagaaatcttttgagaaagcgaaagaaattatgctttccgatttactgttgactcatttcgatccagaattgccgatcgtagtcgctgccgacgcttcgaaagatggaattggcgcgacgataagccacatctttccggacaagagtgagcgcgtcattgaacacgcctcttgtaccttcaacgcggcacaacacaactacagccaaatcgaaaaggaggcacttggcttggtcttcgcagttcaaaaatttcaccggatgctgtacggtagaaaatttacgctgctgaccgaccacaagccccttttggccattttcggatcgaagaaaggcattccgatctatgccgccagccgacttcaacgttgggcgttaatactctccaattatgaatttgacataaaatatgtcaacacaaattcgtttggaaacgccgacgtcctgtcgcgactgattgcaaactacccacggcccaacgaagacattctgatcgccaacatttgcgaaaagacagaatgctacgtcaacttcgtttttcaggccaaagttgagcaattgccgatcacggccaaagaaattgctgatcagacgaaaacggacgaagtccttcaacaaatcagcaaattcaccaacaaaggatggccacaaaaatgcacagacactgatctgatgccattttatccaaaaagagaccaaataaccgaaatcgatggttgtctcacttatggcgaccgtgtaatcattccaacgacacttcgcagacaaattctgaaatcccttcattttgcccatccaggaattgttcggatgaaggccattgccaaaaaccatgtttattggccagggatcaacagcgaaattgagcgcactgtccgccaatgcgacgactgtcaaatggccgcgaaaaacccaacaaaggcacaaattcagccttggaaagcggcagacgaagtttttgagcgcatccatctcgactttgcgggcccatgcgaagacggccaaacgtatctcgttgtcgtcgacgcctattcaaactggccggaagtttgggagatgagtcgtgcaacaagcgaaaagaccgtcgctatgctaaaatcgttcgtccatcgaatgggaattccccgagaaattgtgtccgacaacggaacacaattccgatcagcggaattcgccaacttctgcaaggaattcgacattcgtcacacgttcacgccgccatatcacccgatgtcaaatggggcggccgaacgattcgtcgacatcttcaagagggccatgaaaaagtgccgaaaagaaggcaaagattggattcccaaagcacttttggcctacagaacaacgccaagtgcagtgctcgacggacactctcccgacgaattattccttggacgccggatgcgaaccaaaatttcattggtccatcccaccaatcagaaaatgccgaaagtggatttgaaaaattttggcaattttcaacaaaattaccgtcaaaagatgaaacggcaattcaacgacaaaaacggcgccaagcccatcattttccaaaatggagagccagttttcatttggaatttgaaaggcaataaggcaaattggttgccggcgacgattatcgagagagttggcaactctccgacttatcgagtcgacgttcagacgctccgtcgcgcagtacatcgccatgccaaccaaattcgccgtcgtttcccaatggaaatggagacatcgcaaattggccaagcaaatggaaatattttggctgggaaccaaccaaatcggacccccattaaggagattgaaaaagccaaatctccaattggccaaaatcaaaatgcgccgcgaagatcagcacgcgccaagagggcacctcagcagctgaacatggacccgtcgaagcggaagtacgatgtattccggccatgatctcgcgcagagggatttttccaaaaaagggaggtgttggataagggaacaaccctattgattatattttccctttcactccctctcttattgtctctcgccccgccccttgaccagccccataaatatgtctccctttccctcactccaggcattctcccattcattcctccatttcattattttatttatttattccctgctgtcctccatatttatttgttta

SEQ ID NO: 66570 - DNA, 2018 bp, Heterodera glycines
  Genomic contig location: Contig_ID=SeqID_7980; Location=817..2834; Strand=+
  SCN-specific regions: Sequence locations=1-40,62-104,126-139,183 -193,216-243,266-571,651-1111,1140-1419,1441-1635,1657-2018
ctatcaaaaccgccaacctctccccccccggttcccctaaagtttttgaaaaaatttgcagcaaaaaaaatcttaaaaatctgattttttgattccgtttctcaaaattattaaaaatgatcatctgaggcgaaaatacaaaaattgatattaattgattaaattgtaaaaaaattatttaaggctatgttgttaaatgttctcatttttgaaaatctgattttttgggcatgatattccaattttgaaaaatttctataaaaatctgatataattcacatccctttttttcttcaatcgaattgatcaattataaatattagataaacatttgaacaaaacttggcacaaaatgtaaaaaaaaaaattgggtttgagcaaatcccgataatcccgcgggatcccgaaaaaaatcttcaggattgatctggatcgggattcggtcgggatcccgacccgggatccgtcccgatcgtttttccaaaatgttcgggattgatcgggattaagtcgggatcccgactcggttccctccgaccccagttgtctggtctctagtttaaaatgaaagaaaaaaaaattttttttttaaattaaaatttcattaaaataaagaattttatttattaatttctatttttcattaaaatgtatttgttaagcaataaattgttcatcgttgttccgttttcttatttctcatgtgtgtgctataatttgttattaatccagtaatttttcgtaaacaatttgtcatgccattcaattccgtatttgttgtcatatgcatttaaatttttttagttttcccaattttttcgtatttaaataaattccctaaacgaagtcactcaaataaataattgaaaaaagaaaagctaatcgtttgattttcattaaatgttgcctacttttttgctttttactacaattccattgttcattttcctgcattctgtccttggtaaggtggttgagagttcctggattaatattaattgctctaaacacttttaaattcataatacatatttagccggcgttcttccgggatgcggagatgacgagcccaatgagtacgattgcctgaaaaagggggtgaatatgtgtcatttattttaattttttttcaataaaaaccccaatttagcggggggggggggggtgagaattgaaaattgaataataatgagaataagcataaataatatttagtgcgacttgattaaatgccctaatggaaaagtgtgcggttactttgtcggcattgccaaattaggcaaagggccgtttgaaaagaatgagtacccaaagtgtgtgagtgacccttccgaattgaacgtcacaacgccaaatgatggaaatgcgcacattgaagtggatggaccaggagtatgagaagaacccctttatttaattaacaaaaactaaaatttaaaagccatttttacaaaaaaaattagtgtaagtcggtggagtgtgccgaagggtttcaatgccaagtgcggatcacaatcgacaaacatggcgatcgaccatatgcacagataattggaggtcggttccgtgagttcaacgatttgcatggctttgccttggaaagattccctaattatttatatggaccaaatgagaaaataaataaatgggtaaaagcattaggtttgacatcacagcatctgctcagaaaaagatattcgttctgtcttggaaagatttatacggtacccattttgacagtacaggtttcccacaatgtgtgaatgccactggtggatcgtttcaagagccaaattatttcattgttggaggcccaggggtaaaaagaggcagtttaatgataagaaggataataaaatttagtgtgaccaattgccttctccctgcccatcaggcacaaaatgtgttacaattgttggaattgcaaaatatggcaaatacccatgggcccaggtccatgcatattttataaaagtaaacaattcttaaagtttcagttttttgagcccgtttgcaca

SEQ ID NO: 66571 - DNA, 307 bp, Heterodera glycines
  Genomic contig location: Contig_ID=SeqID_37522; Location=178..484; Strand=-
  SCN-specific regions: Sequence locations=1-38,63-225,249-307
atgtccgtttccccggtgatcagtcgcatgctcagcgtggagatgaaggagaagcagcagcgaatgatcactttggacgaattgggcgtggacatggaccaattcatggagtttttggaggccatcacttatctgaacggaccttttatgcccaaccgtaattcatgatactgtacttattctattcaatcccctaaaaaatactcttccatttttatggggttgaaaatataatttttttaaaatatgattccaatttttagccacaaatgtgctgatgcttctcaaattggctgattacttccag

SEQ ID NO: 66572 - DNA, 389 bp, Heterodera glycines
  Genomic contig location: Contig_ID=SeqID_37523; Location=1..389; Strand=+
  SCN-specific regions: Sequence locations=1-283,311-389
gcgaagcggccgaatgtcccccaaaaaattaaaaaacgggcgcgaagcgcccatcctgaggccgcgaagcggccgaatatcccccaaaaaattaaaaacgggcgcgaagcgcccgtcctgaggctgcgaagcggccgaatgtcccccaaaaaattaaaaaacgggcgcgaagcgcccgtcttgaggctgcgatgaattgctaaattacatcactttctagcgacgcggcgaagccgcgtccctgagcgcgaagcgctttccccacagcaacagaactcaattgataatgtttttgtatgttttaaaataacaaatgagggccatatattaccaagccacgcatgcacaccatagccaactgctcaccctagttactatatatgttatat

SEQ ID NO: 66573 - DNA, 397 bp, Heterodera glycines
  Genomic contig location: Contig_ID=SeqID_37525; Location=474..870; Strand=-
  SCN-specific regions: Sequence locations=1-397
atgatgcgcaagtttcccgacattcccgcggagtttctcaccgttctcctccaaattcgcgaggacattggccgaagcgaggcaaagtaagtaaaaagactgttttaatatgcaaacttcgtttaaatcaccattctctctcttatccgttttttgcagaaacatcgctgaagaggcgttgaacaacacgcgctaccacccccggggggacgcgcaggtcagacgactcttccaactgtgcaaatcgggcggaagcggcggacggcgagcactgcccgcgttggagtcgacggtgcagaatatgtttgcgacaatcatcaccaccactaagtcgacgaccgtttcctcaaatttgggcttcaaatgaatggaagcctttcaaaaaatggacaataaa

SEQ ID NO: 66574 - DNA, 427 bp, Heterodera glycines
  Genomic contig location: Contig_ID=SeqID_37526; Location=44..470; Strand=-
  SCN-specific regions: Sequence locations=1-107,134-263,292-427
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaagcattaaa

SEQ ID NO: 66575 - DNA, 129 bp, Heterodera glycines
  Genomic contig location: Contig_ID=SeqID_37526; Location=909..1037; Strand=-
  SCN-specific regions: Sequence locations=1-6,33-129
aaaaggaattaaaaatttttaaaatatttattcatctcccttttgatagaaaaagcatcagagagccttatttaacttttaattaacatttggtgcgtttcagagcacgttctaaaaaatatttatgaa

SEQ ID NO: 66576 - DNA, 94 bp, Heterodera glycines
  Genomic contig location: Contig_ID=SeqID_37527; Location=34..127; Strand=+
  SCN-specific regions: Sequence locations=1-94
gttggagagggctctgcgagaaaccattacgcgtgcagctgaccaactttgggtgcagcagctgcaaaactcagtgactgctcggaatggctgt

SEQ ID NO: 66577 - DNA, 171 bp, Heterodera glycines
  Genomic contig location: Contig_ID=SeqID_37529; Location=286..456; Strand=+
  SCN-specific regions: Sequence locations=1-7,30-171
atggacaatttttgtactgtcaaggaaaatatgaaacaacttttacaactatttccatggtataattttttttccaattatttaattagatttgaaatataaaattttgcttttaggaaaacaacacagattgtctgtggcacaaatttatggttagctatttgcatttaa

SEQ ID NO: 66578 - DNA, 460 bp, Heterodera glycines
  Genomic contig location: Contig_ID=SeqID_37531; Location=390..849; Strand=+
  SCN-specific regions: Sequence locations=1-439
atgcgaataatgcgaaaggcgaaatgcgaaaagcgaaacctcggcccatccctggtacatacagtctttaacaaaattctaagtccaagaattttttgaactttacctacttcacatggaccaattgagctcctcaattttttatcaagcataccctccacattaatattaagattgacagaaaaaaaattgaaagtgcagaagaaaaaaattttaatgaattttcacgaaagttgcccaaatttgctgttacaaaaatataggtccaagatttcgaaacatataactttttttctagggtaagaaaggaccaaaaaaaattcatattattataacttttatgcttatcaaaaagccaattgcacccagcgatcagatcaatccttcggggtgatcgggagtgatgaaaattttaacacccccaggggaattgagctttttctgaaaattttcaaacaca

SEQ ID NO: 66579 - DNA, 499 bp, Heterodera glycines
  Genomic contig location: Contig_ID=SeqID_7981; Location=970..1468; Strand=+
  SCN-specific regions: Sequence locations=1-205,228-232,355-415,458-499
atgtcgtcatttcgcaaaagcatgctacgttgtcttgaaatgtttttatgtgctgatcaagggaccataagcgacaaatgtctctgtctcgaagctgatccatgcccattggctaaaagcaaaaaagcaacaatctcgagaaccaatcattttaagcggtactcaagaccaaaagttgactccgaggcaggggcatataatttggaaaaaattatataattttaattcgtccaattaatttaaattaaataattataaccctttacatttttattaaggtaattgttataatttactttcaaaaataactgatttaattttgaatattattttataattttcaaaaaaatttttcccgagaatattttatttccaccggaactaaacattggcaattcctctcatataaatgtccatttaaacaatataaaatgataaaaaatattattgttattttcttcatttgatcatttaaaaagggttgaaaattatttttata

SEQ ID NO: 66580 - DNA, 520 bp, Heterodera glycines
  Genomic contig location: Contig_ID=SeqID_7981; Location=1659..2178; Strand=-
  SCN-specific regions: Sequence locations=1-3,26-68,166-390,428-496
atgaaactttattttattcacatattgccattaatttgttcagttcacgtagttttgactgaagttggtaataaattttttaaattttgtattttatttcaaaaattaaaaaaatccatttatttttgtattttaaaataatttataattattattaaaaattttcgaatttagattcaaccgacttgctgtatgccgattatattcttgcgccatcggattttcctgaggaaaaacgcgaaagcattaagcggttgattttctttaagtattacgataattcaattgacacaaccatcgctaatatgacaaaaacagtaattgccgtatcacaattgagttacaatacgaatgcaagtaacttcgttcttagtaaagttttgcaaaaactgaacaaactcaatgaaacatggaaagaatatcaggccagtttcaatttaagtgaaattgtgggaaaaaaagttgacagtctgaagacagtacagtaatcaggacgaaaataattaatatttttaataaa

SEQ ID NO: 66581 - DNA, 930 bp, Heterodera glycines
  Genomic contig location: Contig_ID=SeqID_7981; Location=2521..3450; Strand=+
  SCN-specific regions: Sequence locations=1-311,346-637,659-725,752-930
atgcgccttaacaataaacaaaattttatgagtccatttttgaataagcaatttatgcaagctggcggcggtttggtgaatgattacggagggacagaaggtaagaacaataatatgtttgacgggattaattaatgaggatatgtacggtaattttgaaaaaagtcagaaaggctttgaaattaattaccctattatggtatcaaaaatttagccaaatgcgtaacataaattgtatttttattgtccgccaggaatgtttgatccatttggtggagatactggtgcatacccatcaggtaacgacagctatatacttttatttttaattaagccactattaaaaatagggttctgctccgacccctcggggggcaaaatttcgtgggccggggaccccggtcggaaaagttgcatttttttactcaaaataaaattttggtcactacccgacctggctaccggaaaatgtgtcagtgcatttttcttggaataaatacaattttcttgggtttttaaagtcactgatcttgaatattgtatatatttcggccaattccgaccccggagccgaattcgaacaaaaagacgaatacattaattacccaattggggtgtcacaatttagccaaataagtaatataaattatattaaattgttctccaggaatgttcagcggagaagatgatgcatacccaccagcaggtgacgacagctgtataccatttttatattaatatattattaaaaggcctggaacaatactaccaatacggttagggatacggcgctgatccgatatacagtgtggacgaaccgtagggtcatgaaggtggattttaattttgatgaccagcagatgatggatgatgatgatatatgatggcaaaatgtattattatttgtatctacaaattaaaaaaatgata

SEQ ID NO: 66582 - DNA, 1554 bp, Heterodera glycines
  Genomic contig location: Contig_ID=SeqID_7981; Location=4132..5685; Strand=+
  SCN-specific regions: Sequence locations=1-86,131-506,528-545,567 -611,645-846,875-909,934-1051,1097-1483,1507-1554
atggtctgtcaaaaaaggatgagttttaatggctaagcgttttggacccatattaatttgactaaaatttaaaactcaatttcgagaaataaaattttataccttttttataataaatttattttaaattgtaccaacaaaattagtaaattgtttattgtgcctttattcttgaattttttgggattttctgctacttttgtcgacttgaacccaatagtgagatcctcgaatagctagctgtacaacaattcacgcttattcagtaaaaagtgccataatttaaggcacatttgtccttggcacaaatttttggcgacgccgatgccgtgccgaaactgtcaccacccatccagctgtacgacttcattgctccgagagcgtatgctaattggcctaaagtggttggccaagcgcttaacaaacggaaacaattgcatgaaaagattgatgataacgaagataaagagcaactgcaacaaggggagcgtttcatcaatattccgtcaattaaaaacatatttaacaagggtaagtcagaacgtaatggatcataaatttaaaaattacattggaaattatttgaaaaaaataggcactttaatttatagttatttttggagaaaaattaattaaaattaagagcaaatatttcaatttatcctattagaacattaaaattaattcaattttatgacagaaaaatcggagaaaccccaacttgttactaatttgtaagcgaactcgtagtgcctcgactagtattttttcgacaaattcgttttaacttttgtcaaagtcaatcaaatttaactctaatttcattagagttcttaattttcttgcaaaattaaaaaattaaaattttttttatcatgtttcaaaaaaggttatgaccaaaaagcgtaaatttttgcccatttttaaattggtcaactttgacctaatttaggacattttttcggaagacattacgagtcgggcaatgcgagttggtctggtacgagttgggtttaacgaacaaaaaatcatatgtttaatgacataaaagatataaaataaattcaattattttaataatttaacaaattttatagctcttccttatttggtcaaagttatgccaaatgttgcaccaactctctgcgcgctgaaaggttgtccgccaggaatgcttggccaattcggcggaattggtggatttcctggtggaggtggatttcctggtgcataccctggtggaggtggatttcctggtggtttccaaggtaaaaaatatcctggtatggcatacgatccctacgcttaaggagcgcccgggtacccaagcaacgaccaaaacggtggagcatggaatggtggtccgcagtacggcggctaatacgccggcgcttggcggtttacaaggataaacatcgaaacaaatgttatcgtgaacaaatccatgaattttatctgactaaaagatttgaggatatttgcatttaatattattattatttgcttctatttaacaatctaaggattcaaacaattaatgatgcttattacgga

SEQ ID NO: 66583 - DNA, 832 bp, Heterodera glycines
  Genomic contig location: Contig_ID=SeqID_37534; Location=240..1071; Strand=+
  SCN-specific regions: Sequence locations=1-17,63-282,311-387,410 -434,458-569,591-832
atgaaaaactattacagtaattttgaaaaaaaataaataaaaaaaactatgtaaaaatttaaggaaattcatttattcaattttggagcggatttgtgccagtactgaatcggatgggtggaaaggatgtttcggaggtgtgtaaattaattcaaatttacaatttttcccaattaaaaattcacatttttgaaggaccatcatcttttgccctcccattttgaccgtacaacattttttggcgttccgcgtccgttcggcgccatttcaaacattccatttcccccaccgccgccacccccaccaccgacaccgtttccgaaggaattgcatgacaaaatgatggcacagggtgccgccaatggttgggcctagtttttggaggcgttttttgaaatttaatttttagcggcgttttctacaacaaaaaggccgggcacggaatcaggcgaatcggtaaaacgtgccgaaaaaaaggattaaaaaatttttttgtccgattagcaaatgtatccatccaaaatgccggacaatggcatcatcagtaaaacggcggaatttaatccgaattggggttggatggtgttgatcggtgtcacattaactgtcatcaacctgtgcattctgattgccatctccagaaaggtgtgactaagtttttttttaaaattttccaaaaaatcgcaagaatttttttttgaagtgcattcgacaacactccgagggcaaaaagaagtttcaatatcagagctatgcaagcggtggcgtgccacctccattgccacccatggacatgaattatgcattgatggcacaacaggtgggcaaaaaa

SEQ ID NO: 66584 - DNA, 504 bp, Heterodera glycines
  Genomic contig location: Contig_ID=SeqID_37535; Location=59..562; Strand=-
  SCN-specific regions: Sequence locations=1-107,134-263,292-504
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgcaaataaa

SEQ ID NO: 66585 - DNA, 774 bp, Heterodera glycines
  Genomic contig location: Contig_ID=SeqID_37536; Location=16..789; Strand=+
  SCN-specific regions: Sequence locations=1-122,163-329,351-472,494-774
  Gene Ontology: Mol. function=GMP synthase activity; Biological process=purine base biosynthesis
cggaggaccaaattcagtttatgtggacaatgcgcccgtgtacgacccggaactgctcggtggtcgtcttccgctgctcggcatttgctacgggttccaagtccggtccaaatgattcatatttattgccagaatttgagtgcattttttccttcccattttagctaatcaacaaacacttcggtggctccgtcagtttgcagccgcggcgggaggatgggcgaactcagatccaagtcagcccaaagtcggaccttttccactcgttgaagccggaccaatttgtgctgctcacccacggggacggagtgacaccggaaacgtcagccaaaaatgggtttcaaccaattggcttcagcggggaatttgtggcgggtaattaattaattggggttaatgaacaacaaaaacttgagtattcagccatcgaaaatactgaacggcgcatttatggtcttcaatttcatccgggtaagagaacaaatatttaaatgggaattggcaagggatttacgtattttgcaaatagttcgaacccgcactttttcagaagccgacctcaccgaccagggtattcaaatcatcgacaatttccttcgtcggatttgctcactgaagtgccattacacactgcgcaatcgcgaacaaatgtgcgaggaacgcattcgaagtgcggtgggagagaagggcgaagtgctcgttttggtgtcgggcggcgtcgactccaccgtttgtgccgcgttgtgcaccaaagcattgggcgcagagaaagtg

SEQ ID NO: 66586 - DNA, 797 bp, Heterodera glycines
  Genomic contig location: Contig_ID=SeqID_37537; Location=253..1049; Strand=-
  SCN-specific regions: Sequence locations=1-269,291-797
  Gene Ontology: Mol. function=transcription factor activity; Cellular component=spliceosome complex; Biological process=Wnt receptor signaling pathway
atgacgcttccttcttgctcaaaagatggtgctgcaagtctcagtccaatgtcattcaaagaaccaaatgcttgtccaatgttggaacggatgcattaccagcgaatcactggaaggttttccttttagacaacacagcttcatttgttagttcttttaggttttgtgatgcatgtattttcgttaaagaccgccagttcagtgctcacagaatggttttggctgcccatagtccgtattttgattcaattttgcgtcacaacaaaattgcgaaagagaaggtaaagagcgtttgttaattggaatcctttgttatttgttattcccttcagattatagtcaattgtcaagatccgactgtgttcgatcgcattctcaattatatgtatagcggctcagtgacaattgacagagccattgttgtggaattgttaaaattggcgaataatttgctagtgggttttgcaaaattagattcccattttaaagtttttttagatgatccgcttgaaaaattactgtgctgattatctgatgcgttacattgatgttgcaaattgcttggcaattcgtgatttggcctcccgttacaatttgccgcgcttgcaaaagcatgccaacgaattcttcgactcaaatataaatgggttgttcggtctattgtgtgttaagagcaaaagccgtttcagatgtcttttggaaaatgctgatgtgcttggctgggaacccatcaaattggtcgaattgcttgaaatgccacggcatgcgagcaacgtccgtgccgatgtctaccttaa

SEQ ID NO: 66587 - DNA, 974 bp, Heterodera glycines
  Genomic contig location: Contig_ID=SeqID_37539; Location=491..1464; Strand=+
  SCN-specific regions: Sequence locations=1-238,266-733,755-974
  Gene Ontology: Mol. function=ATP binding; Cellular component=nucleus; Biological process=signal transduction
atgctcaactcgcgcttcaaaaatcgcatcgcttacggaggccttggcaccatcgacctgttcaagcgcacatggaaggtggttggcggcattcatcggcgatagggggagtggggaggaataggcacggcccaagaagggtggcatgacaacactcgcacaaaaagggaactcgtacaatggcttaggctaggcctaagcttcagactaggcataggcttagacttgtttggcttaggctttattttgtaaatttttattgtacgaattacctttagtacgagttgccattaatccccaagaggggttggcacaactccaaatttaagggtttatgctaaatcagttgggcatgaatgggggagtactgggttggcacagtcggagaacagtgacatccaaatttggtgggtaggagcgtttggcacgttcactgaaccgattgagagagattggcacggctcagaacaaatgtcactacagaacccaaccaaatacataattgtttatcccttaggacctttccgagtacattaatgttgagtgtgacggggtggacatcaccgccaaaattcgcgagttcaaattccactgcattctgttccacaacatctctttctacgccggcggcaccgtcccgtggggtgccggcgacggagtgcaagtgaggcgattaatgtgttaattagtagtttttggcaaaagcattcaaacaattagttggcaaataatgccattggcattttggcaaaataaatttggcattctgctcaccaattttactgctccgatttgaggagaactgtggcgaagtgttctcccgtccgtcgccatgtgatggcaaaattgaggtgctcggcttcaccaccgccactttggccgccctccaaatgggcggcaaaggcgagcgcatcgcgcagtgctcaaaggtgcgcattgagacgagcaagccgatcccgatgcaagtggacggg

SEQ ID NO: 66588 - DNA, 929 bp, Heterodera glycines; identical to SEQ ID NO: 37540
  Genomic contig location: Contig_ID=SeqID_37540; Location=1..929; Strand=+
  SCN-specific regions: Sequence locations=1-552,575-929
  Gene Ontology: Biological process=cysteine metabolism

SEQ ID NO: 66589 - DNA, 2864 bp, Heterodera glycines
  misc_feature (677)..(677): n is a, c, g, or t
  Genomic contig location: Contig_ID=SeqID_7982; Location=504..3367; Strand=+
  SCN-specific regions: Sequence locations=1-56,78-201,225-431,453 -545,567-1057,1079-1371,1396-2133,2155-2157,2180-2222,2245-2278,2300 -2864
  Gene Ontology: Biological process=reproduction
atgagtgatgacgaggattacatgtcaagtgctttcttggcaaaagtggaagatgttaagccaggtgctgtgacccattcacccatgaaattgttggtatttgatttttggtaaaataattcccttaaaggtgtcggcaccggaagagaggggcgtcgaattttgcgaattaatgccaaccgagaagaggcgattgaaagacagcgggtggagaagccaaagtcaaaagccgaacttgaaagggacagactaatggagggactaaacgatccgatccgagcggagtcaaaaggctttcaattgttggccaaaatgggctacaaagagggcatgcgaatgggaaggagcgcagcggacgaacagcagatggacagtcggacgaaggagcccattctgatccaactcaggattgatcggtcgggcgtagggatggacgagcaccgaaaggagaagcagagggatttgtgtgaagcgcacatggagcgaatgaagcgacaggcggacaatgaggtgggacgcaattggaaaatgatgggcggggaatcgatttttaaaggaagaattggccatcgatttccgaagacgcaaaagggcagcaatggaaatgaagcaactgatctcggagatccaaaaactgagaaagacgtgccaagagatggacatgcggtgggcattgngagggagttaagcgaaacattggatttgttcagaatgggcaaaacaattccagacgaattttggttttggccgatttattcgaacaataatgaattggtcgacatggtggaagtggtcgacaaatcaaaccaatcgatggatgaaaacaaacggacaaaacgagagccttcagaaggagcggagggccaagtcgagcgatacacatacggcaacggggaggaggcaccgatggcactgaatcttaacgagttggacaatcggcacttggaagagaggtgggagatattgttgggcttcgtctagcacggcattctcccattattcaatacggtgcttttctgtcaattgcaacccgtgggaggctgaaaagtgaaatattcaaaattgcatgaaatagttttcccctttgtggactctagtttttctctgcttctcctgggggtggtttagtatattgtactgacaatgaatcagaggcttttgcggttaagtcaatttaagaaacattttagcttgacaaaaatcattgcgtacatgcggaaagtgcacttttattgtctgtgtgagtgtatgggttgtcaccaatttgcttctcccattctcagattgcggatgcgcattttcttcttcagaagagattgattttgagtgtccgggaatcattcgcgatgatcatgaataatttattcgtacaataaaattttttaccaaaataaaagtagccaatttttttattgctgaaacgtcaactgattcttagtttttatttaattttttggctagtcattctaaaattttaaagcatgaatacgaagacaaatcaaaagccgatcaaagttttatgtgcgggcgatgtcaatggaaagtttgcgcactctcagcgcgtgttaaagcggttgaccaaaaagtgctttattatgaagttgatccatttctatgtgtttgttttttcagtgcggccctttcgatgcacttttttgtgttggcgaatttttcggaccgaacgacgagcagaacaaatccgttttggagggagagatgcagctgccgctgcccacttacattctcggtgtgcgtacttacaattagcagggtgcctaatgtgccgttctaaatgagttaattgccaatttgataatgcttccgattcccaagcaggtccttcttgccagttcaccaccgtttactttccgtctgaaagttcggagctttcccaaagtctcacatttttgggtagaaaaggcattttgacaacagcgagcggaatttctgtcgcttatttctccggcgttgaagaaagccctggaggacaccagcaggacgagacgaaaccatttgaattcgaccagaaagcggttgatgatttacttttgccactctccgccaattcgggctttctcggcgtcgatttgctgttgacctcagtttggccagccgatgttatgccttcccttcttcatatgttacctaatccaagtgattttcaggtttggaaacactcctccaatcagcccacttctccgcccaatgggtccaaattgatctcgcggctggcggcggggcttaaacctcgttaccatttttccggttactttcaatgccaaattattcatttgcattatttaatgataaaaaaggtcatggagtccattacgaacgctcgccttacaggtgcttcttctttctgtttaatattctgttggtttttgttaaggaatcaccgcgttctgcttgaagctgcacaacacgtcacgcgattcatcggactttctccggtggacaatgcgaaaaaggaaaagtggctttacgcctttggcattgtgccgatgcgcaacctcccccggggcgaattggtctctcagccccaaaactgctcggaattcccttacatggaaatccttcaggtaacttttctcttaatttggattgccttttctaaagtaaaatattttaggattatcttcggcaaaaggctgaggaaaatgaacgacgaaaagccgcggaaggggcggcggtgcaattcttttacgatatgcaaacggtggaggaagaccaaacggacgtcggggaaggtcgaaagcgacggaggggaggcggacggccaacggacggacagcggaggccacggctcgacccgaaggcgtgttggttctgtctgtccaacgcggaagcagagaagcatttaa

SEQ ID NO: 66590 - DNA, 687 bp, Heterodera glycines
  Genomic contig location: Contig_ID=SeqID_7983; Location=1..687; Strand=+
  SCN-specific regions: Sequence locations=1-117,139-284,308-602,624-687
  Gene Ontology: Biological process=reproduction
tccctccctcttctgttttccgcgtgggatggctcgccagtgatgtgaagatttctgcccgtcattttctctcatttttccctttagcatctccaatttcaatttgttccaattccaaaaacaaaaagcaaagcattgcgcagtacgtttctcaatttggcacgtctcaagaacattgaattttcatttttaaaggatgaagacaatgtgagttttatttgtgtccgagtgttaatctctttgtttttcttggtttttgtttcatttgtttttaattaagtgaatctctaaaatttactcaatttcaagctaaccaaacccaaagtcgaaagaaacaaaatgatactacgagccataaaatactgttactcttttccattttacagctttgggatctcgtcggagagggttctccctatttttatgccgaatttcccgacggcagcaaaatgttgagccgttcaatggcacagtttcccctccaatttgggagagaggtaaaaaccagagaaatatctaaacatattttttatggctcaggtttttgccaacaaggcccttttggactgtgaagaaaaggtggattggaggaactgttcgctaggcaaaaaggaagaagagaagctgacaatagcacttaaagagggatttaaacctttcgcttttacgggcgatagttctggagat

SEQ ID NO: 66591 - DNA, 83 bp, Heterodera glycines
  Genomic contig location: Contig_ID=SeqID_37542; Location=41..123; Strand=-
  SCN-specific regions: Sequence locations=1-83
atgccaccacctccgactgcgatgacactgggcgacgaagccggtggagcagccgttggcaatggaccaccgccaaccgcggg

SEQ ID NO: 66592 - DNA, 1568 bp, Heterodera glycines
  misc_feature (9)..(9): n is a, c, g, or t
  Genomic contig location: Contig_ID=SeqID_37542; Location=4..1571; Strand=+
  SCN-specific regions: Sequence locations=1-180,213-344,366-402,426 -684,726-772,796-959,981-1028,1050-1213,1235-1487,1510-1568
  Gene Ontology: Biological process=regulation of protein activity, epigenetic
cagcaacancggagttcatcaccagcagcagtcttaccccgcggttggcggtggtccattgccaacggctgctccaccggcttcgtcgcccagtgtcatcgcagtcggaggtggtggcatgcttcatcccggctcaaatgcggcagctgcggcgggcatggcacgcgctccgacattcaatcaccacacccagcagcaacagcaaatgtttaacaaccaaagcgcggcggcattctatgccgcttatcaacaccagtttttccaggttttatttttttgaaaacagtgctcttttatacaaaaacaaatttgaccatatgaccccaaattttccctacgccggatccaaatttccttttattttttgccaaggcttacaattagcctcaaaattttcaaatttttgcaaaaatgactaaaatttcccgtttttcccacggtagacaaaaattcaggaaacttacatttgacaaacaatttttgaccgaaagagaaaaaaaagttccaactgctcctcccgaaatttttttaagtttacgggcctgggacaaaaaatatagttttgtatataacctgaaaaccaaatccaatgttatatcttcgtaatttcagatggcaccgcataactttgtcaacccacaagcggcgcacctccatcaccagcaaccgccgaacaatccgttggccgctgccgcctcagccgccgctgctgcagctgatgctgcacaacagcatcatcagccacaacatcatcaccaaacagcagaatgggcaagcagcacaacagcagcaacatgttcatcccaatctgtaccagcgacagcagcaaccggctgttgtccccagcatggcgccggtgggcaatccgtgcgcgaccttcgcaccgtcgaactgccattctacgaccagatcaaagtgagctggttttctaacaaaaagaaattttctatttattaacaaaaagttgtcatttctcagcagatttttatcaattattttggttttaataatgtctgattgtgagtgagaatttttcttgtttcaaaaatttaaatttttggcatacaatttggttaagaattatcccccccccgtcccggccgggctttcattgcaatttgtttaggtgattgtgccaataactgaactgcctccgtatccggtgcctattcgacctggcgatgcgcgtgcttcgcattcgtttagcgtacccagtgaggacatacaaaaggtgcactatcgcattgaggaacaaccactgccacggtaattgtcgtctctctctctctcttgccaatctcgagcaatttgggctctaccaataagtagcagatttttttagaatttctgaattattcctttggagaaatgataaatcatctttttgaaattaataattcacaattaactctcacgtaagtgttgttggcaatttaattcagtcccatacaattttcagttacgagctccagttgcgcatgtttttgttggagaccagtgaggagcagcaggacgcttttccgcccggctcgacggtgcgagtcgatgaacacggagtgcaattgccg

SEQ ID NO: 66593 - DNA, 514 bp, Heterodera glycines
  Genomic contig location: Contig_ID=SeqID_37543; Location=130..643; Strand=+
  SCN-specific regions: Sequence locations=1-514
atgaaaaagccatcagtgaccatccaaaaagaggaggaaaagcagccagcacaagccaaatcaaaatcgccatctccgcgaccagcaaagtcaccgtcaccgaatccgaaagaggtgggtactgtacaaatggtaccggtgccgtccgcgtgcatcattaccatattccctccggcgggtcgccgggaagtggtcgaccaattcggcatttgcttctactcttttaaatgcattttcagtgtgtgctaattagccacttaagtattcatgatacggtgtcctgaatttgatgagaccgtaatcatcgaaaattccgtaaatttatgagccgacaattccaacgcctaatttttgcagttttttccgtttattttcattttgaagcttttttgaattaaattgcatatattttggcagttattccgttgcaactaacaaagctaatcaacaaaatgccaagtcaacagccgcggcgcgtaattttgaaaaaaacgaatcgcattttttggatgga

SEQ ID NO: 66594 - DNA, 361 bp, Heterodera glycines
  Genomic contig location: Contig_ID=SeqID_37549; Location=1..361; Strand=-
  SCN-specific regions: Sequence locations=1-361
tatacatcccattatgaacgctaaaattatcagagtgccgaaaatcgcatgtgatctaagcctagcaaaaaatggtgtaagtaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgaacgctaaaattatcagagtgccgaaaatcgcatgtgatct

SEQ ID NO: 66595 - DNA, 543 bp, Heterodera glycines
  Genomic contig location: Contig_ID=SeqID_37550; Location=674..1216; Strand=-
  SCN-specific regions: Sequence locations=1-139,164-251,401-417,440 -468,495-543
  Gene Ontology: Biological process=N-linked glycosylation
aattcaaacgggtttacatgcgctgaaccaatgtacgaatcattgtcagacacggaggaagttgaactgaaggttaaaaaagtggaggaggcgaaagcaaaacgcttggaagactcgcaaaaaatgctgcaaaatgaggtagaaaagttaaaaaaggaattggttgaattgaaaaagaaggaagtgtcaaggaagagaaaaagattgacaaaaactgaaaaagtggaagggaataaagtgccaacaaatgtaaaagaagtacaagagacggaggatggagaaaagaaggatgaaaaggaattaaaaggaattggaaatgaaagagatttgaaggaggttaatgaagaggaaaaagaaaagaaagacaaaaaaggaaaagaagaagcaaaaaagaaggaaattgtgttaattgattcggaagaagattggaaaaaagtgtcccaacatgaagacgaggtttcgttaggtcctgaggaggaggacgacgaggagcgaaaactgctcattttctctcttcccacaaatcgattaatattcatttga

SEQ ID NO: 66596 - DNA, 2047 bp, Heterodera glycines
  Genomic contig location: Contig_ID=SeqID_7984; Location=409..2455; Strand=-
  SCN-specific regions: Sequence locations=1-72,95-595,619-815,837 -1007,1043-1046,1068-1292,1329-1418,1440-1934,2027-2047
  Gene Ontology: Mol. function=cytochrome P450 activity; Cellular component=endoplasmic reticulum; Biological process=electron transport
atggccgacgtgcaaattgcggcgggcggaggcgccaatttccgtctcggccgtggcacaattattgtccctcagatcagctgtgttctgtttgatgaaaaagtgcatccggctttatccttcaattttatctacttccgctttcttctaaaggtgtttcccaatgctcgtcggtttcttccggagcgctttttgaaccaaatgggccaattggagcgatttgaggagctgattccgttcggacttggcaaaaggttgttggcttcacgcctgttcacattgccggctcggagggccctggattctcaaattttaaataaacaaatccagtttttttaaatttctgatatctgtcgccaaactcaggcttactgcaaatgcctggcttgggctgtcgaaaacgaggcaaaaaagtgtaaattctttattatcttttagagtttgcatgggcgaatcgctggcccggatggaattatttctcttcacggcaaattttttccgaaatttcactgtaagtggtgaaaaaacatcgtaagcatcacagtctgatcactaaatgtcaaggttttgcccgtcgatccgctgagccctccgtcttctgagaaggaaaagggcttttctgtccatcccatcccatacaaatgcagaattgagccgcgcacatgaaaaagatgccttttatgcgatttggggaagtgatcgggaattacccaatttcatcgctctatcaatatgtgaaaatttcgaggagcaatacggaatttttcaatactgattcaaaagatgctagggttttgctcctggttctgtaaatcgggccaattttttaatttcaaaagccagtactattaccaatttggccctatgttgcaaaagaaagaaagcgggtgggagaaagtgggataaaggacatgggaggtggagaaggatttaacaattcacgacttgaaagactcgatcagagtttttttagatttcgaaagtcgattcagatttttgaggaattctataaaatgaaattataaaattgatttgtgtaatatggcatttgttatgccagagaaaccgcgcaaaaattcaacagtttggaatttatgattagggctcgtttttaggcacaaaaaatcgcgaattatgcacctaaaaaggcagaaaaaatcacaaaataggcaaaaaaaatttttattaaccctttttaggtagtaaaacacgtaaaaacttaaatatttcaattgtaaatgaaattattaaataattcaaacttttttcgaataaggacaaatttttaaaccaaaaatttttattaagaaaataaaatattaaattttgggattaatttttggaaaaaaattttcaaacttaggggtgtattttctaaaattttattgggccatttcttaggggtgtgtttttcgttttattgcatttgtgttaaggattttttcgaaatccttaaaataggcacattaggcacaaaaaccccgaaataggcagaaataggcattataaagtcatcgtagaattcccctttgaaaatattgccatgatttggcttagattttgcattaaaaaatgcaatttttgtattttggcagaatttttaaacacaaaaatagaaagttagttaagaaatatcatagtatgtattacacagacaaaaatagtaaatgaaaaaatatttaattcctaggagggaatcgaaccaagagcaacaagtcgaaaaccaggaagaatagccactaggccatttgagaataaatttttttttcaaaattttctttctcccaattacattacaaattttccatcagaccaccgttcttaccagttctttttttccaggttggtcccgaccataccgggaccgggaattcccgttccggtcccggtcccgtgcaactctacttactaaacgtttataaaattaaagggactaatttataaatattaaaaattattaatgcatttacatttattttatataaatttaataatattaacaaaaaaaaatagtttataaatttaacagcaaaataatattaataaa

SEQ ID NO: 66597 - DNA, 252 bp, Heterodera glycines
  Genomic contig location: Contig_ID=SeqID_7986; Location=842..1093; Strand=+
  SCN-specific regions: Sequence locations=1-2
atggacgaggaggagggaaaggaagtgagaattggattaagaggagaaaagggggagaagtggaatggcagaagaggaggaggagaaggctctgggagagtaaaaatgagagaaagaaatagagagaatgagaaaagaggaaaggagaaaaagagagggacagaaaaaggaagaggaaaagcaaaaagaaacggaaactaaaagaaaaaggtagaggaaaggggaaaagggaaaaagagggcgaggggtaga

SEQ ID NO: 66598 - DNA, 183 bp, Heterodera glycines
  Genomic contig location: Contig_ID=SeqID_37553; Location=970..1152; Strand=+
  SCN-specific regions: Sequence locations=1-39,61-183
ccctaaaaaatcgattttttttcaaaaaatgatatatcaaaaattaatttgtaaaatattcaaatgtgattctaagcctattttggtcgtttttatggcattttgtgcctatttcactttttacgaagaatttttttccaaaaataaccattaaaaaaatttatttacatattttcctacata

SEQ ID NO: 66599 - DNA, 642 bp, Heterodera glycines
  Genomic contig location: Contig_ID=SeqID_37554; Location=130..771; Strand=-
  SCN-specific regions: Sequence locations=1-31,53-125,154-302,324 -564,586-642
caaaagttttttacaaccacatattgccaatctaatttcttgcagattgaaagccatccattgcctgccggtctcggcacagcaaagcactaatagggtgtttgactttcttcaaaaaataattcattacccaaaagttttttacaaccacttattgccaatctaatttcttgtagatttaaagctatccattgcctgccggttctcggcacagcaaagcactaatgcactaatacggtgtttgactcacttcaaaaaataattccatacccaaaagttttttacaaccacatattgccaatctaatttcttgcagattgaaagccatccattgcctgccggttctcggcacagcaaagcactaatagggtgtttgattcacttcaaaaaataattccttacacaagttttttacaaccacttattgccaatctaatttcttgcagatttaaagctatccattgcctgccgggtctcggcacagcaaagcactaatagggtgtttgactcacttcaaaaaataattccatacccaaaagttttttacaaccacatattgccaatctaatttcttgcagattgaaagccatccattggctgccggttctcggcacagcaaaacactaataagggggttgactc

SEQ ID NO: 66600 - DNA, 609 bp, Heterodera glycines
  Genomic contig location: Contig_ID=SeqID_37555; Location=33..641; Strand=+
  SCN-specific regions: Sequence locations=1-7,42-282,304-436,474-609
atgggagaaattaaaattatgaaaaataatttaaataaaatgcgcagagatttgtacagaaattttgaagaaacgaaaataaaaattttggaaattttaaaaaaagacggagaaaaaatgggaaaattaaaagaagaaaatgaccaaaaattcgaagtgcaaaaagcgacgcatcgaaaaacatttgaaaatgtaacgaaaaatatcgaagacgaagccgaaattgggcagatgaaaagggaatgttcgctgtttttccaaaggttcgaagaatgccatcggttcacagaagagaaaatttacgaattggcgacgaaaaacggcgaaattcggaaaaatttgatgcaaataaatgtcggaggaaaagcgcttcaaacggtgggccttcaaattcgccttacgcttttcgacggcatcgaaagagcgatggaaagtgagcaaagcatttggggaaatgaaaaatgagaattttaggtgaaaattcagagttttcccgttttgaaattgtgtccgagtttttgagtttgggctaaagaactatgattaatctatgagtaatcgctaaatttttatcaaagcaggaaatctgatacttccactaattcaaaa

SEQ ID NO: 66601 - DNA, 867 bp, Heterodera glycines
  Genomic contig location: Contig_ID=SeqID_37556; Location=314..1180; Strand=-
  SCN-specific regions: Sequence locations=1-37,74-434,456-637,687-867
atgtcttcatcaactgctgaactgaatccggaagatggtggtcatccgccacagaacaccgccgtggccatcgagcagtcgcaacaggtgggggcaattaagcggggcaatgaatgggtaattaattgctactaattggaggtggtggggtaattaagaggaagacgattatggatatccatattgaactgatcatatctatcgatgtctttaaaacaaatcatcggactaataattcggcttattaaatttaggattaagcctcgacccgatgcgggaaattactaatttcgtctatttcactccatattaggggaaattgtgtttaaatgagtttctgagactttttgccttataaaaagtttccttttttcgactgttaggcttaggattaggcttttttgagaaattcctacccgacgagggtgttcccgaaatttttaaaatttctccaaccaatctcgacaaattttgtcgaggaatttccctccacgattcccgacttttccctccccaagggtcggagcttaaccctaattaaatcctcaggccatccatccgccggcacaaagcggaagcggcaaaattgccgcgtgggcatcgccgaacgcggacgacacggagccgtacgggtgagtaattaacataaataattttttaatttaattttaaataattttttaaatgttttcagaatttgcgcaaagattctgatcgttctgtcctacatcatcacaatcatcacttttccgatctccgtgttcatgtgtattaaagtaaataattcaaagaaaatataaataaaaaatcccctaatttaaatgctttcaaataaattttcagattgtccaacaatatgaacgagcg

SEQ ID NO: 66602 - DNA, 826 bp, Heterodera glycines
  misc_feature (38)..(38): n is a, c, g, or t
  misc_feature (44)..(44): n is a, c, g, or t
  misc_feature (67)..(67): n is a, c, g, or t
  misc_feature (70)..(70): n is a, c, g, or t
  misc_feature (97)..(97): n is a, c, g, or t
  Genomic contig location: Contig_ID=SeqID_37557; Location=349..1174; Strand=-
  SCN-specific regions: Sequence locations=1-371,393-535,557-701,723-826
aaacaaaaaaatcgattttttcaagtgtcgtttggggntactcnaacaattatggggagcaaaaatncancgcagaattaaagtacaggctataggnaagctattccgaagggattcggtctccccataaatctgggcgcatcggttcggggggactgctccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaac

SEQ ID NO: 66603 - DNA, 49 bp, Heterodera glycines; identical to SEQ ID NO: 51181
  Genomic contig location: Contig_ID=SeqID_37560; Location=689..737; Strand=-
  SCN-specific regions: Sequence locations=1-49

SEQ ID NO: 66604 - DNA, 533 bp, Heterodera glycines
  Genomic contig location: Contig_ID=SeqID_37561; Location=447..979; Strand=-
  SCN-specific regions: Sequence locations=1-125,175-206,228-307,345-533
atgattttcgctttcaattgcggcttaatggcaatgttttgtgctgcttttgaccgactttttgctgttgcattgccttttaagtgagaaaaataaaatataattaatggtttttgattgtttggattattttataaatatattttatttatttataaattattttattttttaggcattcggtcattttcacaaaatacaagtaccaatatttgttcagccatcttttcatttgtataaattacggagcttttattgtgtacaatttgcttaaatttgctttccaaaatgcgggaaagtatggcgctaaatttaaatactttttctaatttaattttaatttaggccaaccactggcttagtgtccgaaagttttcaagactatgtgaacgatttttttactgatggcatttacattctttctctgtgcagcgcctgttgttatatggcaatctttgtgattatccggtgcaaaaatggcggtaaaaatgtgccaattttgcacttttgccaactcaaatatatttattaca

SEQ ID NO: 66605 - DNA, 399 bp, Heterodera glycines
  misc_feature (299)..(299): n is a, c, g, or t
  misc_feature (381)..(381): n is a, c, g, or t
  Genomic contig location: Contig_ID=SeqID_37563; Location=982..1380; Strand=+
  SCN-specific regions: Sequence locations=1-20,89-107,155-172,299 -299,379-399
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggnatcaaaagcgacgtcgctatggacgcttggccgccacaagccagttatccctgtggtaacttttctgacacctcttgctggnaactttacactttcaaaa

SEQ ID NO: 66606 - DNA, 79 bp, Heterodera glycines
  Genomic contig location: Contig_ID=SeqID_37564; Location=14..92; Strand=+
  SCN-specific regions: Sequence locations=1-4,75-79
atgaagcaccagcagcaacggcaccaactcaccaacaaaatgccaacatcgatgccagcaacaacaacaacaacgcgag

SEQ ID NO: 66607 - DNA, 715 bp, Heterodera glycines
  Genomic contig location: Contig_ID=SeqID_37567; Location=21..735; Strand=-
  SCN-specific regions: Sequence locations=1-15,37-84,106-342,367 -489,511-591,622-715
  Gene Ontology: Mol. function=DNA binding; Cellular component =chromatin; Biological process=negative regulation of transcription of homeotic gene (Polycomb group)
atgaatcaagcaggtgccccgttggtgcaacaccagcaatttgttttggtccctgcctttccttttcacactgaacaccgccatcaacaacaacaacaacaacaaaatgttcagcgacgccagcaacaaccacaatttctgccgttcactccaactcagcaaccgcaacaaaacattgcatatcagcgtcaccaatttgtgcagcaaccccaagatcatgactaccaacaccttgaccaccaccagcaacaacaacaacaactgcaacaattccaaaacgctgcgccggaaccgcagcaaccgcaacaaacaattttgcaaaatcaaagcgtaggatcgccgcaacaacaacagcaacaacaacaatcactcattcaacagcagcagcacgaacaggcaacttcacaacaaatcctgccgcatcaaactccgcaatttcaacaacaacaaccgcaagaagaacaaacaaatcgtctgccgcaacctccagcgccgcaacaacaacaacaaattttgtaccaactgcaaccaatgcaaccttatcagggggaagtccaacacatttacaacgaaattcatgcggtaaaatgcaaaaaaaaaaaaattatgatataaaatataggatgaaatgctcatccaatcaacctcggctggtgctaatcgtgccactggtggtggaccaaatgctaaaataattgaatcactaaattcatga

SEQ ID NO: 66608 - DNA, 311 bp, Heterodera glycines
  Genomic contig location: Contig_ID=SeqID_37568; Location=593..903; Strand=-
  SCN-specific regions: Sequence locations=1-130
gcatttattagaattaaaaagtgctggcgaaggccaacaaaatcccttcgtatttattgcggaagcacgttggaatccaagcgatcacaattttgaagtgctgaacacagaaacaccaagaggcattcagaaataataaaatattaaatatcaaattaattaaatatcaaatctatattatattaattttatttaatttatgcatttaaaagattaaaatttgtaaaatatgaaatgaaaaaaattcaaataataatgaaaaaatttttagaaagtattaataagggaaaaaaaaattttttttaaataaa

SEQ ID NO: 66609 - DNA, 931 bp, Heterodera glycines
  Genomic contig location: Contig_ID=SeqID_37570; Location=576..1506; Strand=+
  SCN-specific regions: Sequence locations=1-48,85-346,368-527,549 -670,692-791,817-931
  Gene Ontology: Mol. function=valine-tRNA ligase activity; Cellular component=intracellular; Biological process=translational elongation
atgtgcggtcggactgtgctgtttgtgcccggctgtgaccatgcgggaattgccacccaagtggtggtggagaagaagctgaagcgcgagcggggactcagtcggcacgacctcggccgggccgactttgtgaaggaagtgtggaagtggaagaacgagtgagtgctgcgggcatcggattcatttttcaatgggaaacttgcgctgttttttcattttgatcgttttttttattcgttcagaaaagggcacataatttatgaccaactgaaaaaaatgggcgccggcgtcgattgggaccgagtggtgttcatgatggacccggtaaacccaataaattcgaatgaaaattttaagaaattttttggcatcgaataaaccccatttgatcgtcttttcctagaaaatcatgcgcgctgttactgaagcatttgtgcgaatgcacgagaagggtgtcatttaccgaagcaaacggctcgtcaattggtcatgcgcattaagttcagccatttcggaaattgaggtacaataaactgacttttctaatagcacagtgacgaagatataaaaagtgatcaaaaaattcaaatttgaacttttttttaaaaaacgaatcatttgtgagaaagttttgattttcaaagcatcgcattttgattccattctcctaaaagaacgttttgttttatttcaggtggaaaagcgtgagattaccggtcgcactttgctctccgtgccgggccatgccgaaaaggtcgaggtcggcgtgttggtgttgttcgcctacccactggaggaggaagtggtggaggaggacggcagcaaaacccgtgaaattgttgtggctaccacgcggctggagacaatgctcggcgacgtggccattgcagtccatccggaggacgcgcggtacaaacgaatcattggcaaa

SEQ ID NO: 66610 - DNA, 3061 bp, Heterodera glycines
  Genomic contig location: Contig_ID=SeqID_7990; Location=3129..6189; Strand=-
  SCN-specific regions: Sequence locations=1-212,236-536,561-583,605 -872,913-1461,1483-1668,1690-1968,1990-2332,2387-2525,2551-2868,2890 -3061
aatagccaaaaaattcttctcccaagcctattatcaattaaattctctcgcccatttttgatcaaaaattcgcctatccttgtaaatgcccccagttcgttattataagaatttaaaatgtggaaaagcggctcgcaatgacttaaatttacttattttgttattatttcttcagcttcggaccataatgttattctcatacatggcctattgcatttttattgttctttttatatttttctccaattggccgaaatccgttgccacaattctgatcaccccccccccccacaatcatccccttttttattttttcagaatgtttttccattgtgacaatttcactgctggaccgcctcgaccgacaccatctcgcaggcgctcgtctttcgctgatccgggggaggtgcgcggcgatcagaccgtgaggacactggtcttcaaacggcgggggacgtaggataaataatgatttatccttattttattgttttttgcaacgattgtttttcgcgttaatttaaaatatttttgcatccttcatttaattttccttttggtcttcgtctttgtcttcgtgttctctcaagtttttatatattttgtgcttttgaatcattgtaataaaactacaaaaatttggtgcttttctccgtggactgtcatccaacaacaacaaacgcccaaaggcttaattggtactgttgtttgagtttctaattgcaattcaccttattctctaattccttgtcagtaaagtggtgttgaaaattaagtaaatctttccttgaccccaaaatctcaacccgaaccccagcaaatcccaaagtccctcaccgaatatacaccctttctccaacgcatcaagtttgtaaatttttattagaaaatttttggggacaaattttggggaaaaaaactttttgtttgagttgactgtctaaaggcttagttcgaatctctgccatttgatcaacgttaataaaactgacagcaaccacgttcctaaaatcctaaacttgggaaaattaaggccttggaagggatgtgcccaatttttcaacggatctggttgcagtttttcgttatcattagattttgccatttgttaccgaaaaattctaattttttttttgggggggagggggaatatgaccctcgaaataggtcaatttcaatttgtattgacatttgtccgtcttccaggtgacatatctcggcaacatgttgacaatcatgggcaagggcgacacgtccattgaccgtccgttggaaggttttaatttttttgggaatttttaggactgaaattggttgaaattttaaaggattttctgaccttggggggtacccgttggaaaaaagagtcttccaaccaatttttcagatttttttcgtgtttttttcaatattacttctctttatttgtcccgaaaatctttttttttttttttgctttaagaaaattatttcttacaattagcacgaatcttgcaatcttttggaaaatgacgcaggggatcttggatgaaactggttgtgagcaataataatagccaggcaattccaaaaatttttttttaaattctcgaaaaattttcgagcctgtggttcgggttagtaattgagccaaaataaggcaatgcgtgctcagcgcctcgggttacctaaataaattttaaaaaaattcaggaccaatgttcgttactattgccctgatttttgggctttttccgcggcattcattcattgaaatttctcttaacttctaacaccatgaaaattattggcccaacagacaaagaagattgttttaagccttttccgttttcaattcatcgacttaaaaaggcccttaaattttaaaagcgcaattgcccaccctccgattttgtagcggctttttgcaaaaaatagacagatttcaaaaattacggtttgcatttttgccattgcgttttttggcgctttttttaaattatattttttgtgtcctattttccatttttaacactttcctccccctcccctcggcagtgattacgcgcgcgtggggcgccaccgtcgccaaaggcgcgacgcgccacagcgccggcgccacttttggccagcaacaggcgcaacagttggcgatgcgcctgtgcgtgtgccggtctgggctcagggccgagacgtgcattgggtgagtttgtttggtgcaatttgattaaaaatttcaaagttttcaccggcgacgcctttctcactaccctccctctccttatttttatttttttgtttgaaaacttttttttctttgagaaccacggcaaaaaaattgccgtggtgattgtttttaattgaaaatctaaaatttcaaataaaaaattatttttatgttaattaacgaccagcaattttttttcgtaaatttttatatgtaagaaattcaaatttaaattttcccacacttttcagtgtcactgaatattttacgcaccgaatcacttggtcggcggcgcccagtcaatacccggtaaaagtgcaaaaaaaaatttttttttttaatttcccctaaatttagcgcgtgttctgctggatttacaaggtgcttgctgctttggctatgtttctccatttctaaacgttttttcaatgaaaaaaatttaattcgttttttcaaacaaaaaaaaaacaattttctcggagtttttaaatggaaaagttgggacccaattaaaaatcacaaaaataattgattaaaaatttgattccaggccttggatttcctgtatttttgtttggccagaaaaccaggccaaatatgaaacccagatacaagtcctaattcggcacgtaaaacattgatttttgaacccttagctttggttttttcaaacaaatttaaaattgggaatagtttttttttacttcgttttttgtaaagcacgagggcaagcggatgaagcccgaactgcggtgccatgccgtgctctgtcgccgggcggacgagccccaacagatgcaccaaacattgcgcagacatctccaatcggcactccaagtgagtaatcggagggag

SEQ ID NO: 66611 - DNA, 138 bp, Heterodera glycines
  Genomic contig location: Contig_ID=SeqID_37573; Location=184..321; Strand=+
  SCN-specific regions: Sequence locations=1-138
gacagggtttgttcgcctgctggcactaccattgctggactgcgtgagcttgaacgctctggggtcagatcggcattcattgaagcattaagcgcttccactcgtcgtgccactgaaatggctccgaagacaaactaa

SEQ ID NO: 66612 - DNA, 183 bp, Heterodera glycines
  Genomic contig location: Contig_ID=SeqID_37579; Location=6..188; Strand=-
  SCN-specific regions: Sequence locations=1-183
atggctaacccaattgcaaccaaaaaacaaaaagtaaaattgtcttacgaaggccacctttacaccttcgctaaaatgagttctgatgggatgacaaaattttagagatgcgagttcaaaaaatcatttgacattatttttggagttctccggggaattctcgcactatcgaatgacccgtga

SEQ ID NO: 66613 - DNA, 1757 bp, Heterodera glycines
  Genomic contig location: Contig_ID=SeqID_7991; Location=661..2417; Strand=-
  SCN-specific regions: Sequence locations=1-334,357-1275,1297 -1477,1499-1757
gctcggctcgattacctccaattccatcggttcagccggcaacagattgccaaacttgtcgtggagtaccgctactggttgaacatcccgcaggaacgtatcgatgcccggtaaattacaaaaacaaaacaaaaaaaattcctgttttatttgggttcgaacccttagagtttccgaaaacattttttaaaagtcggtcaagtggtgaatgttgttggttttcccatactttgacacgggttcgagtcccgttcgcgttatgaaattttgttctgtggtaagtggtgtgcatcgttccttttaacttgttttgtgcaggttcgaaccccgacgcatttttttaattttatattattgtggaaatgttttccgggtttctctaattcaaacaaaatttttgtcgtacaatttaaaattttttttctttttttttgccagattgggctggttgcagcgtcagttccatctccgcgccgacgaactgcgcctggcaattgtcaaagagccaaggctgatccaatttggcgtcggcccaatccaggtggcaaaatttctcattacataaacccgtcattcgtaattacggagatgtttccaattacggagtccaaaaaatggtggaaaagaaaccacgaatttaacaaaccgagctatctcatctgtttacgccttttttcctttccttccgcccactgcagaagtgaagaatgggcctaccgacaaaacggaatttttgagtttttaatgccctgcgaaatttttacattagctgccagacaaatccaaaattattacaggttgtttcgacattgacccgtaattttggggggtccaaaatgcttaaaaaattcctaaatttatttccattcgaatgctctttctccagggtctcattttggcgctgaaccaaacgtgcggcttcacccagcagtgcctgcaacaaattgtgctcaaagacccgcgcgtgtttctgtcggagaagccccacgtgttgacctcctacaactacttggcctacgtgatgcgcatcaccaacgaacagattggtgggagcacatttttgaaatgtttttttaaatatttatccatggaatggagagggacgaaccctcaatcagaaagtgttcgtattgagaggccatacaaaaaatcaggggctagggtccaattgtctgactttgtttttcgtatagaggtccctataaaatggcaagactttgtgttaccaatttttttgttttctttccgattattttttttttaaaccttgacaaatagcaattcaaaaataaaatgcatgaagtgagggacagaagataaaatgaaaaaaaatggttgggttaattcgaaatttttttttgggaatcaaatgacaaaatcatttaacgcaaattgaaattcatgaatgatttctaaagccaattagtcattttgaagccttcattttctgtctcggtttaaatctcgaaattcggattattttttctttagaaaactaaattttatgcaattttatcgcacttttacattttccacaaaataattcagtggcatttccgctcgccctgcgctgtccgttgtcggcactgcgccgtcgccacgagttcctttttcgactgcgcaaggccaactacgtgccggagacggctgatcacatcacactggagcagttctgccatcccagcgatcgcttctttgccgaagaaattgccaggacaccaatcgccgactttaatcgattcattaaaattgtttaa

SEQ ID NO: 66614 - DNA, 1131 bp, Heterodera glycines
  Genomic contig location: Contig_ID=SeqID_7992; Location=713..1843; Strand=-
  SCN-specific regions: Sequence locations=1-302,324-420,442-973,995 -1131
atgagccaagcatttggccaccaattgctattgctccgttgtcgtcgtccctcattttcaccatcgtcgtcgtcggcattgttttgtccattatttcgtgccaccgccgccgctttcgcaacggttggagccaaaaaacaatcaaccgcacaacaccaaggcgaacagcaacaaaaacaggctcaacaagtacaacaacaaccgttgaaaaatgccaaattgcaaatgggcaacaatcggcggatggcacggctggtcagtcatttccgtaccacaatctgttcaagtcgaactgggttgggtcaacaaaaatgaactttttggcacatgggatgttgaaagctgaaaaaatcgtcgacctttccaagtcgttcaccaaaaataagtagaatggcacaggctgaagtcaaatccattaaaaaatatatttgaaaggctggtgggtttgaacccggccaggcccatcccaagacaagagttttaccaactgaaccacatacgttaaactttttttcgcgttttttcggcgccactggtataaattttagaatccaagaaatgcattaaattaaaaatttttgactaaattctgtattttgaaggcccacgctgacgacgaatcggccgaccaattggctgcccgggaggactgggcccattttgaaatggttgagcgtcagctggacgaactgcttgaacatcatgcggacaagttggacgaggagggtgatgtgctcggcgttgacatggtggcggacccgctcaacgaggtcagtcagccatggcaagggcatgtgaaaccctataaatttcggagatctcaaattttttttatcatgtttcaaacaatttaagaccgaaaaggtgtgaaaaattgcttccaataaaacatgataaaattttcttgaattttgcgcctacatagagaaagaaccttaatttgtaagggctattgtatgtgacactaagaatctttaatttggctgactttgacaaaagttttgaatttttttgtttttggattcatatttaaagaaaactttacaggctggtggtcttgaacccggacttctcccctacaaaaagaccacttggtcattcttttcgttcattcattccctgtcatattaa

SEQ ID NO: 66615 - DNA, 1391 bp, Heterodera glycines
  misc_feature (320)..(320): n is a, c, g, or t
  Genomic contig location: Contig_ID=SeqID_37584; Location=63..1453; Strand=-
  SCN-specific regions: Sequence locations=1-483,506-682,705-1038,1060 -1112,1134-1199,1227-1391
gatgcgatggcatgcggaaatgttcatcattttcattgtctcaatggttgtgcacaaaataatcttgatgttgtgaagagaagacattttcgctcataccgggtaaaaaacgggtggtggtttcgctgaaagggctttgtctaacaataaatatgattttggttcagttcgccactttggtcggtctttggctaatcccttttatggtgtcacttaaaaatggctggtggtgattcattctttcctggactgtgttcacttcttcaaatattttacgtttggcggagggtcaatcagccggcaatttccggatcaactcnccaggttttcagtggcttttacgcaaaaaagggaaattcgtccatttcccttttaggctcgtctacaaatactttgttcatgcataaactcagttacatttttggtattgtcggttacttttcactcgtctttactgtcattggaataaattcggtgttcggtaaaattaaattttctaaaaattcaaaaaaggctttttaaggaattagcagtaatctgagcttggattttggcgtgcatttgttgttttattgcctttattacggtgtgcttggacgtgatttggcacattctctgaccgacagattggcctgcaaaatcggggttttaaaaatgaaatggagagattaacacattattattatttttctagtattttactcatgacggattgccaaaacggtaccaacaaaacggaattgttcactgtttttttcaccattttagggttctcgagtcggatatgtgcgccgtctgcgggaataatttgcataaaccgtcgtccaaccaaaacaatttcaattcgttggatgaagcgaatggaggagtgatgaccgaagctcttgaactgccagaagaaaaagtttgtcacggttttgttcgttttttgacactttctttttagacgtatgctttggcatcgtaaccacgtattccacgagttttgcatccgcggatggtgtgtggtgggcaaattgcagccatcgcccttactcgtgagtgttggaacaaatcaaattctccacgttttttttccaatgttaacgataggcttttaacttaataataagacagatttttatggcaaattaagtacttccttgcaaatttacatatatgaacttaattttatatccttgccattttcaggcaaagaaaaggtggacctcaagaggatgttcaagaaacccgtggggttttttgtcaatttcctctcgatttttgaatttagatggggaaaaaccacatcttttctacgggaaattgctgggattggaccttggactgggaatggagcttatttgatgtatatgcacgttaaagatgcaataacttatttattgttttaa

SEQ ID NO: 66616 - DNA, 147 bp, Heterodera glycines
  Genomic contig location: Contig_ID=SeqID_37587; Location=829..975; Strand=-
  SCN-specific regions: Sequence locations=1-147
ccaacgcagaattaaagtccaggctatagggaagctattccggaaggattcggtctccccataaatctggggcgcatcgggtcggggggactgccccgaaaacaaaaaaatcgattttttcaagtgtccgtttggggtactcaaaca

SEQ ID NO: 66617 - DNA, 455 bp, Heterodera glycines
  Genomic contig location: Contig_ID=SeqID_37588; Location=136..590; Strand=+
  SCN-specific regions: Sequence locations=1-455
gttcggttccagttgttggtttgcgcatggggagaacgaacttcgctctgtctctgctggttcgtccttttcttcgcccatcgggagccgtaaaccgcgttcgttgttgccacgcccgcctccgccgctgatgttcaaccattttttgacccatggtttcgctcatttcctttgctgtttaggttcggttccagttgttggtttgcgcatggggagaacgaacctcgctctgtttctgctggttcgtccttttcttcgcccatcgggagccgtaaaccgcgttcgttgttgccacgcccgcctccgtcgctgctgttcaacattttccccaaaaatccctgattttcccgagaatgctttttttttccgcactcaccgtttttaatttttgaaatcaaatttacattttttattgtcaaagtttttcaaactttcgaataaatttatgatctgtt

SEQ ID NO: 66618 - DNA, 1526 bp, Heterodera glycines
  misc_feature (1442)..(1442): n is a, c, g, or t
  Genomic contig location: Contig_ID=SeqID_37589; Location=35..1560; Strand=-
  SCN-specific regions: Sequence locations=1-250,276-283,305-432,491 -579,638-947,969-1070,1093-1168,1201-1427,1457-1526
  Gene Ontology: Mol. function=glycine-inhibited chloride channel activity; Cellular component=integral to membrane; Biological process=cell surface receptor linked signal transduction
gtcatgacgggttacggatgccgtaactgaaacccagttacgcccagccctgcttttgattgaaaaagataaaatgaactgattgtaccttttttgtcctgttttttgattgcccccctttttcagctattatttgatccaactgtacattccctgttggtgatttggacctttaacaaatgatcaattcccattgttattacattctttcattggcaggtgttatgttagtcgtcgtttcgtgggttagataaatttaaaaataaattaattttgcaaatggccaattttttaggtgtcattttggcttgacaaagatgcaggtttatgcattttacaatatctttttttaattaatttaacaatttttgctttaacttttttagtgccggcacgcgtttcgttgggcgttacaacgtaagcaaaacaaaactctctctctctctctctctctctctctctctccttttttaattttaattcattttgggctgctaacaatgaccactcaagcatccggcatcaactctaaattaccgcccgtttcatatattaaagtgagtgtttaacaaatgttccaattttaaaatgtttaaaaaattcaaattattaaaatccaaaaattaaaatgccaaattgaaaaggccgtcgacgtttggatcggcgcatgcctcgccttcatttttgccgctcttttggagtatgcgctcgtcaattactatgggcgaagggaatttatgaacattgagaagcggggaaagtcgggcatcggacgactgagcatggcatttcagcaggtgaatgaagaagccaaccaacaaaagcattctgtgatcagtcataagcgcatccatccatcattaatcattacatcgatttaattaattcattcggcgattaccatttcccttcctcataccgtattaccgtatttactcgattagaacccccctcgcgattaaagcacccccttctgaggggagttgaacaatagagtccctgtgggctataatcgagtaaatacggtaaattgattacccccctaccgtattcaggaatgtctctgtccgccccctcccaacatttatcacccggacttttttgcacccaaatcgcccactaagagccaacaacaaccacagaaacaactgctcactgtgccgggcaccaataacaacaacaataacagcaacaacaacagtgccatcgtcggcttcgtcggcgatgccaacggcgaccatccgccgctgagtctggagaacaacacattcttcccgcggcgcagaagtggctgttcgtcctcaaagcgccgtcggcgtgagcgaccgttcgccgtctttggcagggccatgcgacggttgcgccatctcttcggctccggcgtggacctgtccaaacgagtggacattgtaaaagcaattgattgctaattaattaattanattttattaattaaggtgtcccgggtcgcttttcctacgctttacctcgcatttctctggtcgttttccctgcttttccgtcca

SEQ ID NO: 66619 - DNA, 60 bp, Heterodera glycines
  Genomic contig location: Contig_ID=SeqID_37590; Location=621..680; Strand=+
  SCN-specific regions: Sequence locations=1-60
gtttttattcgcttttgaatttgggtacattttgcctatcgatcactcgccgaccccgac

SEQ ID NO: 66620 - DNA, 569 bp, Heterodera glycines
  Genomic contig location: Contig_ID=SeqID_37591; Location=1..569; Strand=+
  SCN-specific regions: Sequence locations=1-443,468-569
  Gene Ontology: Mol. function=structural molecule activity; Cellular component=extracellular space; Biological process=negative regulation of cell proliferation
cgcggatggacgccgttgtggagcggatacagcttcgcaatggttagcgaaacggaggcggaaaagccgagactctcgggactaattggaacggataaagaaaagccgagacttttgggtcatttaaggtcatagttttagcgaatgttatccaatgtaatgccaagcacacctcccttccgccaattccctgttttaattttcttttccgcagcataccgccgctggcgctgagggcaccgggcagaatttcgagtcgccggggagttgtctggagacattcttcgcggtgccattcatcgaatgccatggcaagggcacgtgcaattattacgccaccaatcacggcttttggttggccgtcgttgaacaggtggacacagttgggcacacgatacaggcatactgtactgtcagaaagggttacggttactgcgcaattcaaattttaaattattttttaatttccactacagtacaaccaattccgaaaaccgatgccacaaacgctgaaagcgggcggactgaaggacagagtgtcgaggtgccaagtgtgccggaaaggcggc

SEQ ID NO: 66621 - DNA, 634 bp, Heterodera glycines
  Genomic contig location: Contig_ID=SeqID_7993; Location=1732..2365; Strand=+
  SCN-specific regions: Sequence locations=1-160,189-262,321-453,511 -536,559-634
atgtccaattgtggctctgatcaacaaattgatcaacaaaatcgtccattgcacgatcagccgcaaagatacattgacgaggacatcagcttgacagttgaccaaaaatttgagcaagaagcaaaaaagccactaattgaacaggtggggcacttattacaaaaattaataaaaaatttaaaaaatatgtcctggatatcttcttggataaaagggttattcttgaaaacatatccaaattatgaaaattttttacttgttcttattaactttaattcataaaataaacaaattgaattaatttattaatttaatataaacttgggattttgtttttaattttaaaaaagtttttttgacatttaaatctcaatttttataagaaagtccaaactaagaatttaagattgtgcgaatttttgataattctaagtattcagaatgttatcaaaactttaattttgctttccatgtctttaaatttactttaattttttttttatataattaccgcatttctttaatcctttttgtccaaattattttttttttaattttgtataagcaaatctttttcgcgcatctactgttcttttatccattcattttgcagggtcagacaaattcttactca

SEQ ID NO: 66622 - DNA, 650 bp, Heterodera glycines
  Genomic contig location: Contig_ID=SeqID_7994; Location=827..1476; Strand=-
  SCN-specific regions: Sequence locations=1-56,78-446,485-571,597-650
atgttggtttttacaacaatatttttgtctttagaatgccttgaaattttcacttacaaaaataatttacataagatgtaacgcgaactctgcagcaaaattttaggatttttaatctatgtgaatttttttgtgaaaacagcctttaaatttttgataaaaaatataacaaattctaaggaaatttgggctctcggtgccgatagtaaacgccgagaaaaaaattaagattttgatttaccgctaccgattaattaccggtttttctaaaatgggtcggaaatggtaattacttggaccgttgaatttcatggagttttccattttccagtcgcttataacttgcttagaggaggggtgtcgatctgaaacaagacaaaatctcggctcgacaaaaaatatgtgaatggtctttctttaaagatttgatcggcgcaagaattttgaatttttaaatttttttttattatagatattttttaatcgtttttgttatctgcccgagattttgctgttttaaaaaaaatgttcagacggggagtatcggagatgcaaaatatgtgttgatacttatgagagagagaaagagaaataaatgatcggttggcttctcgatcagtaatatcgataatgaagaaattgaaaataaa

SEQ ID NO: 66623 - DNA, 827 bp, Heterodera glycines
  Genomic contig location: Contig_ID=SeqID_7994; Location=1830..2656; Strand=-
  SCN-specific regions: Sequence locations=1-18,62-687,734-827
atggtggatttggagggagataaagatgatgatgatgataatattaataataatgaggatgcgcaattggatatgatttttaatgaggggggaagtggaagcagtagaagaaaagaggtatttttaatagattttttcataagggcttaaaatgttccggcatatagagctagtaggtagagctaagcgtgagcctttgaatttccttggccagagaactgaccaccgcttgacatttatttaaaaaatgaaaaatagcctaagaaaaaacttcactaattaacttataattttgttatcatcttctgcagggttcgcaaatttttttttttaaattcaggacaaataattttaaaattcagacttttttttgtgaaaattgatacataaacaaaattttgtcgaactcttaaaggttataagtgttcgagtttcggaatttatgaccagaaattgcttatatggtaacaaagttcgaaattttataggtaaatgagaaatctgagggctattttgaatgatcccaaggttttttggctttattacagttacacgactttaaaaaaaaatacattgccacaaaatgtttgcctttttataaactttgataaattttatgcttcctaacattcttcaaaagcattttttaaatattcttagtgccattcgatagatctcagctttctctattttaatataaaaatttaaaaaatttaatttttagtttttttttctttggaagactgttcttctatttttttaaaagtgaaattagtttaattcgacgtgagttagaattgttgtgtaaaaattgtttagaaaataaa

SEQ ID NO: 66624 - DNA, 856 bp, Heterodera glycines
  Genomic contig location: Contig_ID=SeqID_37592; Location=27..882; Strand=+
  SCN-specific regions: Sequence locations=1-593,616-856
atgccttcccttaacggacttggagaattcatgaaactgttcaaaaagtctccggaacaacagcacttccagcagatgggaaggccgtgcagcagcggaacggtgaatgtgcagcagaggcacaacggatgcgaaggtgattaatagatgaaacaaagacaatgtaccaaattaaataaatatcaattgataaatatttaagtgacaattggcaccaaacgccaacggagcacttgcacaaaaagaagcattggcacggatgaggtaaaagctatttgaaagtcatttgtaaaaaaaattaatgacaatttcagcactctgattttattggtgccgaagtagtgaagaaagcggcactatcaaagccctatgaacaatttgagttgcagaaaccgagtcaaattggttagtttttaaaattcatttgtacataattatactaattaatgtctcggcattttcagttggcacaaaagtggcctcaactttggccacttcttccgtggtggtcatttctcctccgccacctcagaacatgctgaccccgcccaattcggaccagtccgtttactcaacgagcaatccaagcccaaacaacacaagcagaacgagcagtaacagcaccagctgcaacggtagtcagctaggcaatggcggaaacatttctttgagatttattaacttaatgacacctttttagttgtgcgtccactcgccgtcaatgtcgggaacagatatgcacaacaaccgcagaaccatcagcaacagtgccaggaaatgcttcgccatactgtggatgtccagcagcaacagcacattcatttggaacataatcagcacgttcagaaagtcagta

SEQ ID NO: 66625 - DNA, 99 bp, Heterodera glycines
  Genomic contig location: Contig_ID=SeqID_37598; Location=437..535; Strand=-
  SCN-specific regions: Sequence locations=1-38,60-99
atggcggaacggaaagaattccgacgcatgtttgacgagacaaagatgccaaaagcaaacccgcactttgaccaattgttgatatccttcaaatcgggg

SEQ ID NO: 66626 - DNA, 169 bp, Heterodera glycines
  Genomic contig location: Contig_ID=SeqID_37598; Location=658..826; Strand=-
  SCN-specific regions: Sequence locations=1-169
attgaagaaatcgttcaatgaattggaccgagaatcgctggccaagaatcttgcatttacagcaggtagcaaaacatactaacgaataacaaatctattaccgattgatccttttctttcatagtccgtctcgacagtgatggtgttgacaaaatacagaactcatttt

SEQ ID NO: 66627 - DNA, 222 bp, Heterodera glycines
  Genomic contig location: Contig_ID=SeqID_37601; Location=137..358; Strand=+
  SCN-specific regions: Sequence locations=1-222
atgaaatattctttgctccgaccgtttgtgaatcgaatttttacgcccggcaaagagcagcagcaattggtgcaacgaaaccaaaatgaatttggaatggtcaaaacaaacgccgggcaatcggccattttattgcgatttgtcagttggataagcggcagggaacaaattgagcagcacttcagccgattcgggaagataaaggagacgctaatgttttat

SEQ ID NO: 66628 - DNA, 1761 bp, Heterodera glycines
  Genomic contig location: Contig_ID=SeqID_7995; Location=587..2347; Strand=-
  SCN-specific regions: Sequence locations=1-534,556-562,587-923,945 -972,994-1024,1047-1212,1251-1761
atgggcggcggagacgagtggcgaccgatggaatgccaaagtaagaaaaagaattcttttcatttttttggcattttacggcaggcaccgcctgcgtttgcccgtctccgttccttcaccgactcgtccttctcttccgtcactcttccgccgatgggcgcgtacgaagcggaggaggacgacgcgttaccagcgtcggggcccaaccgaccgcttccgactcccgccgttatcggcgccatcgaagcatcgtccggcgcgacatctgttagtcggcggcgcagcagcacgacgccacggcacaccggcggaacggaggcatgtggtcaaaagccaaaataaaagcgattaatttacggcaaggaaagaatctttaccagtgataaaaatcatttataattccattccggcactgatcaaattaacactttgtctttgatttggttaatggttcagtcagatgctgatcagacggaagtcgacgacgaattgtcgcaatttgtgccgatgcaagcggcacgggcgcattggatgcagctgcacaagcagaacatgcaggtgaatgggaggggcgggggaggaggaaaagcatggcatcaaagggcaattggcatttgattggttggcgggtccaatcattcattgatccattcactggcagttgactgtgctgcaacggatgtttctccgactgctccaccggcacgccccgtttcgcgccctgtggccatttgcgcgttgctttgacacaaccaaacaaaagttggacgaactgttggcaagtgccgcgttccgacacttttgtgccgcgtatcaggcaattaaaccaatttaaaactgaatttggaatgtttgagttgttgcagacctccttcacgctgatcatggacaatgtggacgacgagccttcactttgtcaaattctgcaggaattgggcgccaatcactttttctacgatgccaacgaaacgcattttaaggttgggaaattacggtattcgggtaccataagataaaaagggtgtctttacagaaaaacattgaaaaatttgacaagaatcagtaaaaatgattttactttctgtagatgatgcgcgaagagtttttgctgtcacttgacgaatgtgtggtgggaacgaatgaacaaattaacgacgaattggagcaggactgggaccaagttagtttgacgggagggacagtctcttcgccaattatttaatttaaattttaataaataaattttttaagctttgggccaaaatggagtccaatttggccttcggtctcgccgtccaacgccacaattatttggcccattgtgtgaccggcaaagagatggacactgtccgctcgcaatggcaaaatttgttggaggcgaagtgccgaatggatgccctgggggcatcagtccgggaaggcggcattcaagtgatattcgaagatggacaaaacacgaaagactcacttttcagacattcgccgatgggctgaatcgaattggcctcggaattgagactaataacgaagttaagcggcaattcacagtggcggtgaacgatttgctatgggtgggcgttgaaaaagtaattgggaatgaaatttctacaaggcttcaggccatggcgcaagccattgaattgtgggagcctggcacgggctttctgcgcctctgtgccgagattgactcacgatgcggcggtgcttttgatgtgattcggacgagcagttcggcacttttgcgcacggcattcattgcag

SEQ ID NO: 66629 - DNA, 1406 bp, Heterodera glycines
  misc_feature (830)..(830): n is a, c, g, or t
  misc_feature (898)..(898): n is a, c, g, or t
  Genomic contig location: Contig_ID=SeqID_7995; Location=5793..7198; Strand=-
  SCN-specific regions: Sequence locations=1-345,370-383,405-930,957 -987,1009-1051,1142-1233,1256-1406
  Gene Ontology: Biological process=growth
agatcatttgtaattgttccattttgaggagggcaaggaattggtggacaaattttacttcaccaccgccttcaaaatcccggattggaatgtgcgcacttcgctgctgctcatttggcgcaatatcaccgctcgatactccgactttcaggtgccaaatcgggcacttttattgcttaaattacatcgattcttgaggcccttgtgtttgatgagaacaatttcttcagcgaccaaatgctcgagttgaaaaacacgacggttggaattagaaaattaattttagaaattcggtggatttttaagtaatcgaatgcctatttaatttattctctctcgattagattaattttattttttatgaatctaatgtctttctcagttgtcctccctgggcaccgccattctcgccatgattttcatttgcgttttgttcatcgccgactcttccatcgtcttttgggtgtcctttatgctggtcagtgagtgtgtggaaaattggctaattactgtcggctaacattggctccctcactatcatcattttgtcaggtgtccatggacatcggcgtctgcggctatttgtccctatggggctccgatttggatccgacaacggtggtcaacattctgatgagcatcggactttgcatcgattttgccacccacgtgggctatcggacgtaccggtccaggtgctcatcacttatctctcggaattaacaattaatcgccttcctcctaattgccattgccctcccttagatgtcgagaccctgaccagcgcatttccgattctctgggcgcaattgggtggcccgtcgttcagngcgggagtgtccacctttctcggcatcattgtgatgcttttggtcccgtcccatgttgtgcgcatgtntgcccaggtggagtttgagtcctaggggttggaatttttatatatttaaatattttttctgcatctttattttgatgagaatgcaagaaaaaataatttttagccaaaatatttcgttttattgtcgcattcataaacataaaaaaatcgatcataataaaaaattacaaaaatatttttacttttatcaatgttttcttaaatattttggcatttttcttaaattatttcttttaatattttgtgattataatatgattccaaaccctattgatcagaattttgaatcagactgacaaaataaaaacaaaaaacattgaatttgttaattcctcttttaaaattttatttttttatcaatgagaaatccaaaaacaatctgatcaaatcgttcagaacgatggtgttggtggtggccaccgggctgttccacggtctgttccttctgcccattatcatccgatcgtttgcgtacggtgtcggcgacccggtccaccaatgcgattcg

SEQ ID NO: 66630 - DNA, 604 bp, Heterodera glycines
  Genomic contig location: Contig_ID=SeqID_7995; Location=4678..5281; Strand=+
  SCN-specific regions: Sequence locations=1-239,262-407,472-604
atgcacagtattactacaacagctattactatcccagctataattacggctatggtggctactattatcccaacaactacggttatggcagcaattacaatggctatgggaataattactatgggtacggtggctatggcaactactacggtaactacaacagaggctactccggctactcaggctatggtagagcgataaattaacgatttggatttaatttaatcacctattgggtgtttttatttttaataaagccaaaaagaatgggtctgtccacaatatttcccgttttacaggaagttccggtacttacatgcccggcatttattgctcccatgccaaagtgtgcggacggagatgagagaagaaaagcgggaaagagagaagccgaaagtgaagaagacaaataaaaataatcgatatttaattaaatatttgatatatatatatattttttaattaaattttgtcatttcatcacgattcattggttttaattgtaaatgaatttaaatatacgaaaaacagagaatttagctaaagaaaacttcagaaaaattaagaaaaaaaatgaaagaaaaataatgtgcaaataagaaaa

SEQ ID NO: 66631 - DNA, 735 bp, Heterodera glycines
  Genomic contig location: Contig_ID=SeqID_37604; Location=63..797; Strand=+
  SCN-specific regions: Sequence locations=1-653,677-735
actcaacccatcaacatttcaatctctgagactcaattctcaggctttccaatcgctggaactcaacccaccagcatttcaatctctgagactcaattctcaggctttccaatcgctggaactcaacccaccagcatttcaatctctaagactcaattatcagactttccaatcgctggaactcagcccaccaacatttcaatcactgggactcaacccaccaacatttcaatcactgggactcaacccaccaacatttcaatctatgagatcaattctcaggctttccaatcgctggaactcaacccaccagcatttcaatctctgggactcaaatctccggcattccaaacaatggactcaaatctccggcattctaaacactgggactcaacccaccaactttcaatgacattccaatcgctggaactcaacccaccagcatttcaatctctaagactcaattatcagactttccaatcgctggaactcaacccaccagcatttcaatctctgggactcaaatctccggcattccaaacaatggactcaaatctccggcattctaaacactgggactcaacccaccaactttcaatgacattccaatcactgggactcaacccaccagtatttcaatcgccaggactcaatccaccagcattccaatcactgggactcaacccaccagcatttcaatctctgggactcaatccaccacatttcaatctctga

SEQ ID NO: 66632 - DNA, 366 bp, Heterodera glycines
  misc_feature (256)..(256): n is a, c, g, or t
  misc_feature (344)..(344): n is a, c, g, or t
  Genomic contig location: Contig_ID=SeqID_37608; Location=417..782; Strand=-
  SCN-specific regions: Sequence locations=1-97,119-129,153-301,323-366
aaaaagccaaagggggcagcggacgaccaagccgaaccaaagaagaagccggaaggagtcgatgagaagccgaagtcggagaagaagccgaaggaagaggaaaaccaggcggacgagcccaaaaaggcaccagagctaaagacagcggaaaactcggaaaagccaccggtggcacaggaaaaggcaccgccaaatggcacagccgaagatgatgtacaagttggcaagcaaggggaggaacacaaaaagcaagagncaatgcaacaggcagctgaccaacagcccaatcagacgaagcggcgcccgcgcgtgggaaccgacgccgacgggaggcaaaagtcagncaagaaagatttaatattttaa

SEQ ID NO: 66633 - DNA, 1223 bp, Heterodera glycines
  Genomic contig location: Contig_ID=SeqID_7997; Location=949..2171; Strand=+
  SCN-specific regions: Sequence locations=1-205,227-590,618-1223
  Gene Ontology: Mol. function=heterogeneous nuclear ribonucleoprotein; Cellular component=nucleus; Biological process=RNA processing
tgctaccacctctcaacatcgaaaattgttcataggcgggctcagccatgagacgacggatgaacaggtgcaaaaacaaaatgaatgacggaaatgggctgagacagacggacaggtggttgggtgccattggcaccgcccgcaaaaacttacggggcgcgggtcccaggcgtttgttgtgtctctatgccaatgaatgtgccaatggcacacagtccatccatttcattaactattcggccaatcaaaatggattggtaaattgtatggttagggacccgtacttgaaaaaggagaggaatttgtagacctaaattttgtaaaaaaaataatttgttttttttactccatttcagttacgtgattactactccaaatggggcaaagtcattgactgcattgtgatcaggtagctgaaaaatgattggactggtctaatgagacacagctatcgaatatttcggatttttttaatttgttaaaaaaatgtgttgggtaccctttcgaaccggaaaactaactaaaaatctcaagggaacatttttgaaagtcacttcccaagattacttccagggaccctgtgacgaggcaatccagaggctttggctttgtaacatatgcaacaattggttagttttttaattgtattttgttgattttcaacgattttttggacacgaggcatggcacaatacaaaaacagaattttacttttcgaaagggcctaattgtaaaaaattttttcgttggttggtcgtcataaattccattgcttttccagagatggccgactccgcgatggcagaccgtccccacacaatagctggcaaggtttagatctgattttgatcagatcgaccgggaaataggatgggaaataaaaaattattttggtgcctctgcgaaggggggagggggtaaaaaaagatttgtttttttttgaaaatatatctctgttaaacccaccggtgggattaagtgcatgcgccaatttatataattttatgtatttttacatgagatgggtaattaaaaaccgaatataaatttataaaagacaccgaaccgagccccctccctatttgcaatttttttaatcccccatttttaggtggttgatccaaagcgtgcaattccgcgcgagcaaatgctgcaggcgaccagctgtccacccgcctttctcgacgttgagcccccctccgactgcaaattgtttctttcgg

SEQ ID NO: 66634 - DNA, 580 bp, Heterodera glycines
  Genomic contig location: Contig_ID=SeqID_7998; Location=140..719; Strand=+
  SCN-specific regions: Sequence locations=1-509,533-580
atgatcaacgggcgcaaggtcgacattgcgcgggtgagttgttcggaaggggttttggcgggggtcaccagggcaaaattcggacaaaaaaacggaaaatcggggagaggacggctggcgtacgactcacagggcgatatggtatcaggatttgtgtctgtctagggtaatggcacaaagccctggttaccattagagattgacattctgaagaaagcatgtatctggattcgatgttggacctggacctagatctcctggacaacaatccagttccaggaacaaacccagacctgggcgtccattctgttcttccctcccctccgacgggaagggggggggggattttttgctccttaaaacttgcgttgcttttttgcaaaaaaaaaattggccctcaatttttcatgccaagaaataaatccccctatttcagcagcagggtacagcagcacagcatcatcgtcatgtcaagccaaagtcaccaccattgaaatgttgaaccgccgtcttctccctcccccctccccaattcaatttaaatggttaaaactacatacatacatatatatacatataa

SEQ ID NO: 66635 - DNA, 1454 bp, Heterodera glycines
  Genomic contig location: Contig_ID=SeqID_7998; Location=1323..2776; Strand=+
  SCN-specific regions: Sequence locations=1-195,226-1063,1085 -1134,1156-1454
caacaagtgcacaccgaggacatttcagtcccatggggccaggcgccggacccgcttgaccaacagttcggcaagtggcgtctgtccgtgttccaggatgtgcaagagtcgtgggatgccagcaaactgtactttctgtacgacccggtggctgacgagtcgtgccaaacaacgtcagtcatccatcagccgctgtggcaaaatatattttggaaacagacaaaaagccgaatcggtgaaaaacggacataacgccgcattttcccatataacctctgacaaacaaaagtcggtattttgtccattttagtcgtgtcggggtgttttgtccgtttgatgctttatccatgcaccgtaaccattttttaaatttaattctttagtggcggcagaaaagcgatgacctgccttgccgtttttgacactaatcggaaatgctttgtcggtgaaatcccactccgagttcaaggtgaggagggtatttcaggaattttagacgacacaaacaaattgcggcaaacggaatttgaggcctcaaaatgggaaattgttatgacctttaaaatcgcgaaaattcggattccgagtgccgagagatttttaaaatgaatttggaaatctgcggaattccatttcatccacggaaatttcaaccaaaaaaaagacaaccgaacatttttgggtactttttcactttacgccacataaaatttttttttcgttattttttgtttttcttgtgttttcggagtcactgatcacgaatatgacattcatttcgaacaattacgaaacccggacccgaattcgaacaaaaagtcgaaaatcaaaattttcaaaattctcacttctgttctaaaaccgatgaaaacaagataaatttagtcgcagaccattaacgggtgtcattttagggatcagcatccctgaaaaccccctggagctttaattttaagccttaaagcaaaatcgacaaattattatttttttggctatttgatgcgcttgttttgaacattggacaatgtgtacctaaatgggaattgagcccaaaattagcgcacgacagggggaggaggaggaccatgtgaaggtgtgaatttgtttcggttttttgccattttccattctctcccccactctttttgtttcccataggttgcggtccgttgtcgtcccttaagccaacaggaacaccagcaaggacaccgggccattgtgcagacggatgagcacggaaaatgtgtcgctgtggcccacccggacaaccaaaatgttagaaaaaagtgcattttgtaagaaaaaattaaaaaaattccaaatctgacagcaaccccagaagtgctatttgttcgacgaactgttcggccccaacgcgactcaagcgaccgtttacaattcgttgtgccctgggagggtggaaaatgtgcttaggggttacaatggtatgttga

SEQ ID NO: 66636 - DNA, 444 bp, Heterodera glycines
  Genomic contig location: Contig_ID=SeqID_37613; Location=808..1251; Strand=+
  SCN-specific regions: Sequence locations=1-113,144-444
atgttgcgccccaacaccgcagtgccagggatcacacatcagctccgtaagaagccttcactttcattgcgcctttgggttttgaacacccaaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctag

SEQ ID NO: 66637 - DNA, 345 bp, Heterodera glycines
  Genomic contig location: Contig_ID=SeqID_37613; Location=1367..1711; Strand=-
  SCN-specific regions: Sequence locations=1-2,60-272,294-316
acacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaa

SEQ ID NO: 66638 - DNA, 540 bp, Heterodera glycines
  Genomic contig location: Contig_ID=SeqID_37615; Location=178..717; Strand=-
  SCN-specific regions: Sequence locations=1-267,293-540
atggccgcacttatccaacgccgcccaaatgccccctcagtggccagcgatcgagtgaacaacccggttagggaatggatggccaggaaccaagggggagagaacgaacccccgacgcaacagcagccacaagctcagcaaccgatgcaagccgaacagcaacgatttgagcgactcacgctcaatgaccagggacaagcattccctcgggcatcctatcatgtccgtactcggagggaggagcatcccactcgggaacgcctccgaactcagggagcagctccctcacatcaccatcgttcggaaactcgagcagaaacattgacgactttcgaaacggttcgattgcagccaccgacgttttccgggaaaccggaggattggaccaccttttgggcctacttccagcgggcggtggacgacaaaccaatcccgggattcgaaaagcagcttcatctgctgcggtgcctaaaagaaggatcgccggcgcggagagcggtggaggtgtacccaccatcggatggcaattacccggttgag

SEQ ID NO: 66639 - DNA, 136 bp, Heterodera glycines
  Genomic contig location: Contig_ID=SeqID_37619; Location=104..239; Strand=-
  SCN-specific regions: Sequence locations=1-136
atgcttcgtcgagtggatattaatgtcgccaataacactcccatcgcccacggggtgggcaaaggtcgaacgcctaaaatattcggaggaacggccgggcaattgaaggatttgggaaggaagccaaaggaagacg

SEQ ID NO: 66640 - DNA, 492 bp, Heterodera glycines
  Genomic contig location: Contig_ID=SeqID_37619; Location=411..902; Strand=-
  SCN-specific regions: Sequence locations=1-276,300-403,425-492
cggaagtgtcgcgctattcgacacactttcgctctctcctctgtctgttcttcgccaaactcattgctcttttgtcaccgccctttcatttttgcctcaacggtcgtgcgacgtcaaagatttaggccatatcggtgaaactatttcgcacaatttgccttcaaagcgctgttttttgccggggatttgcgccgattttcgttgtgcccttgtctctgtgagcgttgaccgaacaattcaggtgtttaaccacaaaaaaatactaaaacaaattgtggcacttttcaggttcaccaatttcccttccccactcaaagttctttctccgccttccttttccgtctgtcaattctgacttctgttctctacgttcttttgtggactctttttgcataaataaccattggcattgatttgttgtgatctttgaatgtctctaaattttaaattgtgaatctgtgatacatacgaaataataaagttttttgttaa

SEQ ID NO: 66641 - DNA, 438 bp, Heterodera glycines
  Genomic contig location: Contig_ID=SeqID_37620; Location=540..977; Strand=-
  SCN-specific regions: Sequence locations=1-438
aaaatggtctaagtaaaaatcgtaattacgctcaaaaagcttctcaaacaatttgagcgcttccaattccttctacaatcgcctttatacatcccattatgagcgctaaaattatcagattgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtcaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 66642 - DNA, 4680 bp, Heterodera glycines
  misc_feature (4660)..(4660): n is a, c, g, or t
  Genomic contig location: Contig_ID=SeqID_1035; Location=30..4709; Strand=-
  SCN-specific regions: Sequence locations=1-194,217-595,617-795,817 -1201,1223-1564,1586-2104,2126-3313,3335-3709,3731-3911,3933-4680
atggtcgtgaaaacctcgacgtttggagtggaaacggactcaatgcttgatggtggtgcccaaatatcactgataagtgccaattttctttaccaattggtaaaagagaaaaatttggatttcgactcccttgaaccgtcgcaaacaaacgtgcgagttctcgatgtcaacggcaaaatggtgccatgtttgttaaaagtgaatttgccaattcatcgtcgtggtctcaaatcagaagttaaaatcgcggtgcatgtgacaaaagctccgatcggttttgacatgctgatcggcacaaatggacttggaaaattgggctttaagctttatgacgaggcaaatgattcgatggttgaatttgagaattcagaactgaactccaaaaatcttcttactgtaatttacggtacaaccatcgagccacggtcaacgaagattttggaaatgggagtcaatgaaaactatgaagctagtgagcttctgatttcatcggataattcaaatgatctgcacgtcgagccgacagttgctattgccaatgagggcaaaatcattgtccctgtaacgaatcggtcgcattccaaaattgcgcttgaaaaagggcaaaaagtcggagaagttgagccgatttttgaactgggagaaagtgatgatatgttgataagcccggtcatcgtatccatgctatctgagccaaacggggaaacccttgaaaaacaacaattgttgtgggaaacggtacagaaaaatgttggaattttgaacgaggaacagagtgaagaattaagagaattgtgtgaaggttttggagaaatttttgctgcaagggacgaagatttgacccaaacaaatctggtccagcacaaaatcgaaacgggtgacgcaccgccgatcaaaatcaaaatgaggaatgtgccatatgcataccgcgagaaaattgcggcaatgcttcaagactatctgggaagaggagtcatccaatcgtccatttctccatgggccagtcccatcgtattagtgccaaaacgtgatggtacattacgtttttgtgtcaattagcgagctgtgaactcggttacgcgtaaagatagcttccccttaccaaacattgacaacatactgttaatgctaggaggaaaaaagtttttcagtactctcgattttatgtcagggtattggcagattaaaatggaagacaattcggtggaaaaaacggcgtttacaactgagtacggtctttacgagttcaaagttatgccattcgggctaacaaacgcagtcgcgactttccaaagattcatgactcgtcttttcgacggcatgatcaacgattttgtcttcatttacatcgatgacattttgatcgcttcagaatcgtttgaagaacataccaaacacttgcacgaagtttttgaaaggatcaaagcggccggtctaaaattgaaaatgtcaaaatgtaaaatgtgtgccgaagaattgccttttttgggccacatcttaacgagaagcggaataaaaatggatgcagacaaagtgaagcccgtcgttgatttgccaattcctaaaaataaaaaggaacttcattcactgcttggatttctgacatactaccggaaattcattcactcgttcggtacgatcgccgctcctctgtttaagttgttgagcgaaaaagttgagttcaaaatttgtgacgacgaaattaaaatcattaattatctgaaaggaaaaatcgttgaggacgtcttgctgtactttcccgatttcgaagcagctcaaaatgatcaaagtcggcgttttatcataatgactgacgccagcaaaatgggaatttctgcaatattaagtcagcctgatgccgagaaaaggatcagaccgatttattttgcttcgagacagtgcaatgttcatgagtctcgatattctgccaccgaacttgaggcacttgctgtccgtttcggtgtgaagaaattcgcgcagttcgtcacaatgattccaactcgcgtaattaccgaccacaaagcgctaatttggatgtttcggagcaaaaacgaaacgggaaatgcgcgaattgaccgctggctattagaattgaattcaagattcattcttaaagttgaatatcagcccggaaaaaagaacataattgctgatgttttgtcacgatcgggaactggcaacgaaattgaagaaagcgaacaaaattccgaagaaatcgcattcatcggtaaaattcgaacaacagaaaatgatttggagaattttggtttgatggaagaaagacaagaatgggtcgaacagaccaaaattggcgaaatgaagccaatttacgagtttcttgaacgtaaagttttgccaaatgaccaaagagatcagcaaagagtcattgataaatgccataaatttgtcgtcttcaaagaccttttgtacctttccgagaaggaaggcaaaatgagactttttgtcccacaaaaattcagaaatgagttggtgaaaaatcgccatgaaggaatttgtgcaggacatatgagtggcaaaaaattgtttaagcaactttcggaagagtatttttggccaaatatgctcactgattgcattcgggcacacgaaagttgccgaatttgcgctcacacacgcatttcacgggctaatgaaccgccgttgaacgtcgtcaaatcgttagaaccattagaattggtctgcatggacatcttagatgtcggcccaagccaatcgaacaaaaaatatatttgtgtgatcgttgatcatttcacaaaatatttggtcgcagaaccaattccggataagtcggcagaatcagtggcaaaagtttttgtcgaaaaattcattttggtttatggcaccccacaaaagatccattcggacagaggaaaggaatttttgaatgcgacaatggaagaaatttcaaaagttttggacataaaaaggtccttcacagcggggtatgaccctcaggccaatggattggccgaaagaataaacagaattatcatcggaattctgaaaaagtcgaccgcgagcaattggacttgggatgagagattggcgtatggcgttttcgcctacaacattacaccgtcaaatgttacggggtactcaccctttctgttaatgtttggccggaatgcaaaatttccgctcgataaacacgtaccatttcgggttaatcctgtttacacgatagattccggaaaatacattcaattattccgagaaaatctgctaaacatgttggaagaagcccagaaaaattcggaagaagcgagggaacagtcgaaaatttggtatgattcccgaccaaaagtcacggccaacaagttccaaaaaggagagaaagttatggtcgtctttcctggtcaaaatcgtcgttcgcctcacaaaaagttactttggtcacattttggaccatatttgatcacagaaattggtgattcatcggcaaatttggtaccaatagacaaaaaggagatcaccccaataaaagtgccgattgaacgattggttaaagtcccaaaaggcgtcccagacatttcgacactgcctaaagggaaaaatccgtttaaaaacgacctaaaattgttgtcgatgtacgcaggaattcgttcagaaatttgcgaaatgactggaaataagtgccgcgaaattgggggaaaaagcgaatcgcaattggggacaattgcttcagattgtttggggggaaattggaaaagcgactccttttcagagccaatggatgtcggaagtgtcagtgccggatttggatggacttcggagtgcagtggaggcggctcggggcacgagctgtgcgagaaaatcacgctgggaagtatcgacccggtcctgaacatgtcgaatctgggatcggcggtagtcaaaacaccgcttcaagcccttctcagcatctttctgctccgatcgggcgtggcttcatcgctcacggcagcccaaactttggtccagacaattgttggagcagaaccgaagctggagttgtgtatgtacacagggaaaaggggggaccaaatcagcaccggcaaatacccaacggaggaggaccaacggcaggctttggagaagtgggtcggatcgtgctttgtggctcgacaggctttaaccgagtcgggatataagcccttgtcgatgcaaatgccagagggagtcaattcgctgcccgattctgagaaaaacaaatggcacgaggtcttcaaagacagttcatgggcactcgaacgtgtgcgggccacgattgtgcataaagcgagccgctttttggcacatgaccgtgttctgctcggagactcatcggccgaaatgctcgccaaacacatcaacagctcctactgcatcggaggagagagttccatggccgacttaatccgccaatttcagccgatcgttttgtcaagccgtgtcaaggcactgctcattttggctggacgtgattctctgatgcagggcgaaaccgaaaaatcgatcgcggcccaattcgaaatgatcgtcagcctgtgccagcgcttcccgcacgtgcagatattttggtgccctccaccgtatgtgcacgccaaggcaacggaatgcgaggagctgatcacgaaaatgcacgccatcatctccaaatcgccgatcactccaattttcncccccgagaaaggccgatca

SEQ ID NO: 66643 - DNA, 1726 bp, Heterodera glycines
  Genomic contig location: Contig_ID=SeqID_1036; Location=252..1977; Strand=-
  SCN-specific regions: Sequence locations=1-81,107-145,168-193,215 -627,662-1726
atgataattcgctctccgccattgacacgacaaagagcgttgaatttgcgaacctttgcgcaaaaccaaaacgcagcggttgaagagcagcagcaacaacaacaggttgaaggagttcatggtgaaaatgaaccattggttaacgctccgatctcgccaggacttaaccgaaatttgagtttgtcggcggaggaaaacgaacaccattttagtgaaatggaagcagcagcagcaaattgaaattcggcggcgccttctgcatgtgtccatccaatcgaatttgccgccgcgagcaaacggtggtggtaacaatggtgccgaacagcagcaaattcgcaatgcaaatgttggtcacgaggactttgttgaaggtttgcgtgaagttttgagaccaaattttggaaacttattggtgcgggaagaaggagtaaggatgagattcgttgagaatggcaccgaaaataggcatttcgagcgaattaacagaaatttggttcgggaaacggcgccaaattcacgtcatgtttcgcaaagcgaactcattgggtgtacatcgacgccaataaattttaatggcgaattgcacaactttccaattgtaagcaaccaaatccggcaccgagaaatttatgaggattttggcccctaccgggagcacgaaaattttcgctcaagccaaattcaaattcgccaacaacctgcgttagcgcggcaacaacaaaacgcaaacttcggctttttgccatgcgaacggcaacacaacgaattcgtcggacgacatctttttgaggatggacgtcaaaagatgcacccaacggagattccgaggcaaatgcatcaacagccaccaagagaagagcgtggatggcagcaacaaaacagtgttttgtaccgtccagtggcgcgacagcagcaaaattttacggtttacgaaaaccaaatgctgccaccccaaagccaaaatttagcggttttaagtagtctggagtacaatatggtccttgaaaggatcccagacctcaacggaaaggaagggacggacgaagttaagcgttttttcaaaaaattcgacgcttacaccgacagttggccggatgaaaaaagaattaagggactagaaagcaaagtgtatggccgagctgaaagagcttttgaagcggcgaaagcagtcattccgataaagtatgaactgcttcggggtgaaatgatgcgacagttggaggaaacggactcaaaaaacttgaatgcttttgatgagctgatgttaggggtccgacgaaaacccaacgaatcgattgatgatttggcaggtcgaatttcggggttggtgaagagagcctaccctggtctttctttccaattgtcagacgaattctccatcaaatatttgatccgatcaattggtgacccaactttgtcacttaatttggaactcattcgaacgcctcgaatgtctttggaccatttcgtctcgctagcagcgcgtgcggaatcgacacagcgcgcaacgcaacgttttgtgtctgcggaaaagtcaaagattgatcggaatgaaactcagtttcgagaaccccgccgtaattttagtcgggaatatcaacggcagcacgaattccaaccaatttttcgtgattggcagcccgaatttcaaccgaataatggaccgatcagacaaaacaacccaagttttgagccaaaactgtggaaatgctacaattgtaatgaa

SEQ ID NO: 66644 - DNA, 497 bp, Heterodera glycines
  Genomic contig location: Contig_ID=SeqID_37622; Location=904..1400; Strand=+
  SCN-specific regions: Sequence locations=1-144,168-203,225-227,256 -305,327-497
atgtattttaatttgcttttgttttgtgcttttttcgtttctttggcgagaacagcagcacagaccgtccaacaacatgaacatgttcatttgtggaaaatcactcactccgaaatgaaaaagccgagttatttgcttggtcagtttatttaataaaatattaaaatgtgtgttccccttcccttcccttaccgtagacaaaccaatgcaaaaaagcaaaagcaaactaaataaaaattttttaaatttttaaaacatttccctgatcaactagctgaataggctcacaattaccaattagcaggttccatattttgacatatgtttgcattctggactttcgggtttattccaatttattttctttacatatctaaaataatactctaattaagcttatttaggtacgacgcatgtcccatggaagatactgtataacaaatgtaagttcttcaattactgtgccgttttacaaaaatgacgaatttttattccaa

SEQ ID NO: 66645 - DNA, 360 bp, Heterodera glycines
  Genomic contig location: Contig_ID=SeqID_37623; Location=5..364; Strand=-
  SCN-specific regions: Sequence locations=1-360
atgaaccgacggtaaaaggcttttaaaagtcacaaattcgtcatttatttgactaaactgttttcccatttcagttggatttgcaacgacgtttggatggacattttccccagttttgaccatgctcaacttggcctcaaattggcacttatttcgccacgtttcaatgcgttggtggacaaacatttcaatggcaaaagcgaattgacaatttggagaccaatcgaaattagcaagggcattggaacaaaaccgaagctatctgtgattaccatcaattatggcacttctgcgtattttccgttgcccgatcgtccgctgcccaaaaaaattcgctttaagcaccttcagattaagtaa

SEQ ID NO: 66646 - DNA, 75 bp, Heterodera glycines
  Genomic contig location: Contig_ID=SeqID_37625; Location=373..447; Strand=+
  SCN-specific regions: Sequence locations=1-75
agcaactgctaaccgatttgatgagtctctcggcgaaagtggacaatctatcggcgaaagtggacaatctctcgg

SEQ ID NO: 66647 - DNA, 1791 bp, Heterodera glycines
  Genomic contig location: Contig_ID=SeqID_8001; Location=1102..2892; Strand=-
  SCN-specific regions: Sequence locations=1-422,446-550,572-708,730 -747,770-967,990-1011,1048-1321,1383-1567,1590-1791
  Gene Ontology: Cellular component=Golgi stack; Biological process =Golgi organization and biogenesis
aaacaaacgcatcaacagttcgccatttcgccgtggacgcctcgtcaccattagctgatgccattcccccacctggtgaacaacaacgccaacagccatacgacaacggcgaaaatgggacgcaaattgagaggacgacggcacttggccatcagcaacagggggaggaggcgaaggagggcaccaccaccaacaatttggccacacaaatggaagcgctgtgccgtgaaaatgcgctgtaccggcgcaccaatgagcggttggagtactggctgaccgcgttggagtccgagaatgaaagcatcggcgaatacatcgctttgtaccgcttccagcgaacccaaattcagcagcgcattgccgagaaggatgccgcactgctgcagctccagcagcagaacacacagcttacggtttgtctcaaaattttgtgaaattttcaaaagcaaattttgacgtttttggagcagtcccccctccgcaaattagaaaaaataggaaaattcaaaaaaataaaatttttatgcgcttttttcaaaattttatgatcatacagaagggggccggtgtaaaagaggtggcgggagggggtccgcagcgagggggggtcgcaaatttatattttctaattttttttgaggtaaatatttttatatcttggtttcattttcttcacagcatttcctctgaactgcttgaacaaattggaaattgttaaacaaattttttgagaaattaattgtgactcccatttttgccaccattttttaggccattttgaccgagttgcgcaacgcaatgttggccattatgcaaaaaagtgatgccaacgcggcaacattgccaacagcgacggcaaaactgtccgtggacaactgctgtaagaccctttattgcgatgcacccaaaaactccgccaaggaaaaaaatatcaaaacggaaattttcaagaagtaatcataggaaattttttcttgaatacattttcaatgaattttgaaaaatcgctggaatattttttgaaattttttaaaaaaaatttttaaacagagtttcgtcggcggagttttgtcctgttccgccttcattgacccgttttattcgaaactgaacactttgcaattcagcagccatcacagagggaaatgatgagcactcggattgtgcaaatccaacggaccaacaaaaacaacaaatccatccgcctccgatggaccaattgtcggccgatcgcttaatgcgcattttggaacggagcgaggtattttgcgacttagggtcaattttttaagaaagattagtgagttttacttactgccggaaaaaaatattacaaaaattactcaattttcaatttttttaaatttttatatgaattaattgaccaatgcaccgttatttttggtgcacttggcgagagatatcagtttttgattctttgaatttgcgcgtctttgcattggttttggtgatcagtgattgcattttccatctttgaatttaggtgatcagcagacaagcaaatttaaggagaaattactgactttgtttcaaaattttttacatttattcccggctgtgttttggggtgtaccgtaattttcggtgctcttgccgaaagatacagtttttgatttttttttatatttgtctttgcattggtttggtgagcatattttccatctttgaatttaggcgatcagcagacaagccacttgcatggcggcgaaccaagcacagattcactgcacgggatgtgtggaatgccaaggcgaactgttcaacatttga

SEQ ID NO: 66648 - DNA, 2343 bp, Heterodera glycines
  Genomic contig location: Contig_ID=SeqID_8002; Location=65..2407; Strand=-
  SCN-specific regions: Sequence locations=1-379,403-441,463-571,594 -817,843-852,939-2162,2184-2343
  Gene Ontology: Cellular component=Golgi stack; Biological process =Golgi organization and biogenesis
atgaaggcgcagttggagcagtccattgaacagcaacgaagcgaactgacaatgcgagacatttacatcaaacaattgaccagacaaacggccaacaacacaacggaattcgaaaagtgtgccgatgccattggccagcaaaatgttgcccatcaacagagttccggtggtggtgaaagctcacaaaatcaacaaggcatgtgccagggttgccgccagatagaaaaaaataatcggattttggctttttggtcattgggtttcagcttatccaaggaggatcagctcgtccccccacccggatcagttcccccgtatcgttacactccgaaaaaatattcaaaaaatcttagaaataaatcgctaaaagcatttcaacattttttaaataattttttttaaggggggcataatgacacaaaaaaaattccagtaattttcatttaaacttttcaagaattccatttgaaaattttaagaaatccaacaaaagcgtgatgacgatttgaaatggcacaggaataaggtgctcgagttgcaaaaacagctgcagttggtccaggaacagcaacaaattgaaaattcactggcaaatgccaacgcgaaaagacttgtcgaacaggtacaaaatgtgaacataaatgggctcagctcgtttcccaacctaaagttttttttttaattctcaaacatagaaatttttcaagaaatctgaaaaaattaaaaaaaaattcttgaaacaaaacgaatttttgtttttttttgtcaaaaatatacattataattattaagtgtattcaaaaatttcacaaaaatcgctgtaaattttacaggaaataaacgtagggcaccaaaaataaatattcaaatttattcttaaatttaaaaatatttgtcaggtcaatttattattaatttcaaatatttatattaaaaatcgagtgatttagttggacagtgtgaaggcacagaatgcccaattggagtcgttcaacaatgtgttggaggaacgccttcgcattttgcaacaaaaacttcttttgaatgacaattcaccgccaccgtccaacaacaacaacagaaatgaaaatgccaatttgacaaattctgcggatggacaacaaaatttgctaccggaaactgagcatttgagcgaaatgaacggacttatgaaaagcgtaaaggaattaacgggggaaaatgaaaaattggcgagcaaattgtgcgaaagtgaacagctggtgcaagaaaaggtgagaatttctggcaattttttgacaaaatatgggccaaacattttgggaaggggtgattcaaatttttattcgtttttttttttgaaatggaatttacaatttttaaacgctttttgcccggggttgaaatcctcgaattctgaatgataaattgtagttgtagcagttcggcatttaaactgagtgtttttgttttcttaaagtttttctggcacaggaacacagtcttgaccagctgcaacagtcgttggccgaagctcagtctcgaattgcccaacttgaacagttgcagaacatccaatcaacaataaacgaagtaaggggggggcgggaaattgtaaatttggtaaatattcgcggaatatgacaaaatatcgccgtaaaatgtcgcctagacttaaattggtcgcaaaaaaacaacaaaattcacatgctgcctaatcttaaaatgaattttctataaaaattctgcgaatattttaatgaattccttttttccagtgcgttaggtcttccattagcgtcttttggtcccggcaacatttagcccgtgtcccgacatttgcgcctttgtccaaaattgggttcaaaatcagtcttttcaatccctgatcgcatagacagcattaaataagtgatagagatttgtctgaaaattggaaagaatcattaattagagctatcatagcttgaaaaaattcacatttgaatccgattttggacataggatgtaaatgccgggaccccaaaaaaccatggctctatttatccggccattttttgtggtgcaccaaaataatcattaaaaatttcttaattgaatacctattatattttaaactaatgtcgtcaataggacgtttctctgcttgctgcgcaactgcaaaatgagaaggccaccgtttcgcgggcagtcgcgcagaatgtcgagctgaagagccaactgaaggagttgcaggaccgactgattgcagtgatcaacgagagcgccgccaaggaggacgaacggacgaccgcaatggccacggttgaacgcctaaccaagcaattattgaatgccaacaacaacgaggaggaggacgaattg

SEQ ID NO: 66649 - DNA, 731 bp, Heterodera glycines
  Genomic contig location: Contig_ID=SeqID_37633; Location=259..989; Strand=+
  SCN-specific regions: Sequence locations=1-21,43-267,290-357,381-731
agcaaaaatgcagcaaattcccattctttccctctccaatttcctccccattttctcacttatttcggtgccctttttattgtcctttccttccacggccttcggttgctcttgtgcacccaccaaattcaatgagtcaatgtgtgtggccaaatggggtaaaacaaagccgagggataaacaaataaatgaatcaatggacgggtgggaaattggaggaaaattcgacttaatttatggaaatcgatcagcagaatgatcggtttgattgtaaatttctgtttttgttggtcaatttgtccggattaactcacttttttttgttttcattttgttaagtgtcccatgtgaaggtgttgcaaaacacaacaacaacaaactcccaccgcattttcactgtccgacatttggaagtgttcaaagtttgtcctaattaaccaatttggccattaaatagtccattttgacgaaatgcccccccccccatagagtcccaacggcaccgctcacaatgaccaactgattgggaaggaaagtgccgtttggactcccatttttacggcggcgtgcggagtgagagaattggacactgaaaaggaatatcttttggctggtgggctttggctccgttcatggcgaataattttcacgttcatcgccttaggcactgtggacaatttgggaacaaagaagattaatctttgtctgtttattccaatcgaagacggaca

SEQ ID NO: 66650 - DNA, 124 bp, Heterodera glycines
  Genomic contig location: Contig_ID=SeqID_37635; Location=680..803; Strand=+
  SCN-specific regions: Sequence locations=1-124
gagttgaccggctacgaatacaatttgatgggcatcgactcaattccggaggaggattaactgaccaacgagtgggattttagaacattagacgatgacgaattcctcgattatccattatgct

SEQ ID NO: 66651 - DNA, 59 bp, Heterodera glycines
  Genomic contig location: Contig_ID=SeqID_37636; Location=16..74; Strand=-
  SCN-specific regions: Sequence locations=1-59
aacatttgccttctctagtctggctctaccaaacacgcacacgatatttgaaatgctaa

SEQ ID NO: 66652 - DNA, 59 bp, Heterodera glycines; identical to SEQ ID NO: 52421
  Genomic contig location: Contig_ID=SeqID_37636; Location=146..204; Strand=-
  SCN-specific regions: Sequence locations=1-59

SEQ ID NO: 66653 - DNA, 59 bp, Heterodera glycines; identical to SEQ ID NO: 52421
  Genomic contig location: Contig_ID=SeqID_37636; Location=276..334; Strand=-
  SCN-specific regions: Sequence locations=1-59

SEQ ID NO: 66654 - DNA, 59 bp, Heterodera glycines; identical to SEQ ID NO: 52422
  Genomic contig location: Contig_ID=SeqID_37636; Location=406..464; Strand=-
  SCN-specific regions: Sequence locations=1-59

SEQ ID NO: 66655 - DNA, 59 bp, Heterodera glycines; identical to SEQ ID NO: 52421
  Genomic contig location: Contig_ID=SeqID_37636; Location=536..594; Strand=-
  SCN-specific regions: Sequence locations=1-59

SEQ ID NO: 66656 - DNA, 798 bp, Heterodera glycines
  Genomic contig location: Contig_ID=SeqID_37637; Location=486..1283; Strand=-
  SCN-specific regions: Sequence locations=1-657,692-724,750-798
atgaagcagcagcaaatgatggatgagctgagctcagtgaagacgcaggtcgagaagattggccaggaacaacaacagcaaaagaaggagcagcaggaaaagcaggaggaggacgcaaagggcaaatacggtaatatcaagggaatactacggtaatataggaattcagcactaggaaatatggtaatggaggaagagggaatacggtaatgggccctatttaaaacgaccagaaatattctgaaaatgactttttaattatttaagcttccatcgaccaattcacgcagctgcaaaatgaacagaagacacttttggaaaaagtggaacaaatggtgaaagaatgggagagggaggggaagcgcaaaaggacaattaagacagggctcgggtcgggcaacttccctttccaaggatgggtataccggtttccaagtaaggggaaagttctattaaattttttgaaaattagagtgccatttttaacagattttcagcaaaaaaaggcggattttgcgattttgagataatggggatgaccattttttacttttcacaacacttcttgcgagcgctttttccgaaagactttttgggaatggggggggggggaagaaattgttaatagatttttccaaaattgataatttttaacgcttttggtgtgtcttttgaatctaatttaaaaaatataaagagagatcccggcggtgtcgatagcgccgcctggaaaaattttgggaatttttgtgcaatttaataccaggttatgtaccaataatgcaataagttaataaa

SEQ ID NO: 66657 - DNA, 258 bp, Heterodera glycines
  Genomic contig location: Contig_ID=SeqID_37638; Location=698..955; Strand=-
  SCN-specific regions: Sequence locations=1-15,38-62,98-258
tacaaaaataaaagtgattttgggattcgggaccaaaggggggtaaccaggatttttgagtgaaaaaattttttcaccaaaaatctttcaaaaacatgtcattagggctattttatgacgctgatcacgaatacgtgatcagattttacttttaacatcgataagacctcagaatccctgtgtgattggggattctgaggcatcattttgaggggggagggggcaggttcggatccggacggtgtacattaattttct

SEQ ID NO: 66658 - DNA, 697 bp, Heterodera glycines
  Genomic contig location: Contig_ID=SeqID_37639; Location=10..706; Strand=-
  SCN-specific regions: Sequence locations=1-9,31-244,266-572,594-697
tttggtgcgtttcagagcattttctgaaaaaatatttatgaaataaaaaaatcgattttttcaagtgtccgtttgggtactcaaacaattatggggagcaaaaatccaacgcagattaaagtacagactatagggaagctattcccgaaggattcggtctccccataaatctggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaac

SEQ ID NO: 66659 - DNA, 838 bp, Heterodera glycines
  Genomic contig location: Contig_ID=SeqID_37640; Location=1..838; Strand=+
  SCN-specific regions: Sequence locations=1-427,452-555,578-838
ccattttagcggaagatgggttcgactttcgcgagattaaggttggttggctctgccatatatctatctgtgataatgtgctcttttcaaggagttcacgcagcttctccattcccctcgacgagtgccgccgccgcgttacatttgccacatttgttatcagcctggccattacatcaggtggtgcagagagagagtgtatttacgaaaggctcatttaaaattaccagaaaagcgacaacccttccaaaatttaaccaaatattctttcttaagtgactgtcccgctcgcttcaacagtccctatgaggagctgacgccgtaccaaggccgcaagaagtttgtttttaggcttaaaaatatatattaagcacaagttacacaattctttcaggtgctatggcgaatttgtgagtgcttttggctctttttttaaatttttaaaataattgacaatttttaaagcaatgtgaacagtgcaaacgcaaatggacatcgcagaacagtgtggcgaatgaaggtgagggagggaggagcaaggaattctgaatgagaatttatgaataattaataattgcgtaatttcgtcgcattttagcgcaaagctgcatcaaatgccacgtgccggtctttccgcacaaacaggttgggtaaatggcacttaattgtgttcaataattaactcctcctttcttccatgttcagcttcccgtggacaaggctgtcgcattgggattggtgagaattttttgttccctttttagttgttttcaaaaacgtatgctgggtcatggttttttggaggacccggaaaaaaaatgagtggtataaattatcc

SEQ ID NO: 66660 - DNA, 417 bp, Heterodera glycines
  Genomic contig location: Contig_ID=SeqID_37641; Location=781..1197; Strand=+
  SCN-specific regions: Sequence locations=1-97,119-220,245-326,349-417
ggagacaacaagcggatttgtcggcattgtgccacagcgttttcttaacattttcttcgatgcgacagccgatgaagaaagtcactttggggaatcgtcaacaagggaaaatgaaagatccaacgatttgaccggtgtttcgttttcacacgcctctaaataaatgcccttttcattttgtcagaccaactcaaaccgtgggatgttccgattttccaatcttcgaatgtccccagcatccaaaaacaaggatcattttcctgtcgctcttctctttccggttacgattccgctcaatgggtcgactcgacagacgccgccatttcccatcggccaccgcctcgtccacctccgccaaaattatgccaaacaacatcggaagtgacgtcacccagacgacactttcatcagtcccac

SEQ ID NO: 66661 - DNA, 896 bp, Heterodera glycines
  Genomic contig location: Contig_ID=SeqID_8004; Location=1403..2298; Strand=-
  SCN-specific regions: Sequence locations=1-534,556-667,692-873
atgggggttcctgtgccgactcgtccccccctccctcgtcgtcccccttttcgtcctctcccatttcgttccgtcatcgccaagttcctccgtttctttgtctctgtcccaacggatggactggccaaatatgtgaccaacctttggagaattgtcgcgtcaattcgtgccaaaatggtctgtctttgttcatcgaatgtttaattcttaaatccctcaggtgcttcttgccttgtcgacccgaacagttccttcggcttcgtctgtcgttgtccgcacggatggcgagggattttatgtggggaaaaagaagaggtcgacgaatgccgaacaacgcaatgccaaaacggaggctcttgccaaaaaatggcggacggatttcactgcgtttgtcggaagggattttggggagcgaattgccaggaaaaaatggatgaaaacgaaacgggaaaagtgccaacgaaggaggacttgagaaggatgggagcagaggaagtgtcaaaaggacaaaagtaaacggacaaaggcacagccatcgcagccaatggcacttccttttgcagctgttcgtcctctcgtccccccgccgctttcccctccgtttccgtgcccatcgccctgctgctgttctttctgttcgcctttctcttctccctcagtgccgccttttccgcttcttcccccaccgtctcttccatttcgacaatttcacaaccaaagaatgttttcgaccaccgctctctcttcgcgtcgtcggaaagtgccaactccgaacccgcgcggtatgtgtgcgagccgaccttcagaatcggaccacaaagtcgacggcacttggaagaaagggcactgtcagcgatgggagaacgaagggcaccgccgcggacaacggcgaatga

SEQ ID NO: 66662 - DNA, 560 bp, Heterodera glycines
  Genomic contig location: Contig_ID=SeqID_37644; Location=232..791; Strand=+
  SCN-specific regions: Sequence locations=1-123,145-430,452-560
cactttgcccaaggattctgtgcccgtggaatgggaacatttttccgccaaggaagtcatcgtcgatccgaagtaaattttgggaaattgcccggggcaattcacacaaattgaacatccgaaagttctcctgctttggtcaacggactgcgaagcaaatcgttgcattaaattagctcaatttgttgtagcaattcctccaaaagtgcaattgaaattttcggggggggggggggggaaagatcaaagaatacaaacaaattgaatttaaaaaaattgttttaagaatggcacacacttatgtgactgaattggccggcggcattccgtccgctcgcggcacaaaatattcctacacttatgagtcccgagttgaggaggaggggaacaacgaattgttggaacagagccaacgaaggcgggaggagacggacgaggaggagatgaaacagcaacagccgatcaccgagttgaggagggaagaggaggagcacgagttgggcagggaattgaggagaggggaggacggcacggaaagacactgtacatctacgcaaaag

SEQ ID NO: 66663 - DNA, 743 bp, Heterodera glycines
  Genomic contig location: Contig_ID=SeqID_37646; Location=247..989; Strand=-
  SCN-specific regions: Sequence locations=1-20,42-101,204-286,308 -669,713-743
atgagattatattttggggattcctatcaaaaaatttataagacaaaaattggaaattcaatcaaggaaattatgatgccactagccgatttacaccgaggtataaataaaaaatttaaacacattaaatatttatttttcatagctattaatcataattatcaacgaattatttaattaatttttaaattttaaaataatttcttggtcagaaatgtgcattgatcacagctaactaatgtgttttgatcacctgatcagcagcgacctccgaaaatcgcccgaatttatgatttaatataaaaaatctacccaaaaaaattcatgagaaatagaaataccgattttttaactttttcaattcttttttctcttgccataagttaaaattttttatttttcagttgcggtgcatttgaattttaaccccgaaaatttggtggtgtctaataaaaacaatgctgtttctgttcgaagacttttctccaaagtcgaaagcacaccattgaagctgatcggactggagggggcattctttttggaaatggggcgaaacattgaaaaaattaatgacgatgaaattgagggtcatcatcacttctcacaaacagctaatggacgatacatggcaccggaatatttggacaaaaaggtttatacataatttgcaatttataaatatttgaatattttttatgtgtttaaattaattgtcattttaattatctatcagcaaaaataaa

SEQ ID NO: 66664 - DNA, 153 bp, Heterodera glycines
  Genomic contig location: Contig_ID=SeqID_37646; Location=1032..1184; Strand=-
  SCN-specific regions: Sequence locations=1-64,105-153
atgagcacatcatggacttatttggccagtgagcaattttaaggcattatttttgtatagtatgaaattaattatttaaattaaaaataatttaaaaaataattgaaatgatttttagtggtcaaattagcgaagaaggcaagagcaaattga

SEQ ID NO: 66665 - DNA, 849 bp, Heterodera glycines
  Genomic contig location: Contig_ID=SeqID_37647; Location=366..1214; Strand=-
  SCN-specific regions: Sequence locations=1-34,66-185,212-426,448 -698,720-849
atgccaatcacttttcaagggtcccttggcggtgcgccgccgcctccgccgccaccgccgccgcctttgtggaagggcggtggcggaaagtcgccggtgtcttttgcggatgcaattcggcaaaaggccatcgaccggggaggatccgtcggcgcagaacccgaagagaaagcgccgcaggcgaaagcgcccccgccgccgccccctccggcgaaaacggcggtgcctttgtccccaattgccccggcgttgtctcccatacgtagtcgaaggccaaccccatttccacgcaatttggcaccaatttctgacgaatcggcacaacaattgacgccaattagccgtcgaagggggactccgttggtgcggaaagtgaccgagtcagcggaggaggacccgcaaagattgggcagagtcagacggatttttgcatcggaagaaagcgacggaagccaagtggagaaagcagcgaccagaagacgtcattcgacagcgtcggtgagttcggcactttcctttgcgggaagtgaagtgacaacgccgacgaaaagccgaaagcgaaagggcacggcactgccaaaacgaaaagcggcacaaagagcgatcattgaaactgaagcggaagagcaatcggaagaaatcgaattgggaagaaagggacggaataaatggacggaagaccaaatggaagaaatcgaattggggagaaagggaaggaataagcgagtggatgtgtgggtggaagagcagcggacgatgggccaaaaggcggacgaatcggccgaatttgtgccattctccggcgaattggtcaacgaaagatttgcttatgacaaaatgccaggttaa

SEQ ID NO: 66666 - DNA, 61 bp, Heterodera glycines
  Genomic contig location: Contig_ID=SeqID_37648; Location=545..605; Strand=+
  SCN-specific regions: Sequence locations=1-61
gggcagtccccccgaaccgatgcgcccagatttatggggagaccgaatccttcgggaatag

SEQ ID NO: 66667 - DNA, 369 bp, Heterodera glycines
  Genomic contig location: Contig_ID=SeqID_37651; Location=237..605; Strand=+
  SCN-specific regions: Sequence locations=1-369
atgaaaaatttgcttcaaaaatgccgtgaattggacaaatgggctactgccaaggccattgtgctcgcattggtcagcagttacaatgaattaagggtgagaaaatcgactatcttttagattctattcgttttattcagctgattccgcaagacaccgtcgaccacgaaagtggagattctcaggcacttcccaaccaagaaaccatcgtggaccaggacagcgaacacttccaagcattgcgagaactcgccaaacgtttggctctttcgtttggagtggacagtttcaaaaacagggaggctcttgctgttatccaccacgtaaataaaagaaatgtttcgaaattaccagatttttaaatgacaa

SEQ ID NO: 66668 - DNA, 457 bp, Heterodera glycines
  Genomic contig location: Contig_ID=SeqID_37652; Location=444..900; Strand=+
  SCN-specific regions: Sequence locations=1-457
gtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgtttgatagggccagacaaaagaaggcaactgttggtaccaagtttgcggtaaaaaaatgagaaaaaagagataaccatttttggagaatttttttgtttgcgtttcaaatatcgtaagattgtttgatagggccagacaagagaaggcaactgttggtaccaagtttgccgtaaaaaatgagaaaaagagataaccatttttggtcaagaatttttttgtttgcgttttcaatatcgtaagattgtttgatagggccagaccaaagaaggccactgttggtacccagtttgcggaaaaaaatgagaaaaa

SEQ ID NO: 66669 - DNA, 236 bp, Heterodera glycines
  Genomic contig location: Contig_ID=SeqID_37653; Location=374..609; Strand=-
  SCN-specific regions: Sequence locations=1-21,67-236
tttttttaggtcgattcttaggggtgtattttttggttttattgcatttttgttaaggaattttccaaaaaatgtcgaaatagtgaaaaaatagtgacaaaacgccaaaatagtgatttttaactattttagtgacaaaaccccaaaatagtgatttctagtgacgaaaagtgacgtccaaatgaaaaaattttaatgcagaaatgcgttttttgagctcctttcttcaaaacaat

SEQ ID NO: 66670 - DNA, 677 bp, Heterodera glycines
  misc_feature (636)..(636): n is a, c, g, or t
  Genomic contig location: Contig_ID=SeqID_37654; Location=348..1024; Strand=+
  SCN-specific regions: Sequence locations=1-276,326-524,546-677
  Gene Ontology: Mol. function=DNA topoisomerase activity; Cellular component=nucleus; Biological process=chromosome organization and biogenesis (sensu Eukarya)
atgcccacaacattgggcattgcgcttgtgcatggctaccaacgcgtggaccccgacttgattttgccaacaatgcgtgccaatgttgagcgccaattggacctaattgccaagggaaaagcggactatcagacggtggacaaatcattaattaactaactaattgcgctataactaatttaattaccaatttcaagacggagaaaaatcattaattgactaatgaattatctgactaatgttgtattattaatgagttaaggcattttctttcagaataataaataaaataattagtaaattaaatttttaaaatttaaaaaatctcaaaatatttaactattgaaattgcgtaaaatatatttgtacttattttttctaaatttaatttcagatcaagaaccaaacacttgagatttttcggcagaaatttctcaattttgtgcagaacataaatttggttgacgcactttttggaggtgaatgtcgccaattaattgggcccattaaccaattaattaggcccattaaacaatttttaaattcaccattttaccccattagattcatttacatcgctggccgactcgggcaaaccgtcagcaatgtggcaatggcggcgctacatgaagctgntcgagacgctggcccaacgattgtattgcccgatttgcgat

SEQ ID NO: 66671 - DNA, 388 bp, Heterodera glycines; identical to SEQ ID NO: 51536
  Genomic contig location: Contig_ID=SeqID_37657; Location=184..571; Strand=-
  SCN-specific regions: Sequence locations=1-20,42-275,297-388

SEQ ID NO: 66672 - DNA, 544 bp, Heterodera glycines
  Genomic contig location: Contig_ID=SeqID_37659; Location=205..748; Strand=+
  SCN-specific regions: Sequence locations=1-16,38-268,301-383,474-544
atggcccgtgtcgcttcgccgccgctgccggcggacggcacggcactggccgaacgcatcaaagaggccgaagcgcgagaagaagcggcactgacagtcgacgccgatgaaacggttgcggatagacccccatttgttgttgatggcatcgacgaagtgctagcggacgacagcgaacatttgcgtgttgtcattgttgctaaagggaataaaagtgattagctgatcaatgatctcatgtaactgttttcgtctcgactaattcaagaaaaaaaattataaattgtttaaaaataattagcccctaaaactcaaatcgtaaatcaatgaaaagcattgaaaaagttgttgatggtttaaattagagtgccacgggaccgggacgggaattcccggtcatccgaggtcccggttcccggtcccgggttttgaaaagctcaggtcccggtcccggtagggcaaccgggaaccgggaaaaacaagcactggtaagaatggggtctgagtgaaaaattagtgaagaaaattggagtcaaagggaaaa

SEQ ID NO: 66673 - DNA, 202 bp, Heterodera glycines
  Genomic contig location: Contig_ID=SeqID_37659; Location=111..312; Strand=-
  SCN-specific regions: Sequence locations=1-71,93-202
atcggcgtcgactgtcagtgccgcttcttctcgcgcttcggcctctttgatgcgttcggccagtgccgtgccgtccgccggcagcggcggcgaagcgacacgggccatcacgtcaagatcacccgcaccagcagcagcatcggcacagaggtcgagaacggtggtggacagaaacgcgagtccggcggcgatgccattgcag

SEQ ID NO: 66674 - DNA, 2650 bp, Heterodera glycines
  misc_feature (23)..(23): n is a, c, g, or t
  misc_feature (42)..(42): n is a, c, g, or t
  misc_feature (159)..(159): n is a, c, g, or t
  Genomic contig location: Contig_ID=SeqID_8007; Location=1..2650; Strand=-
  SCN-specific regions: Sequence locations=1-10,46-168,191-379,403 -533,555-590,612-613,636-821,857-977,999-1173,1209-1744,1771 -1872,1894-1941,1996-2426,2459-2474,2526-2576,2598-2608
  Gene Ontology: Mol. function=voltage-gated calcium channel activity; Cellular component=apical plasma membrane; Biological process=male courtship behavior (sensu Insecta), song production
tgtgattttcaaaaataattatntaattactttaattatttntaagagttatttccctcgtgttgagcaacgagaatggcgtttacgtccgttatactacgaccaacacaattcaacgcccatgctgacactgtttgtggtcacaacaagcgaaggtgngcgtggaaaattgcaatttttatgtgtaaaaattaattgactaattattagggagcgttaagatgctcgagagtcaaaaattattttccagtaacttggggaaaccgagacagaaaattgaaatcttagaattgatgctgaaagagatcaagacccaaaataacatcacagataaatttctcgactagagaacaggggccgagaatctcgagagcagcccaactaaatattgtaaaacacttaactatgtatgatggataaaagtagatttaaaattcaacaggttggccaggcattcggcagaattcgatggacactacgtatgaggaccaaggtgggggattcaataaatgattcattaatgttttcaaagattttttcgaggggtgggggatacaggttgccgaaaaatgacctgtatctgttgaattcaggaaccattatcacaatggtaaaaagaacatttttaacccgaaaagttttcgttatctcattgtttttattatcccaatggtgctatgtcattacttaaaaaccatcataatgggcgttacttaaaaaaccatcataattaaaatttttgcttataactttgctctaaaaagaccaaatttttaatccttgctatcattcgatagatctaaatgttctttatgagcctgtaaaatttcaaaaaattttattaagtttaaaaaaagttatggccaaaaatgttcgaaaatcacgttttttgagttccccgagctataacttttttgaaacttaacgaaattttttgaaattttgcagactgatagagaacatttagtgctatcaaatgatatcaagaattaaaaatttggttgctttcgagcaaaattataaataatttttcgacaaaatttttcataatgatggtttttaagtaacgacccagcaccatcccaatttgttttttggattgaaacgcgaaaatcatggccgtatggttgaaatttctgatatttttttttatcaatttaagcttataaaggcatttttattcaattttaatattttgaataatttaacacacaaatttaggaaattcggtttttcaatgtttatctcgaacctcgttttttgacgaaatttttctttttaatacgacccgaaaaacatgtttccagaggttttcagggtcaatgattatgagagcatgatatctgtttttaacgataacaaaagaaaacttttttctcaaaaaattacaaaacgaaattgaccaaaatgcaattaaaaatgtgtaaacaagcttgaaaattatcttcgagaaagagaacggagtgatcagagccaatcatggaagtgatcagactaaccgacaaccaatcacaaattcccattttcactctttttaaggcccatcgccgtattatcgtgtggaggtggcactgttttatgtgatgtttttcatcgtgttcccgttcttcttcgtcaacatttttgtcgccttgatcatcatcactttccaagaacagggcgaagctgaactgtccgagggtgacctggacaaaaaccaggcaaagcaaattcaaaaatattataaccctaatttttggtgtttccaaaaattcttcttttacaatatatgtacaaaaattaggacacttccgggttatgcttcccccctaccttaagttttttttaggagttaaggtctttagagacctataaagaccgaaattcaaaaacaatttttttttttttttaattggaaatttatgccaaaatatatcaaaaaatggaacaacattttctatcttttatttattattttttataattaataaatttttgatttactttttattttttcttctaatatggcttttcataccatatttagcttattttcaagatttttagcctaaatttaacgaatttgaagaaatttgagaaattttaccctaatttgaaaaaatttatgtatatatttttcatatttatgtgcaataaatattcaacaattgatgtataaaaattcagaagcaatgcattgatttcgcgttgaatgcccgtccccgttcgttgttcatgccggaggacaaaaattcgatgaagtaccgaatttggcgtctcgtcacgtcaacaccatttgaatattttatcatggccatggtcagtaagaaaaaactaaaagtttaaaattaaaaaaaatttcgatgtggaataataatacggaggaaaaaaacaagtatgtgtagaaaaagaagagatcgatgggttggagaatgcagaagagattcattttttatattatataattttaattttttttgacaactcaaagcttctttttttataaagaaataaattttatttttattaaataaaatatatttttagattgtattgaatacaatcattttgatgatgaaattccacgggaattcgccggaatatgaaaaagttttaagtaaatgttttgtatttatttttaaataaaattttaaataaatcaattattttt

SEQ ID NO: 66675 - DNA, 1358 bp, Heterodera glycines
  Genomic contig location: Contig_ID=SeqID_8007; Location=631..1988; Strand=+
  SCN-specific regions: Sequence locations=1-25,80-127,149-250,277 -812,848-1022,1044-1164,1200-1358
atggtatgaaaagccatattagaagaaaaaataaaaagtaaatcaaaaatttattaattataaaaaataataaataaaagatagaaaatgttgttccattttttgatatattttggcataaatttccaattaaaaaaaaaaaaaaattgtttttgaatttcggtctttataggtctctaaagaccttaactcctaaaaaaaacttaaggtaggggggaagcataacccggaagtgtcctaatttttgtacatatattgtaaaagaagaatttttggaaacaccaaaaattagggttataatatttttgaatttgctttgcctggtttttgtccaggtcaccctcggacagttcagcttcgccctgttcttggaaagtgatgatgatcaaggcgacaaaaatgttgacgaagaagaacgggaacacgatgaaaaacatcacataaaacagtgccacctccacacgataatacggcgatgggccttaaaaagagtgaaaatgggaatttgtgattggttgtcggttagtctgatcacttccatgattggctctgatcactccgttctctttctcgaagataattttcaagcttgtttacacatttttaattgcattttggtcaatttcgttttgtaattttttgagaaaaaagttttcttttgttatcgttaaaaacagatatcatgctctcataatcattgaccctgaaaacctctggaaacatgtttttcgggtcgtattaaaaagaaaaatttcgtcaaaaaacgaggttcgagataaacattgaaaaaccgaatttcctaaatttgtgtgttaaattattcaaaatattaaaattgaataaaaatgcctttataagcttaaattgataaaaaaaaatatcagaaatttcaaccatacggccatgattttcgcgtttcaatccaaaaaacaaattgggatggtgctgggtcgttacttaaaaaccatcattatgaaaaattttgtcgaaaaattatttataattttgctcgaaagcaaccaaatttttaattcttgatatcatttgatagcactaaatgttctctatcagtctgcaaaatttcaaaaaatttcgttaagtttcaaaaaagttatagctcggggaactcaaaaaacgtgattttcgaacatttttggccataactttttttaaacttaataaaattttttgaaattttacaggctcataaagaacatttagatctatcgaatgatagcaaggattaaaaatttggtctttttagagcaaagttataagcaaaaattttaattatgatggttttttaagtaacgcccattatgatggtttttaagtaatgacatagcaccattgggata

SEQ ID NO: 66676 - DNA, 1399 bp, Heterodera glycines
  misc_feature (1215)..(1215): n is a, c, g, or t
  misc_feature (1259)..(1259): n is a, c, g, or t
  Genomic contig location: Contig_ID=SeqID_8008; Location=1..1399; Strand=-
  SCN-specific regions: Sequence locations=1-168,192-243,265-292,370 -520,554-891,920-1036,1087-1206,1264-1399
  Gene Ontology: Mol. function=voltage-gated calcium channel activity; Cellular component=apical plasma membrane; Biological process=male courtship behavior (sensu Insecta), song production
gaggagagtccatttggtggcccaaagccccattgtgccatattcgtccatgttcatttggcaccgcaaacccaatttccgtgttgggtgcacagtgtggtggccaccaaatattttgaaatggtagtgttttaaaacatatgcaaaattttgatgaaaatttcgattttcctttttgatatcccctcaaagatttttttttaattgcgtgaattttccagagttttgtcaaaaagaaaaaagttttttatatcatccatttgaatattgttttggaaccccgcctaaattgaattattttgtttttacaatatttattagattttaatttaaaataaaatcattacaaaaatcaaaatatttttttttcaaaggttgtcatggctgtgatctgtgcctcttccatttcgttagctgccgaagaccccgtcgatgacgacaatccgcgcaacaaaattctgcaatacttcgactattgcttcaccggtgttttcgcctgtgaaatgttgttgaaggcacgaaataatttttaacaattttattaaattttattgccaatttgaatattgtacaaatgtatattccacttaaaaaaagtaggcggacgggaaattttgccaaaaatcggatgaaaaatacattaaaaaggtggagagaggtgattttttaattttcccaccgcatcattttcacgaaattttttttaaaaactgaaaaacttggtattttttttgacttcctttgatgggttttcaatgtaaaatgtgacttttttaaaaaaaatcttggcaatggtaacaaaaattttagctaattaacttaattttattttctgaaattctaattaagtacaaaagctatttttatttgttttttttcaggaaatccggcaaatatttataaatgtatatatttttttgttctttagctgatcgatcagggtgtcattttgcatcgaggctcatactgtcgtgatttttggaatgttttggacggtgttgtggtggcgtgtgcacttgttggcttcgcattttcgtaaattttttaaatacaatttttttttaattaaattttaaaattattttagcggcaccgccggggcaaccggcaaaaatttgagtacaatcaaatcgttgagagtattgcgcgtgttgagaccgttgaagaccatcaaacgtattccaaagctaaaagtagcccctggggaatttttanattaattttaaatttaattttttaaattaatttttaatttttanatttccccattttaggcggtttttgactgtgtggtcaattcattgaaggtattgttattaaaaaaacagccattaatcctttaaattcattattattaagaatgtgttcaacatactcctcgtctattttttgtttcaag

SEQ ID NO: 66677 - DNA, 1906 bp, Heterodera glycines
  Genomic contig location: Contig_ID=SeqID_8009; Location=1..1906; Strand=-
  SCN-specific regions: Sequence locations=1-13,51-81,129-194,216 -275,409-475,517-669,694-786,821-936,990-1010,1034-1269,1292 -1408,1430-1526,1549-1581,1603-1906
  Gene Ontology: Mol. function=voltage-gated calcium channel activity; Cellular component=apical plasma membrane; Biological process=male courtship behavior (sensu Insecta), song production
tgcttttatatgcttaaattttattttaaaattttggtaaaataaattaaccatcccgtcgcctcccctttccccaattacattttttaaattattttttatatatttttaattaaattaattaatttgagcatttttaagtttgcgaaatttggtccgatcactgcttcattcaatgcgttccatcatttcactgctgtttctgttgtttttgttcattgttattttcgcactgctcggcatgcaattgtttggtggaaaattcaattttcaagtaaaaaaaatatataaattatttaatatttgaattttaaatttataaaatctttctaatataaaatatcataatatttatttaaaaaaataaaaatattaaataaaatataataatttttataatatttttttccagaacatgcatccgtacactcattttgacactttcccaatcgctttgattaccgtattccaagtgaaatatttttaaaattattacataattcttaaataaaatttgtcagaatgggtattttctaccgaattttgcattttgatagcttgaaataaaatcttggtccagtgaaataataaatccgggaaatccaggcttttccctggacctcctggattttttggcattacaaaatttttgtgtagattttgaccggtgaagactggaatgaggtgatgtacttggccatcgaatcccagggcggtgtgtacggtggcggaatggtttactgtgtgtactttattgtgctcgtgctgttcggcaattgtaaaaacttattttaattttatttttaatattattatataaccaaaaattggttaatcatgagaattttggtccaaaatattgggtaaagaaaatttaatatgtcgaattatttccaaaatccgttcagttcgaaaatcgaaatgtgatcattttgcaaataattaaaaatttttgcattaatataaaaatatttaaaaaaaaataataacgttaagacactttgctcaacgtgttcttggccattgcggtggataatttagccaatgcgcaagagttaactgctgcagatgaggtcgaatatttcgatgaacccaaaaaattcgccggacgatttttttgacccaaaacttttttcattgttaaaccgaattaagcaatcgctcttatatgtttattattagacctgtcaaaatcctttgccaaaatctcaaaaaagaaattctctgtttctaaaattttttgccctggttttttttacatgacaaaaatgttcatattttacagattaatagaatttatcaagtgcttttgaacaataccaagaatgtttaatttggttgaaaaagaaaaaagttatggcccaaaaaatgtcctgcgacggttcggctggcgataattttatagaaattctttttaatgttattctatttttacctattgttataggcagacgaaaaagccaatggaatgtttgaggacgagtcggaaacattgggtaataaataatgaatgatgagctcatcgattttttcaaattaaaataattaagattatgatgaacatgatttggaggctggtccggatggggaatttaccagggaattggacggtaattttatcaacaacaaaaaaaaatattgttaaggagcagctcgtctctgccttccgctccccccccctcgcatatcgtttcctcccgaaaaatcttaattttatagttttttttttcaaatttatgacgaattaaaaagattttcggggaatgtggagaggaaactgatactggagctggacataataatgcacccaaatttctatattctttttgtccctgattagaagaagagtgtgacgaggaggagagtccatttggtggcccaagccattgtgcatatttcgtcatgt

SEQ ID NO: 66678 - DNA, 935 bp, Heterodera glycines
  Genomic contig location: Contig_ID=SeqID_8010; Location=8..942; Strand=-
  SCN-specific regions: Sequence locations=1-176,213-312,363-691,713 -746,792-935
  Gene Ontology: Mol. function=voltage-gated calcium channel activity; Cellular component=voltage-gated calcium channel complex; Biological process=synaptic transmission
atggcaccactgcttcaaattgggctgttggttctgtttgcaattgtcatttttgccatcatcggattggtcagtgcgtcagtcatttttaagcctatccctcgtcttactcaagcctatctgctgttctcaccaaaacccacagtctctcgtccctactttatttctttaacttgttaaaaaatgaaaaaaaatatttttttatttattatgtttacttttaaggaattttattctggcatttttcatgccgcctgctacaattctttcggcgaaattgtgaatttctctgaaaagccattcccttggtgctttattattattttttttttataacaaatttaaaatttaataaaattttagctcgaataaatcgtcttcaactggtgcctacaactgcgacgtggtatgatggcgttaggaatgaaattccgacgtctcaaaaaaaaattttaaaatcgaaaagcggaattccgaagccctaaaaatttttaaaacctgaatttcgatctcaaaataatcctttcccgacttgattccaatccgactttttcaaaattccgggctttagtaagaaattcccttttgtttagccgggtgccatttgcttagcccaatggattggaccaaactacggcataacttcctttgacaacattgcatttgccatgatcacggtgttccaatgcattaccatggagggttggacaacaatcatgtattatgtgcgtgattctttcgagatctatttttttaaatataattttaatatttttttttcattaaattatcagacgaatgactcattgggcagcacttacaattgggcttactttatccctctcattgtgcttggctcattttttatgctgaatttggtgcttggtgtactctctggtgaatttgccaaagaaaggcgtgtccaattaatttaa

SEQ ID NO: 66679 - DNA, 731 bp, Heterodera glycines
  Genomic contig location: Contig_ID=SeqID_37665; Location=93..823; Strand=-
  SCN-specific regions: Sequence locations=1-147,169-203,225-494,516-731
  Gene Ontology: Mol. function=neurotransmitter:sodium symporter activity; Cellular component=integral to plasma membrane; Biological process=neurotransmitter transport
attcgtcgaatgtcttccacaaagtcttctcacgttgtgttcgaaacttcgatgggcgcaatgtccattgagttgtattggcaacacgcgccgcggacttgcatgaacttccaggaattggccaggaaaggtacggtagtccgaatgtattcatttaaattcctttttagggtattacaacaacacaattttccaccggataattgctgattttatggttcaggtgtcactgttccctgtggttatgttttttatttttgtttgtttagggcggtgatccgacacggacgggtgggcgttttatggcgcggcgggaggcaaagtaaaatccgagttaaggcagaggtggcacgtccatttacggcagtcgatttgcagacgaaatcagtgacgagttgcgacacacgggggccggcattgtgagtggactgttaaaattcgtccatatttcatgccgttaacagatttccatggcgaattcgggtcccaacaccaatggttctcagtttttcattaccctcggcccaactcagcatttggacggaaagcatacaatttttggtcgactagcgacgggcatgaaagtcttgcagaaaattggacaggtgacgacggacaacagcgacaggttatgaccgacaacacgcgaaggcgcaattcgttctctgtttaggccaacgaatgacgtgaaaattgttaaagcttatccacgcagcgaaattttgtccaat

SEQ ID NO: 66680 - DNA, 1224 bp, Heterodera glycines
  misc_feature (20)..(20): n is a, c, g, or t
  Genomic contig location: Contig_ID=SeqID_37667; Location=9..1232; Strand=+
  SCN-specific regions: Sequence locations=1-314,337-626,649-660,682 -1192,1216-1224
  Gene Ontology: Mol. function=helicase activity; Biological process =growth
atgggcccttcgcgtggtcnaaccatcgcgaaaacgagagggattcgcgacggtgccggacgtgcgatgggaggacattggggcattgaacgcagtcagagaagagttgaaatggtcaatattggtgggaatttgagaaatctgttggccaatagagacacttccatttcattcagtaccccatacaaaagcccgaactgttccaacactttggcacttccgcacagccgcaaggcattttgctgagcggaccgcccggttgtgggaagactttgttggcaaaagcggtggccaatgagacgggcatgagttttatcagtgtgaaagggcccgaactgctgagcatggtcagtaaaaaggcaaattgacggcatttcccatttcttttcagtacgttggcgaaagtgaaagggccgtcaggacagtgttccaaagggcgcgtgattcggcgccgtgcgttgttttcttcgatgaaatcgacgcgctgtgcccaaaacggtcgcaaagagaggttattcttttaaaaaaataaaattttgatagatttggcaatcaaattcagaacagtggtagttcacggctggtcaatcaattgctcaccgaaatggacggattggatggacggagaaatgtttttctgatcggagccacaaaccgaccgggtgaataaaaatgggctaacaaattgtaggttttttttgtccttttcagacattgtcgaccccgccatcactcgcccgggtcgtttcgacaaaattctcttcgtcgattttccttcaccctcagaaagggcggacattttgcaaaaggctaccaaagtgagttttttaggattcatttttatggtttctcattcctcagaatggcactcatccgcgcatttctccatctgtccgtttcgatgccttcgcttcaaattcctcccttgattttttcacgtaaattccctaccgtttgctctttcctattcctattgtactattgtgtttcttcctcttaaggggtgccgatctcgtcgctttagtccacgaagcgactctttgtgccctccgagaacgcattgaccaaaatgattcgcgcattgactccgtacaatcgcaccattttgaagaagccctccgtcgaattcgtccgtcagtgagacaatccgatcgagaacattacgacaaattgagggagaagtacgcagcgggaacagaaacaaagccaatggacaacgaatga

SEQ ID NO: 66681 - DNA, 337 bp, Heterodera glycines
  Genomic contig location: Contig_ID=SeqID_37670; Location=154..490; Strand=+
  SCN-specific regions: Sequence locations=1-337
atgggagtggcggttacggcagtggcagttacggtgggagaagctacgggagtgggtcatacggtagcagcggttacggcggccgaaattatggaagtggcggttacggcagtagcagttacggtggtagaagctatgggagtgggtcatacggtagcagcagttacgatggtcgaagctatggctagcggaggctatggaggcaggaattttgggaacgttggtttaactgctggcagaggaaccatggctttggtagtggttacggtagtggcggatatggctaattctttgtgcaagatgaaacaaggctttcttagttttagataaaaagcta

SEQ ID NO: 66682 - DNA, 3552 bp, Heterodera glycines
  misc_feature (3439)..(3439): n is a, c, g, or t
  misc_feature (3498)..(3499): n is a, c, g, or t
  misc_feature (3515)..(3515): n is a, c, g, or t
  misc_feature (3520)..(3520): n is a, c, g, or t
  misc_feature (3545)..(3545): n is a, c, g, or t
  Genomic contig location: Contig_ID=SeqID_8012; Location=4..3555; Strand=-
  SCN-specific regions: Sequence locations=1-109,136-290,396-432,476 -492,643-653,696-803,849-953,979-979,1011-1107,1191-1205,1241 -1505,1527-1692,1729-1730,1753-1880,1922-1923,1946-1974,2094 -2180,2210-2239,2261-2344,...
  SCN-specific regions: Sequence locations=...2382-2518,2540-2779,2802 -2994,3017-3371,3393-3552
atacaatgtaaaaagcaattttattaacttcttaaaagaacaattcgtttaagatttattgtattatttgaatataatgtagtataatactcattttaaaatcattgtcaattttttttaattaattattttattcatcaatatacacaggtggaaaaaagttttggtacaaagtgttttttgtcgtaactttgtcaaatgtcggctcaatctcaacgattttgctatcaaaaaataacttaacgaatttcagttgacctatttcggcattttttaactaaagttaaaccattttttaaacaaattaaagaattattattttttttattaattataaaaaaatatgaacttaatatgaatatttttataagaaatttaaattttatgtaaaaaaagctaataatgattcctgaaaaaagtccagttccattctttaaatcaaaaaatattaaaaaaaactataataaaattattacgcttaatttttttagtaaaatgaaacgagatataaaaatattagactaaaagttaaaaaaattgaaattgagttagaaaataaaataaacatgaaaacaataaaatgtgatgtaaatacgaacctcattataaaaaaacaaaaatttagaaaattaaatataaaaaagtactgcatgaaaattttcattaataaatcaatttttatataaaattattttgtgattgaaaatttttattatgatgatgaccaatatgcaggtagtagtcccttatagaaaccattatgtgtaacaatttcggttcaattcagtttaaattgaagtatgcatattctttaataaataaataacaaatgtgatgaaattttttattaaattcataatacttagaatatattacggtattctagctagtaaaatcgaattacgcctacgtacttcttttactgctttaaagcaatcaatatgataatataaaattaaacattggaataaattaaagctataaatttaaaaaaaaatcattatttaaaagagaaactgtaagcacgaaaaataaattaataaattgaaatatcaaaaaaagcttgcatcgggcatgagattaatacactgcttggcgagtcacttgaataaaaaaaaataaaagctaataaatataaatgtaatagtgagatatatgaaatataaataaaataatgaaatattaaaatatcactcgaaggaaaacaaaccttaatatcttttaaaatgtttttattctattaaagccaataaattacaaatactaacttaatggaaaatatgtataaaaaagcataagatgaatgaagccgtatcatcaacttgttcaggacacatctgacatcccttggttcaaatatgtcattccgcctaatgcaaaggaatttgacaacagaattagactatttcacaaaaaaatatttgggctctgcaatttacaagaccaaaaaaagacatgtctataaactcttaatgctataaaatgatttcaaaaaatctttaattaagaatttttaaaaagctatggttcatcggcaaccgatttttagtgctaaatcaaataaagggaattttgaaaattggcgaaatttaaagtaaaaaaaaaattgtttcaataagaagacatttgcacgaaatggataaaataaattttaaattgcagattcttattctcgtaagaaaaagaataaacattattttagtataatattttatgaatattttattactaatactttaaaacaaccattgagtcgaaaatattattgataagtcaaatacaaaatggcaaaatagcaaattttgtagtcgacgccatataataatagcggtcatggttagcggtcatggttaacacaaataatagaagattctttttgcaaattatatatatatatatataaaagtaaaattaattattaccagtttaagatgtcacttaatttcagtgaaaaatagagaattattatgtatgaaatataagttatataaattttttttaaatttaagattaaatgcattaaaaatttctattgaatttagggaattgaattttatgagatataataaattataaattttaatttaaattaactattcaaaatttgaaatattcaagtattttgtatgattgcacggtccgcgtatttgggcaacaaccgggtccgggttaaaagcttatactttaaaaaatcaaattctttattatttgtcgaatgtttttattgctatttaaaccacttttttgctgtgcgctttttccaaaaaaattttcataggcaaggtcggtccgatggtgccgataggcgcagccgggaaaaattttgaaaattgcttctgatttgttaacagattttattgaaaaaatgaacaaattttgtaataacttttttttacgtaaagaaatctccagataacagttgtggaagattggtatgaggcaattataaatggaaaaaatgttgactgtatttatattgactttcaaaaagcatttgactcagtgccccatgaattactttcatacaaattggaaaaaattggtataaggggcaaacttttgatgtggataaaggactttttgagtaataggacttttcgtgttaaaattggggatgatttatcctccagtaaaaagttggttctggcgtcccccagggatctgtcctgggccctttattatttttgatctatattaacgatcttcctgatgctttgccatcagaagtgagaattaaattatatgctgatgatgttaaattgtatatttgttataaagcgagagctgacacagaaattatgcataaagcattgcataatttatccgaatgggcaaataaatggcaaatcagaatctcaattaaaaaaacttttgtacttcatttggggaataaaaaccccaaagaaatatataaaattgatggaaatataataaatgttgcggatacaattagggatttaggcataaatattgataataaattgcaattttccaatcatgtcacacaaataacaaagaacgcatatttacgtatgcgttctttatttcgggttattaaatcaaaatcttctaggatttggattattttgtacaaaacttatgttagaccgttattggaatatgctcctgaggtttggaatccatctcttctaaaaaatattaaaaaaattgaaaaatgtcaaaaatatttcaccaaaagagttctttttaaatgtagccttccacccattccataccaaaatagattagaataccttcaactaccaacacttgaaagcaggcgaaagctgtctgatctgttcatggctcataaaataatttatggccgaacagatcttaatccctttgaaatattcaaaccttctgaacgctttaacattcccttttatagacttaactcgaaatataaattaggcaaaaaatttataccttttgcggngcgggtaactaaaatttggaaccaactcgataaaaagctcattgaaataaactcattannatcatttaaaaataanactanaactatttcattccctgtaaatagnaccggaa

SEQ ID NO: 66683 - DNA, 888 bp, Heterodera glycines
  Genomic contig location: Contig_ID=SeqID_8013; Location=360..1247; Strand=+
  SCN-specific regions: Sequence locations=1-1,27-232,254-362,389 -448,491-670,776-888
atgttttttatttatttattgattgagaacaaaatccaattcaattctgtagatttaagtgttgataatttgtttttgtatgtatgatacatcattcaaactttgcgtaatcattttttaatgcacaaattcgaattgcaaatttttagttattctagaataaagtttttgtctattttagagattccgacatagttttatcgctattgctgtacttatttttcatttattccctttcagcctaatcttccatttccaataacatacaaattagccactttcaattccctcgcccttcttttcttgtctcgcaccaaaattttgagattgaacttatcgtcaagaagccttaaatattatttattttatcttttgttgttttttaaatcatcgacctttgtgttcgacatatttgagattgaagctatcttcattcaccattaaaccctatttataatttatttattttttgttgatttttaaaatatttcagcttttaaaaatttaaagagccgattacttttaaaactgatgaaagttttcatattttcgttttattaatagtgcttttttcggtatcttcttgctccaaactttcggttgttacggcatggcacatctcaatatatttcttttaatcaaaagatgtatattttttgcttgaaatatctttattttatttattttaaatcattttaatttatataaaatgccatatatttgtattatattcctttttatttgttatccattatattatattcctttttattttttataagtccacaagataaatgccattcacgaaaagcttaaaaattgccgtttataaacgaattgtgtttagtaaattaaaataattcgcatgaattctctattttgaaatga

SEQ ID NO: 66684 - DNA, 104 bp, Heterodera glycines
  Genomic contig location: Contig_ID=SeqID_37673; Location=104..207; Strand=-
  SCN-specific regions: Sequence locations=1-54,77-104
cccaatgcggccgggatcacaacgcgacgacgttcgccctcgcacattgaggtcatggcacggtccattccggcgatcacttcgccgtggtggagacggaaaat

SEQ ID NO: 66685 - DNA, 804 bp, Heterodera glycines
  Genomic contig location: Contig_ID=SeqID_37674; Location=234..1037; Strand=+
  SCN-specific regions: Sequence locations=1-3,25-502,524-726,749-804
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccggcataagcgaggacctcaaggcgaagagacatgattggctctataaagaaagacgtacggtaaaggggatacttgaaaatagaccacagaaggtagtgattgagaatcatgtacccggtccgaacgttgcaccatatctgggcctcaataaccaatccaaactacaggagaccgatgaaccccggaaaataattattcctaagaaaagacttgaagagcaaactcctgatccggaatcggataatgatacaataaatgagttaactccggagccccaaacaacatccacattaaaaacacccattccgatcaaaactattatacacccgacccttttaaacggtctttttaggtacgtaaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtag

SEQ ID NO: 66686 - DNA, 943 bp, Heterodera glycines
  Genomic contig location: Contig_ID=SeqID_37676; Location=350..1292; Strand=+
  SCN-specific regions: Sequence locations=1-616,638-943
atgtgcttcggaggcaaaggcaccagtcaagactacccttcattcatggccaaaatccgatggcccatggaagcgagttcacatggactatgcgggaacattctttggaaagatgtttctcgtcattgtagacgcatattccaagtggcccgaaatattcgagatgaattccaccggttcgagccgctacgattggtaaattgcgctatctttgcgcacggcatggattgcctgaaacgttggtcacaaataacggtacccaattttcgtcgaaagaattcaaggaattcacccgactcaacggcataaaccatttgttttcggcaccttattgtccgatgtcaaactgacaagccgaacggttcgttgacacattcaagggtggttgtgtgaaaattaaacaatcgatttctgtattccaattaattccgagaaatttttggagagggccaattagtcgtttggcctctgggagctgggaaatggcttcgacggaattagaacaaaattctctaagtggcatggaagccttttcaaaaagcttaattgattttaaacatttctcgtttgcctctgatgggttgtttgacgaaaggaacacattatcaacataaatgttatttttgatttcatttgaaaggggggatggattttgagacagatggtgctgaatagtagccgcaaggaggaagggggatggacttaacccaaatgagactcgagtaaaacggaaaattttaagattagacaaggaaaggggggtttcaatgttttcatggttcacctggtcttgttcaaaagcgccacgttcgtttcgctgatgaagtggatcaaaacggtgccattgctcgagaccaacaacaaatcgccgatgtcgccgacaaacaaatcgaagttcgacgttcagaacgtcaacggcgtccaacaaagaaattggatttag

SEQ ID NO: 66687 - DNA, 318 bp, Heterodera glycines
  Genomic contig location: Contig_ID=SeqID_37678; Location=356..673; Strand=+
  SCN-specific regions: Sequence locations=1-273,295-318
atggaccccaaaaatggccaactgtcacgcgcaatgcgaaaccgagcggtggaattggcatttggcatggacacagtttcagttactgctgctgcttctgctattaaaccgcccgtttggagtgccaatgccgtggatgttgtcagtgctgtgccattattaccacgggcggaactcctttcatcatcattgaattcaattgccactcccattgtgccggcttcgtcaaaacaattgcagcttgtttcgcagctgcaacacaaattggatgggtaaataaatctgacaaaacattgaatcattctgtcaaaattttga

SEQ ID NO: 66688 - DNA, 986 bp, Heterodera glycines
  Genomic contig location: Contig_ID=SeqID_8014; Location=1754..2739; Strand=-
  SCN-specific regions: Sequence locations=1-20,54-458,480-495,517-986
atgaatttaattttatgggatttaattaatattttttgtttgcttaacaataaattctttaaaggacaactaaagtgagtaaaaccgacaatctgatcagaaattgaattataaaaaaggataaaaatttggccattgtctattatgaaaccaaaatcataaagaataacagaaacatcaggtaagtattgatgttggatttttaaagatatgcaaaggctggttgaggttgaccacatcctatggattggggcttttcagtgtttgctttgttccagaggaaatgaaaattttattaaaattccgaggaaaattgaattttttataaatttactttcattctaaaaaattcctttctaatatgtagagaggagagtaggaatctaagaaattgtggacaaatttaaaaagctgaaagtcggcctttggtattggaagccgatgctgatttgaatttgatatcattaggcatttacagtaccatttcgattggaatttggacaaaatccgacgacaccttttacaaatattcaaacaatggcttcattttcggacacagtgccactggcttgggcggatatccctcctttgcagagggcgacacaatcggatgcggcgccaatttaacatcgatggaaatcatttacaccaaaaatggacaaaaattgagtgagaaatattaatttatcatgaaattaagcagatgaagactatttttagacacctcaaatttattcgtttttgacaacgaattgcttccatttgtacaagttaatacgcttggtgatgtgattgaagcggatttcggacctgtctttgagtacaaaaatgtttcggatttgttcgctacacaaattgcctaatttaacagagaagagaaaacttacaaaattaatttttgcttttgtttttaattgtatatacatttaatttactttattttacacgcattttaaaatttatatattgtttctgcataaaataaa

SEQ ID NO: 66689 - DNA, 1339 bp, Heterodera glycines
  Genomic contig location: Contig_ID=SeqID_8014; Location=3449..4787; Strand=+
  SCN-specific regions: Sequence locations=1-333,385-502,523-571,596 -635,664-746,768-1080,1140-1145,1167-1339
atgaatttttggcattttgcaattgttttgcttcatttatgtatgcaaatgttgtcagaacccactgctgaagtgcaggagaatggtatgttttttttgttcaatttttaattatatttttcagtgaaaaatattcgcgtcgaaattaatgatttacgcgagaacatttcacgacttttcaccaaatttgtaagtttttctaaaatatgccaaattagcagtcaaattacagacaaaaattgaattggaacagaaacaaattgaagaagcattgaatgaccaattattggttactcaagaacaaaaatcggcagttgtgagtcgccgacaaacttttaaataaaaacattttgatttaaaagtaatatttaattataaataaatgatgatgacatattgcgtatggcttattaagaaaccaaaaataaattttttagaacgaaacacgagaaacggagcaattgaagacattggaatttaaagttagatttgaagaaaatatttattattattattattattttttactttaagccgaaaaaccaatggagtgtcaacaaatctgatagcgaattgttcattttcaagcccaaacacttgaaagccattcatcgtggaaaagaaataggtaaaagaaattaattatttatttattttttattactatggcacataatataaaaatatactaatgctaataatgtaactttttcattgcttaggctaaaattgcacaaattctttgtataataaaactaaaaatagaagattctttgatactttaacattgagaaagttttttgaaaatttttgcataatttgttgccttttcaattaattaagtcattttgccttaaactttttttaaatttcattaaacactttttaacaaattcattccaccttttatgccttttgatttggcatttttaagcggcatattttaagggcggcgccgggaattaattgcggaatctgtgcttctcccatattttgaagttgtgtattatgagacgaaaattataagaaagcaactaaatattgaaggaagctcgtaagtaatcgaaggaatcaaataacaattttatttaattttaatcgttttaaaataaatttaaaattttaatgatttataaaaacttttaagatcgatcggaattggactttttggaaaaagcctttacatgtatggggacaatggcttcatttttgggcacaatgtgaatggcttctggggatatccctcgtttgaagagggcgacacaatcggatgtggggccaatttaacatcgatggaaatcatttacaccaaaaatgggcagaaattgagtgagtaaaa

SEQ ID NO: 66690 - DNA, 691 bp, Heterodera glycines
  Genomic contig location: Contig_ID=SeqID_8015; Location=392..1082; Strand=+
  SCN-specific regions: Sequence locations=1-34,56-241,281-425,451-691
gctggaaacagcttgttaaaatgcacataaaacaattttgtgccttggtttgaaacttctatgacccatttcgatatgcatattttgtatatctgtatatattcacgtctttttgtgattatttttatgatattggagctctttttaaaaaacgaccattaaaactagcaccttaattatattggaccttttgactcataaggacagaaattttcataaatcaattagaaaaatatttggcattttaataataatataattataaatctttataaaaattggcaattacgacaaaatataagatcaaaaagaaattttctatttttagttgttttcttagaatttataaatttttagcgttttccctttagataggcatatcttagctattttcgagagttgtagcttaaatttaaaggacttgaagaaattttgagaaattaacctcaatttggtaaaatttatgtgcgcatttcttcggttttatgagcacagaattaaaagccgtcaaatgagattatggggcgaattttaaggcaaaaattttaaggaatgtcagattaattcgagaaatccggatttaaatagcgcgggaaaggcaattcattctcaagattttcaatctaatttcatattgaaatcattcaaaataaagcaccttttgaggtaattaaacaaattatatatgaaa

SEQ ID NO: 66691 - DNA, 141 bp, Heterodera glycines
  Genomic contig location: Contig_ID=SeqID_37684; Location=357..497; Strand=-
  SCN-specific regions: Sequence locations=1-141
atgcccccgtccgctgatgggcacaggtcgttcgagatgacttgtggacgctgcccaacattacggggcagctgcctcacgagccatgcttttggggtgcttccatacgttggagctgtggtataccgctcagtgctgcac

SEQ ID NO: 66692 - DNA, 160 bp, Heterodera glycines; identical to SEQ ID NO: 55175
  Genomic contig location: Contig_ID=SeqID_37684; Location=562..721; Strand=+
  SCN-specific regions: Sequence locations=1-160

SEQ ID NO: 66693 - DNA, 307 bp, Heterodera glycines
  Genomic contig location: Contig_ID=SeqID_37688; Location=1..307; Strand=+
  SCN-specific regions: Sequence locations=1-26,50-58,89-307
tgctctttctattgtcgttccgttgatttcttactctgttcttccatttaccaagtagcacacttttatttttctgcccttattttatatttagcaatccttcaacgaattccgactgcttgcgatggcaatgttttgctacggtttggcattgaaataggcatgccataaatcggtcaaaggaagtgatggagcggatagcgcgctcctttcactctgtgccgctgagttgacgacactgctcagaacgaatttgcacgcggactctcagttggaggcggaaatgcacgaatgcgacaggaacatg

SEQ ID NO: 66694 - DNA, 145 bp, Heterodera glycines
  Genomic contig location: Contig_ID=SeqID_37690; Location=82..226; Strand=+
  SCN-specific regions: Sequence locations=1-145
ccggcgcaaaagaggagtgcgtgcacatgctaaatgcagaaggccgatggaacgacgcgcgctgcgaaattcaaatgacaggcgcgatttgcaaaaaatcaaatttttaaatacaattgatggacgaattttaatgggcataagc

SEQ ID NO: 66695 - DNA, 453 bp, Heterodera glycines
  Genomic contig location: Contig_ID=SeqID_37694; Location=1074..1526; Strand=-
  SCN-specific regions: Sequence locations=1-453
atggccaacgtggccaatgactatctgatgcggcgttatccgagtgagaagcccaacaaacaaggaaacgtaaaataaaataattattcaggccgacggaaggcgtgcagagaccctttggcattgccatgcgttgggtcgccttactcggcactgaacgaattgaatttcgacgagaaatgatcagagcacaatcaatggatgtcttctgtcccccccccccctctttggtcccctttttcattcatttccaattgtgtcccaaataccctcgcgtccattcaattcatacgcatggccccgcctcccattgtccctcccgccttcctattgttcaaaattgggttgatgggggggggggggcgtcagtgatcgaagtcgtcgataagcgaagggcccttcactgtgttctttctctgccattactcgcgccgcgcatttttcaaaaataaa

SEQ ID NO: 66696 - DNA, 91 bp, Heterodera glycines
  Genomic contig location: Contig_ID=SeqID_37694; Location=292..382; Strand=-
  SCN-specific regions: Sequence locations=1-91
atgcccctttccgagtgccaaaaacaccaaaagaacgaagggagcaaaggagttgacaaagaagacaaatatgttaataatatcattttgg

SEQ ID NO: 66697 - DNA, 665 bp, Heterodera glycines
  misc_feature (624)..(624): n is a, c, g, or t
  misc_feature (646)..(646): n is a, c, g, or t
  Genomic contig location: Contig_ID=SeqID_37695; Location=302..966; Strand=+
  SCN-specific regions: Sequence locations=1-145,167-176,241-274,296 -308,330-404,444-483,547-573,595-665
cttaaacgtttcaacaaatatttttctgtcacaatttttgctcaaattctgccaaatacaaacaagcgctttcatgaattcgattatggtaaacgattcgctattattgaacaacttcatttgggacaaaattagtcaacaaaatgagaccaaaataatgacaccatacactgaggtaattaaaaaataattactttttctcaatattattttatttaaaatgaaagaaataaaaattaaggtttttcctattttaatattatattccatgtttaattcacaaataccatttatttcgaaagaagggcccccgggggctttatttttaagcccccctcaaaggggatgctttatttctgggcaggttctaatttggggggggggctgtattttagaaaaaaggtaataggaaaattatttgaaattttattcaaaaattatgagcgagttcagatgaacttaaaattttaagctattccattcttaataatataaaagaaattaaatataaaataaactttaatattataatttatattttattttctcagtttttattcgacttggattctaaccgtttcaacggctttttaattgttataacaaacaaaatgcatatcactnggcgagtcgtgccacctgtttnggcatctattctcacttga

SEQ ID NO: 66698 - DNA, 362 bp, Heterodera glycines
  Genomic contig location: Contig_ID=SeqID_37697; Location=89..450; Strand=+
  SCN-specific regions: Sequence locations=1-145,168-169,194-229,251 -318,342-362
gttcgggccgatggtcagactgctgatcctttctctcttgttttctcctgcgcagcagctgagcaaaaagggctcaattctaacacttcaagcacagtgcctcgtgctcaaaatgctgctgctgcatcacggccgaccgatccacggccaaatgcaatccaaactgtacatgctgcatctgctgctgctgttggaggtggcgactttttaattcctctttatattcttcttaaaataaaataaaaaataacccaaaaaaatggaaaaaaataacctttttaacaatgggatttttgttcgactttcggttgggaactcaaagaaggagtcaaggcttttcagtttatttatttccaaattaa

SEQ ID NO: 66699 - DNA, 122 bp, Heterodera glycines; identical to SEQ ID NO: 59085
  Genomic contig location: Contig_ID=SeqID_37698; Location=295..416; Strand=+
  SCN-specific regions: Sequence locations=1-7,29-122

SEQ ID NO: 66700 - DNA, 783 bp, Heterodera glycines
  Genomic contig location: Contig_ID=SeqID_37699; Location=184..966; Strand=-
  SCN-specific regions: Sequence locations=1-257,279-306,328-417,439-783
atgtcttccgttgaggacgaggaggacagtggcaccaacgcgggtgacgacggttggatggtggtgaagaaggagtcgttcaagaagttgtgcgacttctacgagaagcgtcgtcgcgtggagtgcggcggtggcaccgtcgccgctgacccattcgcggaacaattggaacgcgaatttcgcgaggcaacgatggctgacaacaacagcaacaaccgcaccgatgaacgcgtggatgagaaattgacggcggagagtggtgagttgggggagggggataattttcgaagattttttaacttctaagttaggaaatttttaaaaattgggggattatgaaaagttcaatttggtctactaaaataactgaatttacggtttataataaatttattagtccaataattgagtctcttgtttaaaacttaaaagatattcacaattttagccgaatatgctcgaactttctacatgacaaaaccatttacaattagtgttttatttccctcaaatgcttcattttgattgctgtatttatttgtagaaccgaaaaaggcagacgaattcgtgaaggaagttggacaagaaccggctgccgaggtttatgtggcacaaattgtggatttgaccaccgaaaaagatggaaagtcagaaaaatcggagaaggtggtacataattcttcagtaaaagagggaaaaggaacattttttaagaccactccctgtgtccattcggttgtgatgcgcggcgtatgtgccggatgtggacaggattttcgtcag

SEQ ID NO: 66701 - DNA, 3418 bp, Heterodera glycines
  Genomic contig location: Contig_ID=SeqID_8017; Location=372..3789; Strand=-
  SCN-specific regions: Sequence locations=1-148,170-346,369-847,869 -1394,1416-1538,1582-2452,2474-3418
atgagtgagctcttgcgcatctccattgcaccaatggtggtgcgtctcaagatgtacattgagacagcccaagaaaacttgggcaaagagctggcggaccaaagtgtccgtgcagatctaatcgcggagagacaaaatctctgcaaaacaatttctcttttggagaaatacaatggaaaatgggaagccatttttctgagagtgaagggacaagctcttcaagatgaagagcaaaattacagagactttaagcctgaagggaaggctttcatgcattgggttgaccaagcccgagggcttgtcgacactattgaaggggctttaggcctctcagagctgggggatgcaattccccagccaaaccaaccagcacaagttgtgcagcagccacaacttgtgcatcagcgtcatgatgtgacgcttccgccgataacattgcccaaattctcgggggaaccccgagaatggcctttgttttggaagctatttgagacttccgttgaaagtcttcaaattgaagacttcaagaagcacatttatttgctgggatgcctcccagagaagtcagttgctaggagagcaattgacttatacccaccgtcagatgaaaattatccaagggtagttgaaattctgaaaaagcggtttggggatgaaaaaacgatggtggagtccctccaagcggagttactccaccttcccaaaccagcagaatccgttcagtctctgagacaattctcagagtccattgaacggatttgccatcagttgttggactatggagaaaatgaacaaaataagttcatggcctccactattaagtccaaactgccttatcaccttctcacccaagtggtggagaaggaaatgagggcaggaggtgcctttaattgcacagagctccgaagagctatcacttcaatcgttgaagtgaaagaagaagtacagagatgtactcaggtttttcgaggtgaggaaaaaccccggaattttcccccacattcaaatgggggaagagctaaccaagggagaggaacaccgttccgtttctcccagccgttccggcaagaatggcagtggaggccaatggaacgaaacgaaccggtgaggaggatgtctcctcaaccgaatcgttccttctcggccattaacaaatctcaaacccctatttcagatagggggtcaaatcgcttatgctccctttgtgaagcaaaggggcatgcaccgagtcggtgcacgaaatacaccactccgggggctcgaaggaagcgcctcgcggaccaagacaggtgtattaattgcctcattatggggcataattctctgaactgcacctcaccccgcaggtgcagtcaatgtggtgaaagacaccactttatggtgtgttatggaggagaaaaacaatggaatattcctccgcaagtgcagaggaataatttccatgggatggggacagagtcccctcccaatcagtttatccagggtcacgagagacccgacaacagaaatgattctgtggggatgatgtctccccaagtaaacagatcatttctgacattgacaagtccccaattttctcaaagaaaaatagggacagggacaagacaaacttgttccctttgttgtgctatgggacatcctccaagtcgatgtccccaatattccacaccaggagcacgcagaaggcggctcgcaaaacagcgaaaatgttttaattgccttatgaaagatcataaggcacaacaatgccaatctccaaagagatgcttgaagtgtggtggaaagcaccactatatgatctgttatcatggagatgctccaattgggagcactccgcaacagataagggaaggaaggactgttcagaagaaacagtcctccaaacaaagaggagagtttcctcgttctaaaaccctttactcaggcgtatcctctagagtagaggataaaccgtctgaaagtattgctttcgactgcagctcaaccagtgggttgaaaaatgtgacaaataaatcacattcatttttttgtcgtgccatggtcatgccaaagcacgaccaccaaaaaatgatcgaaaagtcagttcttttcgatcaaccgagtcagatttcataccaatctgactctcatttcggtgagcagaagacaccgaaagtaactcccacagataagaaaatctgtggctgttgcataaaaaagaatggcgttgtgagccattcagttttttccattcgtattaatcgaatggacaataaatgggaagaaactcttcctaatcgaacagagcaatcaatcatagcattgacgctttgtttttacatcagcataagcctgatggttctctcaattttaaaagccctttctattgggcgtaaaaccattgcttggctaatgatccaactcaaagtatcattactttgttttgaggatcagagcacgccttgctttcaagaaggaaggcaaagaggggcaatccctcaattttgtacagcgcgccatattttgcaaataatggcgtttactgtaattttagcatgtttgttccctcttcccgttaaggggggaacagaaacaaatgcttatccaaccaatcactgcaatgaatgcaaacttctttgctttaacaaaggcgttaaagcaaagattccaaaagaaatcaataaagttgagctctgctgtgcagagaactgttacattcatgagaatgtaaagcagctcacttacgagctaccaaaggaaatcctcctaaatgacttccaatgtgaaggtcatttttggatggattcgaaacacatgttcaaaaaggacatgttatgtccagcagttgatgagtgcgaactcatcgaatgctatttttgcattgaacagttagcgaatccaacctgttacccattgatttcatcaatgttagcagggggactttgcttatcactcataagcattagctttatggccttttccatattaaaagtcctgttttcaggattttatatggtcatttggctgataattcaatttatcaggccaataatttacttagctggcccaaatcggcttccgaaagagaggaggccaagggcaacagcttctcaaaattggacatcacgccgtgtttacagaacaatggcgtttgttgtccttatggctaactctctccaggatttgactggagcagagaccatagcagtcatggccaaatcggaaaaatgcattaaaaatgcgacaagcatgagatgcattgtcgaaaactcagcaatgctgacgttgctgccagttggccaaacaaacacacttcttctgaaaacagatgaaggtgttatccttggctcaataaacgttgtgcttaaggctttagctttggaatgccaaagcttcactaaagcctggcaacgttcatacgcaattaatgtattggccg

SEQ ID NO: 66702 - DNA, 377 bp, Heterodera glycines
  Genomic contig location: Contig_ID=SeqID_8017; Location=5976..6352; Strand=+
  SCN-specific regions: Sequence locations=1-377
gtaacagccagatatgttcaacggcaaaatggtgcaaaggctttggtgaagttccaaagccatttgaagaccttcgatttgaaggtttaattggacaggactgaatcctgtcaaggcaattacttttctcccagtatttctgagttggtaatttttgatgtttaatggaagtctcctctctggactttccattaacttttcaaggttatgtgaacggcaattgcagttcactaaacctgatgaatggtcaggtatgcaatcagtgcatgcctgaactccaagactgcaattgaaatcaattgcttcttgccgatttttacagttgaagtcaattgtaaagggctctcgggtcagagccatattgctcccgtcaaaaa

SEQ ID NO: 66703 - DNA, 1063 bp, Heterodera glycines
  Genomic contig location: Contig_ID=SeqID_8017; Location=4247..5309; Strand=-
  SCN-specific regions: Sequence locations=1-33,55-395,417-744,774-1063
actttcaaatcatccttccacggaatgcctattcccatacgagaagggccttatttctcggctcgccgggtggtcatacccgaaaatgccgaggtcttcaatgatcgcctttacggacttggcgatccacgatttgaagaggaggagagagttcctcgctggcaggaacctcctattcctcgccaaattgagtcattgagctcatggattgagcggtcttatggaccgcattggtatgaaacagcacgggagcgccgtgctgtcgaagcccgccttcgcggagaacttcgcgaaggagccacgctacttggcgaacattttggcagaattgccgagatccattttgatggattcacctgttatggtccggagggtctcttcatctctccgggcataacacttttcgatcattttgtacggttgggtcttcaagtagacccagtaaaaccgtgcatacaagaatatgtagggtttagccctcgcgagcaagggatgcttgtcgacatttatccgatcgaactggtcaacatccgaaccagaatcggagttgcttggagagcgccagcagttttggaggaacctcaccctcctctacgtgaccaccagttaccagatggacgactggagaatcgtcctccgagggtggctcgtcgacttccaaaccgatgatgaaaagaattttggcaaagagacggcaacagatgtcgccatccttgaggcccggagtatgtcgccaaagcgacacaaatttctttgaaatttcttttatttttgatccttttcgtcgatcaattttctcccttcgctcgctcctttaattatgactcatcttttcttttctccatattttcgctatgagtcatcatttttgagggaattttttccctttgcttgtgcacatttcttcacgtgcctggccccgcccccatcgattgtgagggtataaaagcccggcccattctccattttcttcactctgatcactttttgattaagtcagtcgtgacagttttctgtccaagcatttgcattaaattgtaattgtgcaattgaattgaataaa

SEQ ID NO: 66704 - DNA, 106 bp, Heterodera glycines
  Genomic contig location: Contig_ID=SeqID_37702; Location=215..320; Strand=+
  SCN-specific regions: Sequence locations=1-106
gtgtccgtttggggtactcaaacaattatggggagcaaaaatccaacgcagaattaaagtacaggctatagggaagctactcccgaaggattcggtctccccataa

SEQ ID NO: 66705 - DNA, 119 bp, Heterodera glycines
  Genomic contig location: Contig_ID=SeqID_37702; Location=751..869; Strand=+
  SCN-specific regions: Sequence locations=1-119
ccaacgcagaattaaagtacaggctatagggaagctattcccgaaggattcggtctccccataaatctgggcgcatcggttcagggggactgccccgaaaacaaaaaaatcaatttttt

SEQ ID NO: 66706 - DNA, 417 bp, Heterodera glycines
  Genomic contig location: Contig_ID=SeqID_37705; Location=430..846; Strand=-
  SCN-specific regions: Sequence locations=1-36,58-388,411-417
gacactctgaatgcgttgggtttgttgttgactgggcttccttcctccttccaagccttcttcttggatcgaattgaggagtccttcgaatggtcccaaatcgcctctgccgacgctgacccttcgcaattgttcgagtcgcttagccacgaagtttacctccactcggacagtcgcattctctcgatgctggccctaatccattcattttgtcaacatggcggcaatgttcggaaacaaacaaaatgttttgaaatcaaatcattttagaattcgctttcgattattcccgatttcgtgatcaaccgacttgctcacaaagtggacaatgaggcacagctggtgtatttccttcgcattgtggtgccgtatttgcagagaattcacgaaaaggagcggaacaaacacatgcccgag

SEQ ID NO: 66707 - DNA, 209 bp, Heterodera glycines
  Genomic contig location: Contig_ID=SeqID_37708; Location=1..209; Strand=+
  SCN-specific regions: Sequence locations=1-170,204-209
tgcaaatgccccattcgccgctgaacagaagggacagcaaaccccagtttggaggctagcaggccaacgtacagcaacaaacgggtgaatgcagtccagatacgccagctctgtccgtttccacctcatcggtttcacgtcctctttaactctctcttcaaagtgctttgcaactttccctcacggtacttgttcgctatcggactcgt

SEQ ID NO: 66708 - DNA, 153 bp, Heterodera glycines
  Genomic contig location: Contig_ID=SeqID_37709; Location=261..413; Strand=+
  SCN-specific regions: Sequence locations=1-153
atgggcagggatcgacctgaattcgacacaccagggaaacttggacggatgaccgaccgttgggggaagggaaatgtcggaaaaagcgaaggacaaaaggacgacgtatccctcgccattctcacaaaacaactcattcattctgctgaatac

SEQ ID NO: 66709 - DNA, 335 bp, Heterodera glycines
  Genomic contig location: Contig_ID=SeqID_37710; Location=803..1137; Strand=-
  SCN-specific regions: Sequence locations=1-202,224-274,298-335
tggacacacttcaaacaatggtccattacctctgctcttctatcaaattgtcaggaagccgacctcattgccctcgccggtgtatatcgccgatgaatatgtgagtcaattcaaataacaataaaaatatagaccgagaatcgaaatcatttaggcgaaacgcggtcgaaacatctactcacactacgccaagaacggtattgacaacagcaaaaatttgcagctcttcgcaaagaacaaaggggtggaatggccgctgcgcacttatgcggacatgaccaaagtcctttcttttcctcaacaccacctacctgagggagctgcgcatcaacgcc

SEQ ID NO: 66710 - DNA, 94 bp, Heterodera glycines
  Genomic contig location: Contig_ID=SeqID_37711; Location=631..724; Strand=+
  SCN-specific regions: Sequence locations=1-94
gtcttgttggcggctttgttctgtctctgcttgcccagtggaccgctccgacaatgggcagcacatcgatcggactgcttttcagtctctcgag

SEQ ID NO: 66711 - DNA, 799 bp, Heterodera glycines
  Genomic contig location: Contig_ID=SeqID_8018; Location=1561..2359; Strand=-
  SCN-specific regions: Sequence locations=1-51,73-226,255-324,347 -384,420-629,651-737,767-799
atggtggaaaattttaagactttgccgattttgtcggttttccgtggagattgtgagagaaacaaccccctcattttgacgtgctatttctaaacaaaatttcttactgattttctttaaattttgcatattgattgattgagaaagaaaaaattttagcacgattttgattggcaaaaagcttcgaaaaattttctgaaaaccgtccacttgttacttttttggcataaaaaatcaaataataaaattaattactacttttttgacggagtctaaaattgaatcggtgtataaaaaagtatggcaacgtctctggtaaattgggtcgttgatcagtctgtttgttactcattgatcagtcagacaaattgaccaaaaaaacggtcaaagctggaattttttcttttcaaaattaagaataatttaaaaattgagattagaactcttaattttttcagtaattattctctgtgacgtcactgatcagaaagtgatcaatcgttctgatcaaatcttctacgaatggatgatgttaaactgaccggataaacagaagtcgttctcctggcacacctttataaagagaaaaggctttgttggcaaattgatgaccttttttgatgccaattaaatttttaaaaaccaaccaattcattgatcagtcgaggaaagtaatcctcgggcagttgtcgccatgtcttcaaaaaatttattaagtttaacaacatttttcaagaaatgaatgatgatgaatgaatgaatgaattgtcaagaatcggtgccgagtttcgagaataaa

SEQ ID NO: 66712 - DNA, 76 bp, Heterodera glycines
  Genomic contig location: Contig_ID=SeqID_8018; Location=94..169; Strand=+
  SCN-specific regions: Sequence locations=1-76
acctcttctaatcactgttgtacctcttctgatcactgttgtacctcttctgatcactgttgtacctcttctaatc

SEQ ID NO: 66713 - DNA, 909 bp, Heterodera glycines
  Genomic contig location: Contig_ID=SeqID_8019; Location=3396..4304; Strand=+
  SCN-specific regions: Sequence locations=1-393,418-909
atgtcttcagctcgatgccggatggctttggggcccgcgctgttccgacttcggcaacatgtcactacggccgaaaatttgctggacgagcccatgatcaatgccgagacgaccgaaaaccttgaacaggaacgggggcacatcacccgtatcctgtcaaggatggaggtcgagctggacgcgtggggtgccatcatgaacggactgcaaggccctgcgagagaggcggaggaagcgtttttcactgcctttattcgagatgaccggcacttgacggagtggttggaagatgcgcgagaaatgctggctcacatagcagcagaactcgcagatgagcccaaccagccaatcgcggcgggaggacagcaaccagctgttgctgtgaatccacccgtgccagccgtgccattcgtcaacaatgccgcatttctcggcggtgccaatgttcaacagccagctgctgttgccaaccatgccaatcagccaccattggtgccaattaatgcccaaatcgtgccaaacttgccggctgttgctgcgcctgcgcctttagccactgctcggctgccgcagctcagtcttcctgttttttcgggcgaaccaatggaatggcccgcgttttggcagagtttcgagagtgccgtcgaccgtgccgcccttgagcccgtcgacaagctcaactatctccacggttgcttacgcggaaaggctgctcgtgccgtaaccgcctaccgtggaggggacaattatgcccatgccgttgccgcactcaggcgactcttcggagatccacggaaaattgccgaagcacttcagtccgaactgatcaatctccggcctgtggacgatagcgttggatcactgcaacacttactcgagactttggagcgtgtgtgccgccaactttga

SEQ ID NO: 66714 - DNA, 560 bp, Heterodera glycines
  Genomic contig location: Contig_ID=SeqID_37714; Location=50..609; Strand=+
  SCN-specific regions: Sequence locations=1-430,452-514,536-560
  Gene Ontology: Mol. function=low affinity sodium:dicarboxylate symporter activity; Cellular component=integral to membrane; Biological process=sodium ion transport
atgcccatcggcatcaccgctctgctgcccaccgtactgttccccgccctgggcatactgtcggcccgtgccgttgcccatgagtttttaaatgtatgtgcgtgcgttagttactgtaaacccctcacagaaccagaggcactagagacggatcgggggaccccgagatagggtctcttccaaatcccgatcgatcatgaagattttggaaaacgatcgggacggatctcgagtcgaggtctgtcaaaatttcccggtcaatcctgaaaattttgaaaaaaatcgggacgggtcccgagtcggtatccgtccaaacccccatcccgagcaatcccaatgaattaaaaaaaggctcgggacggatcccgaggtaggcaaatcctgcaggataaagcagatcccgtccggtctctatcaggcacacacattaaagtacattttgggtgtgggtctttttggtcattaaaatgcttttcaggacaccaactttctgttcatcggcggcctcgttgttgcggccgctgtggagaagtgcgggttgcatgaacgcgtggcactca

SEQ ID NO: 66715 - DNA, 212 bp, Heterodera glycines
  misc_feature (30)..(30): n is a, c, g, or t
  Genomic contig location: Contig_ID=SeqID_37718; Location=701..912; Strand=-
  SCN-specific regions: Sequence locations=1-212
acaaaaaaatcgattttttcaagtgtccgntttggggtactcaaacaattatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaaca

SEQ ID NO: 66716 - DNA, 798 bp, Heterodera glycines
  Genomic contig location: Contig_ID=SeqID_37719; Location=42..839; Strand=-
  SCN-specific regions: Sequence locations=1-378,400-559,588-674,697-798
atgaagattggaaaacgttttatatacaaattaaaattcaaggaagagattgtgcgtgtgctgatcgagaatggcacaacactggtgatcaagccaaacggtgccgagggcactgactcggctggcgctgtccgtgctgaacttggccaacagttggcgtccggctggcaccacgtggcgctgcatcgcgacgcacaaacgctgcgcgcaatggttgacgacacgcatgaggagacgctggcggcaccaattgaagacgcgtcggatttgttggtcagtattttgtgtagttttctcgggattttaactttttaaattcggattcgggaattggcttcgagactgaaaatttgctatgaaacagaaagtctccggactttctaatctaaattaatcaagttcatagttttttttttattaaatttgatcgagccttagcttgaaaatgtaagaaaagtttcctaaaaatatattttttttggcaaatttttttgaataaagttagttcttggttctttataaaactttaaaaaaaacgctatattctcttcttagaaacaaaatttttaagatttttttttaaatttcgaacttacaattagaaattaaaacaaaagatttctgggaggaaatggcaattaaataaattatgaaaaataaaaaccaacaataatacaatcaatcacaatgtcatcatctccaaattttaacaaaatcatgatcaggaaattcatatcttttcagctgttcactttttcatcgtcgcgtcaacttaattaatattcaagttaaattaaa

SEQ ID NO: 66717 - DNA, 382 bp, Heterodera glycines
  Genomic contig location: Contig_ID=SeqID_37720; Location=850..1231; Strand=-
  SCN-specific regions: Sequence locations=1-382
atggattcgcccaaatgccaaactttgaattttgcccggccgtttttcccaaataattttgtgcttttggaggtggaaaagtcggtggctgatgctttttcttcgtccaatatgatcactgatcaatttaatcacgaaaggtccattttgtgatacgattggtctttttcgtttctgtattagatcgatcggagcccttgtttggtctataatttggattttgaaaagcacttccattttcagtctttcgcttacaatccgtggccattgctctgaccctttggtcgtgtgcacttcgtcccgaacattcggcgcaaaggacgtcgaagtgtccaacactttgctgttgctcgacgggacgccaaacagcgccggagcaaat

SEQ ID NO: 66718 - DNA, 224 bp, Heterodera glycines
  Genomic contig location: Contig_ID=SeqID_37721; Location=191..414; Strand=-
  SCN-specific regions: Sequence locations=1-224
atgacattttacgcgtcccatcacattttacgagtcccaacaacactttacgcgtcccatcacattttacgagtcccaacaacactttacgcgtcccatcacattttacgcgtcccaacaacactttacgcgtcccatgacattttgtgtccatggcggggatggcattccgaggccccaaaaattttcggaaatcggaattccgtgccatccctggtctcatg

SEQ ID NO: 66719 - DNA, 350 bp, Heterodera glycines
  Genomic contig location: Contig_ID=SeqID_1037; Location=357..706; Strand=+
  SCN-specific regions: Sequence locations=1-11,162-350
gtggtataagaggcggtcgtggacgtgttggcggctttggcgtgagcggaggtggttttcgttggcgcggtgctgctggcgggcgcggagttggaggtgttggcggacgcggaggtgttggcggacgcggaggtggtggtggacacggaggtggtgctggtcagggatggcacggaattccgagttccgacttccgacatttttggggtcggaattccgacttccgacttccgaaaatttttggggcctcggaattccgacttccgacttccgaaatttttgatgaaaagtcggaatttttttgagttttttttttcaaaaaattagcaatttttgtacaatttatgtta

SEQ ID NO: 66720 - DNA, 3561 bp, Heterodera glycines
  Genomic contig location: Contig_ID=SeqID_1038; Location=787..4347; Strand=-
  SCN-specific regions: Sequence locations=1-16,39-1056,1079-1087,1109 -1727,1749-2024,2050-2867,2889-3248,3274-3440,3463-3526,3552-3561
  Gene Ontology: Mol. function=transcription co-activator activity
atggatacggatgtgaatgccaaccaggaagtgccacccattcaaacagaggaagagtttgaaaatgtggaagaaatggacgaatcacaaaattcggttttaaaatatttggtatgccaaacggacgcgaaaagcgtagttggaggcaaattgagtggtcagggccctttctttatgggcatcccggatgaaattgtaagcgctaaaaggcgtttgcaaatgggtgatgttgtgatggtaagtcaatgggtatggaaagtcggttttgaaaggttgtcgtacgacataaaccccgttgatgaaacacgtccatggtacgtacaaggccgaatcaatgtccaagcaatcgcacaaaatatttctgatgtgagtttcgttacaggtacgttttgcccagggatagtcactgacttaaaaaggtataagggcggagactttcggtcggcggtcgtaatggcatcccaaatgctaagaccacagacaatttatgcccgtcatttgaccgaaatgagtcctggaagggtaactttgaatcaggtgctttatctgcagttggcatccattacgagtcctcaagaatggtggatgggtgagaattatttattgccccatccaacgccttacatgaaaggagatgagattaaggcccatgcaaaccacgtggttattggtgccaaagattgtaatgattctttctgctttcccttggatacattttcagaaagattgatgggagcagcagcagcggtacaaaggacccacgaaatggtaaaattggccaagcaagctgtgactgttcaattggtctgggacagaccacaagtcagggatgaggaagttcagagaaatttgaaaaaggcgcaacttctctcttttgattggaccttaacaaacaaatcttcagtcgcagactttttagaagcatgggaggaagatacgccggtgaatgcaaaaattgccaatgacaccaaggcccattggtgcgctcatggacacgtcatttcggcatcggcaagtgaaataaacccgggaattttcacaataaaggtgaaattaattttgagttttcaggcaaaaaagggttatgaaaaggcctgggaggactgggaaaatattttggacgagatggagtcttatttggtcttggtaccgaattatggcggattaacatttagagaaatgtgcttcgaaaaaacgattttgtccgatattgcgcagggtaatgcccccgtctctcatattttaagggttttaatgggaaaaggaacggacgaaacgagaacagccgtcaggctgacagaaaaggttggaaaattgaacgaagagcaacggattgctcactcattgtttttggaccaggagacgcgagtaatttttatgcaagcccccgcaggtactggaaaaagtgtttccgtagcggagtgcattgccagtgtgctgaaaaaggaccctgatgccgccattcttgccgtttcccctctgaacgttgcggtgtgtgagttggtaaaagatacaatggaggcactaactgaaaaagttccaatgctggcacttttctctggtcaaggtaaagggcgatatatggacagaattcggcccctcggggacaatttgttggttgaggcagtccaaaggtatggaaatatccctcccacggaaggagcaccaggaaagaggtggaatgaggaaaaattatttcagaaatacgtggacgattttaaccgggcaccgagaagggcacgagagcggacgaccactgccgctctactgaacatgacgaaataccgtgtgtatttcatgaccctggcattggcggaggagttggcactggatttgggaaacatcaattatgtgttggttgacgaatgtggtcaagccacgctttcagccattctgtccacattaacccaatttcgcaaggtaaggaaaattctactaactggcgataagcaacaattacgagtgcatttgccaagtcaaatgcttccgattcgtggtaagtacggatttgagtcggttttggaggttttggaaagggccaaaggaattgatcgaactgtcctttcgcgttgttacaggtctcacagtgccattgtcaaatgcctagacgcgggagtgtacgcaccagccggtgaccgactcgttccaggaaaacccgacactgagatgtcattctttctgaatttcatgggaccacgaattgtcacagaaaattgtccagtcatactcattcaccaaaaaacgcccgctcaacaggaaagcgtgtcattctcttcacacaatccggaacagcgtgaaacggctttggaatttttggggataattcagcggaccttttcgggactaattcaaattgtttgtttttatcaggccgaacgaaagcaggtgacattggaaattgaaaggaggaattggcaaaatgtcaaagctggtacagttgattcgatccaaagtcaagaggcagatctcgtgatcgtcttgacaacacgcaccggagctggacggactgaagatgttaacattgggaaagaattctgggcggatgcggcgcgcacaaccgttgcggtttctcgaccacgttttggtttgattgtcattggcgacctcactctgttgtggcacaagggagaagtgtggagacggtttctcgaccaagcacttaaaatgacggttgcggtaacccctgactatattggcctaataagcaacccctggccgaatcgggtgggaaatacaatcacccggcccaatggatcagtcccaatggcctatgagttttacgcagaaagggatagcactttgagacatgagagtctaggccaaaggattaacacaactaatttttcctctcccagtttcttaggcaattctttctcagtttttgcacaccctgttttgccctgtgcgaacacttcttcccttgcaccatcctcggcacattcattcggcatgatggtcattgacacttccgttccaccgccagcagtgtatgctcggactggacgagcaggaccaaatgtacgcatgacgccttatccaccacaacgagagccacgaacgagttacgcagaagcagtcgaacatggccgaccagcaccgaaagaacgaaggacggatgttgtatgccgcagatgtggaagattcggacacattgaaaaacgatgccgaacgtgattttttttctgttctctatatttctcactcattcctttttcatcattttcacctctgggctttatcaaaaagtgatttaaaaaaaaaaatttaaattttcggataccaccaaaattttactcatcgatcggggacgatcgcttcaagggatggaggtgtaaaagggatttcttaattggatttttggccttttccgggacaaattccttcccgcattttccttcactttcccatctctttatctccgttcaatcagtcattttcttatccatttcatttccatccttcgccatccgcgttatatccatcattcacttcattttcacatttcgttttattcaccaatacgtgtggtttaattacccaagtttgagatgggagaataaa

SEQ ID NO: 66721 - DNA, 730 bp, Heterodera glycines
  misc_feature (69)..(69): n is a, c, g, or t
  Genomic contig location: Contig_ID=SeqID_1038; Location=4477..5206; Strand=+
  SCN-specific regions: Sequence locations=1-23,45-463,507-615,669 -697,729-730
atggctaagcggaccgtaataaagaaacttcaaagcaaaaaatcagtccaaaaaacgtggaacaattgngaggagagaaaggcgcagacgcagagggcgacagaagcccgtctggccaagaaaagtgagttttttcatcaattttaactcaaaaaaatcatgactcggtgtgtacaaacattcttggtatcattcgaaagcttaaagattagggaatttataaatacaagaaaagagcaaatactgcaatgagaaaaccggaaatgcatcattttacgcgtataatcacgaataattgtttgtctattgccattatctcataattttgcaacagaaaaacttttgtagacttcaagctctcgaatgataccaagaatgtttgtattgaccaagtaataaaaaaaggtatgacctataaaagtgaggatagtcactgattggacgtgtaaattggaatagagccaaaaaatcaacaatttataaaattataaacagaaaaacttagtggactttgatttgggcaaacactttatttttcctaccatcagttttccatattatttcaaaaaaaaacaatttttttaatgggaaaggtctgccgaagaagttttgcactatataaattaaaaatttttttattatttaatataattttaatttaattataaccaaaaggcattatcataccagcagattatcagtttgtaaatttacataattaattatttaa

SEQ ID NO: 66722 - DNA, 2733 bp, Heterodera glycines
  Genomic contig location: Contig_ID=SeqID_1039; Location=620..3352; Strand=-
  SCN-specific regions: Sequence locations=1-250,272-1202,1225 -1252,1274-1452,1474-1666,1690-1858,1882-2212,2235-2305,2330-2733
atggatgccatcatggaaagagttgctaattgccattactattcctctttggatttgtccagtggttatcttcaaattaaacttagtgaggaagcatcccgaaaatgcggtgtaattactgaagacggagtctatcaaatgacacatatgccttttggattaaaaaatgccactgcggcattttcccgggcaatggcaagagttttaacaggtctcaatgacaatgtaattgcatatgtagatgacattctcattttcacaaaatctcctgattttgaagaacatttaagtgcattacgtaaagtctttgagagatttaggcaattccgtttaaaattaagtccgaagaaatgcgtctttgcttcttctcaaatgaatttcttaggctatgttttagatgccaaaggttatagacctagtttaagtcgcatagaaattattaaaaatttacaagcaccaactaatgtgaaagaggtaaaacgagttattggtatggcttctttttacagaaggcatgtgcctaatttctctacaattgtcgaacctctgacaagtcttactcgtaaaaattctgtctttaattggggagacgaacaaataaaggctttccagaaaatcaaagaccttttatcacacgagccattgctcacttttcctgattactcaaaaccttttcatgtatttacggatgcctctttagtaggtcaggccggagtcctaatgcaaaagaataacaatggagtattttcggcgatttcgtattgtagcagaacattaagtgcctcagaaaggaaatggcccacagtccaaatagaattaggtgccatcatttatgctcttagagaatttaaaccctttattttcttgtctgatgtcgaattacatactgatcataaaccattagcttacttacttaaaaaggcagaagctcatcccaatttggcacgttggctaattgagttacaggcctatcaaattaaaattgtccacatcagtggaaaacaaaacagtttggcagacgctctgtcaagagcacaggaaaatatttcaattaaggaagtccaaaatttggacgaactggatgacattgctgaatttccaatttgcttgtctttgacaattgaccagagagtaatttttgatcctttcataaataatttaattcttagaggaaaggacgggcattcttatgacattgatttaaagaaagaacaaagagaagaccctcagtgttcaaaattgattaattttttacaaagaggcaaatttcctgatgaaatggaccctcaatctatggaaaatctcaccgaaaatgctaaaaatcttgttatggactcaggaattttatattttaaatattccgaacaatcaccaagaatttatttaccaatttcattaagatctctcatttttgattcatttcattcttcaccattaggagggggacacatggacctgaaaaagacattaaagaaatgtcgtaaatattattggcctttacaatattctgatattttatcctggtacaaacaatgtattacttgccaattaaggcattctccatctccagcttttagagctgaaatgcaaatggttcccgcaaatactttatttgctcgcgtaggccttgatttggccgggcccttcccaatgactattagtggaaataaatatattttgaatattatttgctggttttgtaagtatgtcatttcggtaccattacctgacgctaaatcacacacaatagcgatagcctttttaaagaactgctatttaaaatttggtggctgcactgaattagtcagtgataatgccaccgcctttacatcggaatttttccgagaattttgttcactattatatataaataaaaaatatgctgtaccccattggtctcaaggcaatgctgcgactgaacgtacctttaggacttttcataatattttagctaagtacattacgaaagaacagccagattttgacgaattccttgattatgctaatttttgttataatacatcagttcattcttctactaacgagaccccttattttttaatgtttgggcgcgatcctatattttgcatagatcaaattttagaccctaaagttagagacccggtagcgtttactgacgaaactgaatttaaacaaaaactagtgatctctcttcggagagcgtggaaaagtgcctcagaagtgcatgcagatgcacaagaaaaaatgaaaatacagtatgacaaaacaatgagaacgcctaagctaaaggaaggtgatagagttttgctaagaaattatgcgggaaaaataaatacatctaaaaaattccagttgccgtggaagggcgtctttaggataattaaaattgacggtatttatgctaccattgtaagttgcaattcgccccaaagcaacccgcgccgcgttcacattaatcaacttaagaaatgcgttgaaatcctaggaccagcttgcacttctccctggcttagtcccgaagaaaataatgctcttgtggaagcagaaagcgaagaaattgctgatttacctggtcattctcatccaattattataaaagaacaaatagagttacctgcgcaaaaccatgctaatgacctggttagtgatactcaaaacatagaaaatgatacatgcgaaccaacacaattgcctcattatgctttaagaaatcgtacaaaacttaacaaaccagcgcgatatttagattag

SEQ ID NO: 66723 - DNA, 2018 bp, Heterodera glycines
  Genomic contig location: Contig_ID=SeqID_1040; Location=37..2054; Strand=-
  SCN-specific regions: Sequence locations=1-905,928-1119,1142 -1352,1374-1545,1567-1732,1754-2018
atgtttaatgtcacagatatcaactttcatgcttttattcataatttagtcaaagtaagtgacataacttaccaaattcatcaacatgatactaaattatcttctgctttttccaatacttggcaaaaaacgagggatgaattacagaaggaaatttttggagattggtcttatatttggaaagtaataatcactattatttctttgatttcattgatcgatgttttgttaagatttggaatttttgcactacagatatatctgggaaatggtcgtttaggatcacttcttttaggaaaccaaacaattaggacagctcaaaatataattcaatcattgcctcaatcatccaattcacaaccctcccaatctcccattgaatcttttgacattaaatttgttcaagttaataaaattccatccccttcaaagcaaatgaactctcctcagagagacagcaaaagtgaaactatttgtgaatcaatatttatgcttcgttcttatgctgaatttaaagaatttggatttattcctgcaaatttagaccttccgattttcctaattaagattaatggtgttgaatttagagctttagttgatagtgcttctgaaacctcagttggctcagatcgaattctttatttagcaagtgtacccaaaagtgcacaaagggaagttaatatccgattcagatcgcttggaatgaacccactcgaagtttcgggtgattcattagttggaaaaatagttgcatgggctcatttagcaaaaggtgaagatattttaggagaagctcctttattgtttactgatcattcggtttttgaaaacgaatgttttgatttaataattggtgccaatttaatcgatcgttttggtggagtcacaatccttccaaaagaacgaaaaattatttttggttgcactctcacaaataatgttagggcgatatctcccatttctcaagtaaatgaaatttcagtagcagaaagtgaacaaagtatcaaaaaacggataccgacttcggaacggttcaaaagaaaggggcgttttaagcctcactcccaatccaattcaattgatgaagaaagtggatcaatcacctcgctttgaaaagatttctgttaattttcttggctcaatttcacctaattgctcaattattacatcacgaattaataatgtgaaaaacccaagtctggttgatactggagctagcattagtgtagcgccaaaattgatggctcctatttggcaatgcataccatatccaacatttgtcaatgttataagtgcctcgggtcacacacttgaacttactgaaaaagtttctgttgttttttctatagggaattttgaaattaaggaaaccatttatcttgtggacgataacaaatttaaaacatcagcctataatcttctaattggttgtaatatccttggtaaattgccaccttttacttttgactatcctaatagtaaattcagtgtaggtaattttatcaccccattaggctctttaccaaataattctctcttgaataatttaagaatccaagcaatcaattctctaattcttcctccgaataaagggaccataattcaggctcaatttgatccctcaatagtttctgataaacccatttatattcattctcttgataaaaaacttttgaatgaacatttcggattaattcctttaattgtggagccctttcgagggacagtgaaaattcttattattaatccaactgctatgccttttcaaatttacaagggtaaacatttggcttatgccgacgaagtcagacaaattaacaattatacaatgagtaatagctctgaagacctaatggccatgtcaattagtgaaggtgttgttgtcgacccgaattttaaaatagatctttccaaaagttctgtagtaggtaaagacttagaaaaactaaaatcgctgtgcgatgaattttatgatgtttttagtcaatctcaatatgacttaggttcatttacggagg

SEQ ID NO: 66724 - DNA, 2274 bp, Heterodera glycines
  Genomic contig location: Contig_ID=SeqID_8020; Location=113..2386; Strand=-
  SCN-specific regions: Sequence locations=1-222,253-308,371-703,733 -861,883-1122,1153-1385,1409-1413,1492-1722,1784-1949,1971-2072,2095 -2274
agatacgaaaagccaccaggcaaagatggaagcggaaacggaagagaacaaatgggaaatgttgaacgcgcggagcagggaggagcggaaaaaggccatggattgtgtcaagggctcggagttgattaaggcgttccagcacaaaatgttctcggatgaaacaacatcggagcaactgggaaagtctataagtgaatgaatttttatgtaatttaattatatcaaaaattaccctccggctgcattgggtggtatcccaatcgtattggcgaaaaatagggtttaaagacctttgaaaattcgtaaacaaaaaaaaaattattatttttctttaatttttttttgtaaatattttattattaatatttttcagaaagttatgtctattttttgaatatgtttggtcataactttctggaaacttaatgaaatattctgaaatttttcatgcttatagagcaagccaagagctatcgtaagatagtaagattatttttaggttttatttaagaaaagttatgactgaattttctcaaaaattctgtgaatttggcagttttacaaaacgcccatgttggcagtttttacgaaacgatccagcacgttacatatcagggatggcattccgaggccctaaaaattttcgaaaatcagaattccaaccccaaaaaacgtcggaaatcggaaaattttcaaaaaacacaaaatataataaaaattttctaaataataggctaatttttaattcttaaaaagtaaaaggtgatttcaaaaatgtatttggtatattcgcttgaaaaaagtattctggttttcataaaaatcttttcatgtcattttacattgtttttttgtggcgcgtttttccaaagaattttggggaatatgggggggagggcagggcgtccggcagtgccgataggcgccgccgggaaaaattttgtaattttttaatacgatttgttaagagactttgtcaaaaaatgatcaaatttagcgtttgagcaatttttcaagaaaattaaggatttttaaggcgcggcggtgccgaaaggcgccgccgggaaaaaaattgaaaatttcagttcaatttattaacagaaattgtagaaaaattacttctaatttttgaaaaaattaaaaaaaaaatttccgaaaatttccgacttttcatcaaaaatttcagaaatcggaagtcggaattccgacgaccaaaattttttcggaaatcggaattccgacccaaaaaatgtcggaaatcggaattccgtgtcatccctgttacatatgtacatattttatacataattcggactctttcacaatttttcttacatattttgcaatttttgaggattttttaagcaatttttattaaatacctcaaaaaatccaaaatttaacaatttttcgttaaatattttaattttttacatattttgagaatttttgaaaatttagaaaaatatcttgttaaaaaatttaaaaaatcatcctcctaatacttggcatagtttttcgttttcttcattattccgatctttgtaatttatttttttccaggaaatattgccgaactcaaagttgacgttaacaagacaaaaaagctgcacaaacaaaatagtcgcacaaggcgatcgcgtcggcataaagatgacgatggtgatccgatcaatttattaaaacgaaatttatctcggcgaggagaattttcatacggaccaccaccaccatcacattcatcctcatcatcattgtcatcatcatcatcattctcagcatcgcatcgtttacgtccaccgttgccgcatcggcgtaagagttcaccaccagcagaagtaaaaaatgttgatttgtcatcgtcccctgttgctggcacatcaagcggtccctttgatgttgccgaaaatgtacatggcttacctattttggatgagtcatacaaatttctgcgctctaattctgtgaaagaagcagaggaaaagcggcgacaacaaaggcagcactatgaagcggttgtgcgccgtaatgggtcaacaaaaagtcctaattgtatgggaggaaatggattggatgatgaagatagtgatgatgttgaggaaaaggtggaaaatgatgaacccaactttgatatggactcaccaagaaatgtccaacaacaaagttaccacgacggtggtcatcgccgccttgataaaagcgaaagcaaaaaaatgttggcagacaagaagcagcagctcgcggaagctgaagctgaattagaaatgcaactga

SEQ ID NO: 66725 - DNA, 1354 bp, Heterodera glycines
  Genomic contig location: Contig_ID=SeqID_8021; Location=64..1417; Strand=-
  SCN-specific regions: Sequence locations=1-100,122-293,316-414,442 -572,594-718,740-1159,1181-1306,1328-1354
atggaagaaattaatcccaaattaagtgacattttcgataagaccgaaaagggcgctgagttttcatttggcaatcacattttcaatgccgtagagcgcaaaaatggtatagtgggcaaattgttgtacgattgggagaagaagaaactgtacgaatgggaccgtaaccaaatgagcatttgggtggcaaaacagtacaaaaatccggacccgccggaacacagtgagttacagacagcatattactgtatatgaatgagtgtagtgttactgtatgtaaaatgaaggaacacatatataaatacattttttggatacggaacacagcgaattacaccatactactgtatgttaatagaatattactgtgtgcaatgaaaatgaataccaattggaatactactaatagtttaatacatttttgtggggaggggagaatttgtaacaccaaaaatttcatgacaaaggctttttaactttgtttgaagcttatggctgcagttaaaattctgctcaaatattgttctattttttagttcatagaaaattctaaaaaaaacaacaaaatgtgaaaaaatttttaggggttttcactgatttagatttttttttttgcccattttttaccttttttaattagggtcctctattatagttactcattttagaattcttctaccaatattacggccattaatttcagcctttcttttttggcatttaaaaaaaaatttaatttgttccattagccggcggcgcccattccttaattcattttaaaattccgtctccacgctctttgatcggtcattatttcatttcagggcacaaattatacgaacatgggctaacaaattcggacaatcacgagcgcatccacctgatcatccatgtgctgcttgtggacgcggtttttgatcgtttggcgcgcgacctttgcagcaagacggcatttgaagtccaattccgcaactgggccgcggtggccaaacaaatggagggggaggagatccgcaactacgtgtgcacacccttgaacaatgtaaactgcttgctgagtgcctgctgggctggtggtggtcatgtttggcccaagggtttatggccaaattttattgctaattatcggacccaactccgcgaccgaccctgggctggcaaaattcgccaaaatgtttttcggcacaaaaaaattgtcataatttctgggatatcctggatgaagcgaaacccggcttacgaccccaaaattcgggaacaacaactcggaatccattccaaaaagtctaaaaaattatttgttcgagagattttttcaaaatttaaattcagattttataaattgtcattttga

SEQ ID NO: 66726 - DNA, 804 bp, Heterodera glycines
  Genomic contig location: Contig_ID=SeqID_37723; Location=326..1129; Strand=+
  SCN-specific regions: Sequence locations=1-393,427-492,531-599,621 -674,723-769,791-804
atggtaaaaaacttattagtggaatatcgtactgagtgttttgtaaatccgcataaatacagtagttgggcatttacggcactttggctgtcaattactgtaaaaaacttattagtggaatatcgtactgagtgttttgtaaatccgcataaatacagtagttgggcatttacggcgctttggctgtcaattacggtaaaaaacttattagtggaatatcgtactgagtgttttgtaaatccgcataaatacagtagttgggcatttacggcgatttggctgtcaattacggtaaaaaacttattagtggaatattctactgagtgttttataaatccgcataaatacagtagttgggcatttacggcgctttggctgtcaattacggtaaaatctgtttcttcattttcatttatttattactgtggtattattttctcatcaaagtttttcgctaataaaaaaaattatctatgaaggaaaatgaattcctaattaattaattaattattaatttaattaattaattattatccgtatttaaagatcatcctttgtttgggattaacaatttatcatttgcttgttttggatttatcgtttgcattaacaaatatttttgtgggtctgtacatcggagcaatgatcgccagtttaatcgaaatttttgtaagttaaaaatttaatttattatttatatatatatattttttagattttttctttggtcagaaaatctaatcagaaattgtttgatttgcgccctggaaattataaaaatcaaccattaaggttcggtaccag

SEQ ID NO: 66727 - DNA, 922 bp, Heterodera glycines
  misc_feature (825)..(825): n is a, c, g, or t
  Genomic contig location: Contig_ID=SeqID_37726; Location=593..1514; Strand=-
  SCN-specific regions: Sequence locations=1-426,454-462,484-891,913-922
aaaattacggcggctggaaaagtacagtcgaacatgaatttaccgattgaaaacagtaattatagagatgttctgttgtatctcgcggggaagaattcaaaccattaatatgggcaagactatagagaaaattcaaatctccggcaggaattcaaaaaatttaaaaaaaaattcgcgagattaaatacagtaccgagtggcttccacaccgattggcagtgtgatttgtgcatatttgatcaattgaaaaagcataacgatggttacagatatttattggtctgcatcgacgtgctgagtcgaatgattttcagtgcaccggccaagtcaaagaagagtgaggacatgatcgaggtatttgatcgggtgttcaaaaagtcgaaaattatcccaatgaaaatatatagtgatagcggaatcgaattccaggctggaaaaatgaaaaagtattttgagggaaaatttattatcaaaaatgtcatgtatagtcccgacctccacaccggagtagcttaaagggcaaaatcgtacaataaagtaacggttatactgatattttacaaagatggaaactctacgatgggtcgacgtaatagataaaatagtctcaaacattaacaacagtgtgaataggacattgggggtcaaaccgtcttcaattaattttgaaaatgcccgggcgttctgggaaaaattatataaggagaaggaaattaaaatttcgaaaaagaacaaatttaaaattggcgatatcgtttgtattagcaaggaaaagggaaaatttgcaaaggggtatctcccaaacttctttaccgaagaattatntaagatcgttgttgttaatccaacgacacctggttcattcaagattgaacattttaaaggaaatttaataaaaagcatattttataaccaggagttg

SEQ ID NO: 66728 - DNA, 545 bp, Heterodera glycines
  misc_feature (95)..(95): n is a, c, g, or t
  Genomic contig location: Contig_ID=SeqID_37729; Location=1..545; Strand=+
  SCN-specific regions: Sequence locations=1-354,384-545
  Gene Ontology: Mol. function=protein phosphatase type 2A activity; Biological process=nitrogen metabolism
aaaaatttctcactccaaaggtgcaatgtgcgatatgctttggtctgatcccgaagtacggcatttttgtaccaagattttatgttattcttatntaattttttgaattattggtaaggagtgcgtcggcttcgctatcagtcctcgtggtgccggctatctgttcggttctgatgttgtgaaattgttttgtgaaaagaatggcgtagaaatgattgcccgtgcccaccaattggtcatggaaggatacaaatggcactttgacaacaccgtaagtaaaacgcaatgtttaacagagaaacagcgaaagatatttcccatctttcataggttctcaccatttggtcggcacccaattattgttaccgttgtggcaatgtggcggccattctcgagatggacgatgtactgaaaaaggaatttttgattttcgaggcggcaccgcaagtggttggaacaatatttaaaaaagaatattttgaatgttttggtttttcaagggacgaaacacaccaatgaaggggcctatgcctgaatatttcctt

SEQ ID NO: 66729 - DNA, 60 bp, Heterodera glycines
  Genomic contig location: Contig_ID=SeqID_8023; Location=1264..1323; Strand=+
  SCN-specific regions: Sequence locations=1-60
atggcgggaattggcaccaaattatggggggacagtggcggaggaggcggaggaaggacg

SEQ ID NO: 66730 - DNA, 1336 bp, Heterodera glycines
  Genomic contig location: Contig_ID=SeqID_8024; Location=2827..4162; Strand=-
  SCN-specific regions: Sequence locations=1-735,757-830,852-888,910 -1010,1032-1038,1074-1336
  Gene Ontology: Mol. function=protein tyrosine kinase activity; Cellular component=cytoplasm; Biological process=eye photoreceptor development (sensu Drosophila)
ggcgaatgcggtgtggttgtaagcgcatcgccagcacatcggctgccgattcaggacgacaaagatggacatttgatctactcaaatggggacagaattgacaacaaatgtaagactataggtggtcgtatttgtttttcccgtccgttttctcacaaaatttattaagattggaaatttttcgttacaaaatttaaaaacaattgccattttcagttgaaatcgtgaagactctcggcgagggaaccttcggcaaagtcgtccaagtgaaagacttaaacaacccaaaggggccgcaacgggcgctgaaaatcatcaaaaacgtgtccaaatacagagaggccgctcgactggaaattaacgttctgaggaagttgaaggacaaggacccggacggacgcaatttggtcatccaattgttggacagtttcgactatcagtgggttttgggtttggggaaaagcacagaaaacaaagcaccgctttcagtggacacatgtgtttggtgttcgaactgctcggactgagtgtcttcgactttatggtgcgccttttattccctttaaccgacaaaaaaaaaattccgtttgtccttttttcttgctattttttttacccctttaaagaaattgaacaattaccagccttacccaatggaccaggcgcggtatatcgcttatcaggtaatgacggtggtaatggttgtcggccaatggaataaaataatttattagtttccaattttcatttttatcataaatttggtccctttctctttttagctgatccacgcagtcaaatttctccacgacaacaaattgactcacacggacctgaagcccgaaaacattttgttcgtcaacagtgagtctgacgtggtcaacggcggggaggaagccaagcggaaaaagcaatttcgggttattaaggtcgaatggatttggaaaacaaattaaaattggaaaatgggcatttaaggacgcctctgttcggctgatcgaccttggctccgccaccttcgaccacgagcatcattcgaccattgtctccacgcggcactaccgggcgcccgaagtgattttaggtcagaatttcgcatgtcaacagtttttaattcccatcatgcattttttacatttcagaacttggctgggctcaaccgtgcgatgtttggtcaatcggctgcataatgttcgaattgtactccgggatgacgttgttccaaacgcacgacaaccgcgagcatttggcgatgatgcagcgcattttggatggcatcccttacagaatggggcggaaaagcaagtcagttttgagagctggacttatttgttaa

SEQ ID NO: 66731 - DNA, 131 bp, Heterodera glycines
  Genomic contig location: Contig_ID=SeqID_37735; Location=57..187; Strand=-
  SCN-specific regions: Sequence locations=1-45,76-131
atgctgtcgatctcaattgactttgacctcattgactttgacctcattttattaatatattttgattttatttttggtcatccatatatttatcacttactctacgacatattatctgaacagtcgtcaga

SEQ ID NO: 66732 - DNA, 55 bp, Heterodera glycines
  Genomic contig location: Contig_ID=SeqID_37735; Location=367..421; Strand=+
  SCN-specific regions: Sequence locations=1-55
cataaacatttatttgatttattttaccatattcacaatttgatcaaaatatagg

SEQ ID NO: 66733 - DNA, 1160 bp, Heterodera glycines
  Genomic contig location: Contig_ID=SeqID_37740; Location=5..1164; Strand=-
  SCN-specific regions: Sequence locations=1-840,879-1160
tgcccctcaaaattttcaattgattacattttgtccattcctgcgaaaaagccacgtcatggcattcaagcgggagctggaacttcatcggctaagtcagcaaaggatttcgtcaaaaaattggaaagcagtatcgagcatgtgccacggttccaatacgtcaaggccaaatcgaagttcagcatcgaggacgtcccagcgaatcccgaagggctgcttgccggcattttccaattttgcattgatgaggccgtcgtggaaagcgaacagcgcggagtaaaaccaactcatcttgggtgtttgatcagcagcccactattgactggcggtgacatacccatcccaattcgccaaatcactgacaacaccgtggacaccatccttaatcaattcaataaagttgcgcaaagcaaacaacagcaaaatgtgaccctatggggcgagccgttcacagttactgtgaccaccgttgaccgaactggacttcccgacaaaagaagtctgaaaggtggcgcccggcgcagtctggcatctgtacatcaccgtatcaatgatcggtgtttgatcaaagttcgctccaaagaatgtcaattttgacgagaaaaaattaagattcgaaaccaggatggatattgtcttttttacgccttacaagcaacgatggtggcaaaaacgcgtggatggcctaagtggcaattttacaactacatgcatagcagatatggtcaacagggctgtcttcagagagatgttttggacttaatgcagcaaactggtgctcggcctggtcttaatgcctacgaagccgaagtttttgttccaagagtggttgactattggaataacaacaatgaccaacaacaacaacaacaacaacagcgatttgctgtgtttattttcggctcttctggacaatacaagcctctctacaaatacataaacgaccgctatgacaccccaattgtgctgtacttcaacaacgaccatttcgatggggtgcagaaggagtatgggctgtttggccaaaactattgttttgaatgcgagaagccatatgatcgtccgtcgcggcacttaagttcatgcaaagcacactgtttgctctgttctcgcgttggaccacgcttcccatgctctccgttgagaggatttttccggga

SEQ ID NO: 66734 - DNA, 1172 bp, Heterodera glycines
  Genomic contig location: Contig_ID=SeqID_8025; Location=192..1363; Strand=-
  SCN-specific regions: Sequence locations=1-62,84-566,588-834,856 -946,999-1007,1042-1141,1163-1172
atgagtgtacaaaaaatgtaagcattttgccccaaaaattcgtaaagaatgccaaaattttgccgaattttccaaaaattttttaggcctcggcagagttcccgacggttggcacttgtcggctgtgtcatttcggtgctgctcctctacacatttctgtttggatggccaggccccaacatttacagcaacaaacaaccggccattgagcactgtgtggccgaccatatgatcaggtcccgtctcagtcccccgcggattttccatttttttttgaaatttcgaaaaaaaatcccctagattttttcgtttaaaaaaaccgctggatttttttgttttgtaaatgacgtcgttgatatggatggataatactgccgatggtaacccatcttttttgaaaaacaaaaaattttgttttcaaaaatcataaaatttgtttccaagggctttgtggtcgctgatcacgaatctggcgtccgtttcgaccaactccctacattggacccgaattcgaacaaaaactcaaatttttttaattcgcatttttggtctaaaaaatgggttaaatttttccaaaacccctacccctccgagggggttgaaaaatagaggcctaactaaaattttcaaccaattttttaggtttggttttattttttaatttccccaaaaaattttaggaaaggcatttcccatccgttggtaaatggacaagccgaggacggcacatattggcgaggttggcattgtgcaaaacaagcgatgaaaatggcattttggtgcccttccccctcaattttccatatttttaacccagaaaaccgtgtcgcttttgctggcaatggcttcctgggcattgacatggcattggaccgtcggttggtgctgttggccaacgaaagtggtcgttcccatttgcacaccggcttccacccgttggcacgtcatttattatttttttaaagatttttcaatttgaaaaaaaacaaaaaaaaaatctagcgaattttatttaatggaatttcaaagccagggcaattgttaagattattggtcataataaaaatccaaaaaaacactttattttttttagggttttatggcgacgaatacaaatacatacaattatagacgcttgctcagagtctattgagttgaccagaggtctgtga

SEQ ID NO: 66735 - DNA, 363 bp, Heterodera glycines
  Genomic contig location: Contig_ID=SeqID_8025; Location=2052..2414; Strand=+
  SCN-specific regions: Sequence locations=1-202,224-276,298-363
actttagctcaaatttcttagagaagagtgcgttctcttaatttttcaacaaaatttatgtgctccgacaacaacgaattgctgaaggacccttccgccgcccacaaattgacgcttttgttggccaaccgccaccgttgtcataaaagcagaaaaactttggccgattttttacgaaaaaaatttcattttcataaccgtcgtgtgaaaaactgtgccaccaatttgacgacgacgacaaaattttttaccgatattagaaagggttgttacacgaaaagcattgaaagaggaggaggaataagctaacaaaagtcgaggacaaagtgccgaaagtcgagacaaacgaacaaaaaaaagtga

SEQ ID NO: 66736 - DNA, 1272 bp, Heterodera glycines
  Genomic contig location: Contig_ID=SeqID_8026; Location=903..2174; Strand=+
  SCN-specific regions: Sequence locations=1-184,252-376,399-646,668 -669,719-817,846-1272
atggcgttgtgccattgcggaaattgtggagaaaaatttgaaacggacgtcggaggagacgattcgcgcctgttcattggccgcactgatcagtgtccaattgggtgtgtgttgtgccttttttttacacaaaaatgccaatagccaacccaagaaataatttgggtacatccaaaaacgtggcaaaaaaaaaaatttaaaatttaattattttttttgaaagcctaaatataatttaaaaaaatttttttgtgtctttttcttaatgtaatttttttcgaattaggccaggcataactaaaaaacttgcaaatttaaaacaaattgtggcgagattatgtcccagagacgttacggcgtcgacactttgtcactgttccctaaaatttaaaattttactctaaaattctacaaactttaaatttttcgtcaaaatttttatcttattgttcgtgcctgatcctacatctttttcttggccacaggtgttgatcttgagaacgagctgtgtgccattgtggaggcgatgtgccaaatgtgcgcggatggaaccgccgccgaagcggtgcgtgccgcgtgtgcccaagccgttggcatttgcgtctatttgagcattgaggtgggtggatgcacgaggattttcaaatttaaaatcattccttccccctgaaaaattaacaaaattttaaatttttttgcgatttatttttaaaaaaatcaaactaggtatcatataagtataaaattcttaattgaaattttctaaaaagatagatttcttttctttttttgcgctggaatttttcacacgaattcgaaaaataaaattttttttttttaaatttctcaacgacagagtcgtggccaccgtttcgctgcgttgcaaacgctcaaaaatgtttggcttggcatgcgaccgaccggcaccgacggcacttcgctgttctcatccgcaattgcctcatgggcactgctgttggaaagagtgagtcatcgtccaaattaacgaattaaaaattatggaaaatccgtaattaccggtggtaaaatttcaaaaaaaaattggtaaaaatccaatttatttttgcttaaacattcctcgctacaaattgcaattacaaaatctaattaattaattgctataattactagggttggtcgggaccgggaccaaaacacggacaactgagtatggaagttcccggtttttcaacccgaaaagtgccggtcccggttttgcccaaaattcccggtcccgacctactctattaa

SEQ ID NO: 66737 - DNA, 134 bp, Heterodera glycines
  Genomic contig location: Contig_ID=SeqID_8026; Location=152..285; Strand=-
  SCN-specific regions: Sequence locations=1-134
tggcaccggaatcaccgcagccgccaatgtccgctccgccgccggtcatcgacgagtgcacactttccaactcgtccatttcgctgagcaactccaaccgttcacggccacacaccgaaccgccaccaccacct

SEQ ID NO: 66738 - DNA, 867 bp, Heterodera glycines
  Genomic contig location: Contig_ID=SeqID_37742; Location=1..867; Strand=+
  SCN-specific regions: Sequence locations=1-147,169-261,286-463,488-867
  Gene Ontology: Mol. function=ribonucleoside-diphosphate reductase activity; Cellular component=ribonucleoside-diphosphate reductase complex; Biological process=DNA replication
attgagccgtacacttcaaatgtgtacagccgtcgtgtcctttcgggagactttcaagtaaaattgccaaaattttatggatgaccaaagaattcttaaacatgtaagattagtttctctatgtgttttaagattgtcaatccgcatttgatgaaggatttaattgaactcaatctttgggatgatcaaatgaagaacagactaatcgcggagaacggatcggtgcagaacatcaagcagttgccgcaagaaatcaaagacctgtacaagaccgtgtgggaaataccgcagaaggacattttgaaaatggccgccgatcgcgccgctttcattgaccaaagccaatcccttaacattcacatagcgcagccgaactatgctaaactgagctccatgcacttttacgcctggtcattggtcggttatcgactaattgttaataaataaatggttgtatattagttttatgccttttattccttttttataaaattgcgtaaaaaagaacacctatacgtttaggacgataataaaaataccatgaaaaaataaattcaaaaaataatgcaaattcgaccaaacagggggaggggtcactatgtatgttacgactcattaatgggtaccatcgtttagggacttaaaaccgggatgtattacctgcgcactcgtccggctgtcgatgctgttcagttcactgtggacaaaatggcccttcggggaacaattgccaaggacgaatctgtcgaaatcgacgttttgaaagacaaggaaaacatttctgccaattcggagttgcgcttgccgtccaaacgcaaatacaatgaacaattggaggagagcgatgggtgtttgatgtgttccggt

SEQ ID NO: 66739 - DNA, 56 bp, Heterodera glycines; identical to SEQ ID NO: 52733
  Genomic contig location: Contig_ID=SeqID_37744; Location=776..831; Strand=+
  SCN-specific regions: Sequence locations=1-56

SEQ ID NO: 66740 - DNA, 343 bp, Heterodera glycines
  Genomic contig location: Contig_ID=SeqID_37745; Location=594..936; Strand=+
  SCN-specific regions: Sequence locations=1-14,37-93,131-283,311-343
atgactttgttgacttcatcaagttcatctttggaagatttggctgcccttgacggctgctcaaacacatcagacattttggtaaaatcatagaattaattaacaaatcaataaaaaatatatttaaaatcttttggaaatgggatcccttagtttgagttaattaaaattcgaatttaaaataggtaccatttaaaattttatttgtttttagcttgccgactctttgctcagtgacattgaacattttgccacacattgtctggcacttcgcaatttattggccacaacagcagcagcaacagcacacaaaaacggagcaacagcaggtaaaatgtgataa

SEQ ID NO: 66741 - DNA, 318 bp, Heterodera glycines
  Genomic contig location: Contig_ID=SeqID_37747; Location=1..318; Strand=-
  SCN-specific regions: Sequence locations=1-69,91-140,172-318
  Gene Ontology: Mol. function=dihydrolipoamide dehydrogenase activity; Cellular component=mitochondrion; Biological process=growth
ggtgtcaactacaaagtgggcaaattccctttcgtcgccaattcgcgtgccaaaaccaacaacgacgtggaaggctttgtgaaggtgatcggcgacaaggacactgatcggctgttgggtgtgcatatcatgggaccggttggttttaaaatttcattcaaaaaattattttgcattttgtccatcaccccaatgttttttttttttgctcacagaatgcgggtgaaatgattgccgaagcgacgcttgcgctggagtacggtgcctcctgtgaggacattgcgcgagtgtgccatccacatccggtcagttggtttt

SEQ ID NO: 66742 - DNA, 751 bp, Heterodera glycines
  Genomic contig location: Contig_ID=SeqID_8028; Location=57..807; Strand=+
  SCN-specific regions: Sequence locations=1-458,488-680,716-751
atgataaaatttgaacaaaatgaccaaaacgagcaaaatgaaaacacatcaggagttgatcaaatgggtgaagaaatgggaaatggtccaaatgatcaacaaaaaagagaaactgtcaaaaaatttgatgcaattaaagaaaaattaaaagaaaaaggaaaatttgaatggaaaaaccaaagcaaaactgagagaaaaattgcgaaattattaggcacaaaccgaaattcaatacaaaaatggaaaaatgaattaaatttaaagaaaaacaacaaaaagaaaaaacaattttatgagcagaaaaagcgcaaattcattgaacaatttggtgaatttaaagaattatatgcccaagggaaacagaaagaatttgtgaaggaattgggcatttctaaagacacatttcgaaagtggaaaaaagaattggcaccaaaatatcataaaagtaaaaataagagatttttaaaaattttattattttatttttgtttaagcacaacataacaatgttgacaaattgaaaaagatgaagcaatattacgaaattaaagaatcaaatcctcaaattagtgaccgaaaaattacagagaaattgggaattacatgtcggactttgttaacgtggaaaaagaaatttgcctcattttcgaccatttgattttgcgggtgataatcggctcaaattttttttaaaaacaaaaaaaaaaattttaatgcgttaatgaacaaccctaaagcattttttgataca

SEQ ID NO: 66743 - DNA, 2365 bp, Heterodera glycines
  Genomic contig location: Contig_ID=SeqID_8029; Location=1546..3910; Strand=-
  SCN-specific regions: Sequence locations=1-77,99-2365
atggacgagttagtcacaggcattcatggagttttcgtctacctggacgacttcatcgtggcaacaaactccatggatcagcatcagcaaaccctttacaaatttttcagtcgtttgcaggaatggggattgcgagtcaaattcgagaagtgtaaatttctctgcaccgaactgaagttcctgggtcacatcatctcagcggaaggcattcgaccagaccccgaccgatcgcggatgatcaacgagatgccagcaccaacggatgagcaaacattacgctcttttctcggcgcaattaattattattcccgttttgtcagccaaatgcgcgagatccgtgcaccgctggacgaactgcttaagaaggatgttcaatggcgctggggaccggatcaacagcaggcatttgaaggggcaaagaaaatcatcacttcagatttgctgctcacgagttacgacccggccaagccaatcgtcgtcgcagcggacgccagcaacaaaggactaggcgctacgatcagtcacacattcgccgatggcagcgaaaaagtcgtcgaacatgcgtcccgatcattgacgccagccgagcgcaactactcccaaattgagaaggaggcgctgtccatcatcttcgccgtacagaagtttcatcgcatgttgtatgggcgaaaatttagccttttaacggaccataagccgttaatcagcatttttgggtccaaaaacgggatccccatttacacagcgtctaggctccaacgctgggcattaattctgtcaaattatgatttcagcataaggtacatctcgacgaaaaattttggccaggccgatgtcctctcgcgactgatcaaacagcatcgcgacacacttcaagaggaggacaaagttattgcttctgcacagatggcacaaaatttggacaattccgaggacgataacattgagttttgtgccgcagcagtcgactacatgttccaaacaacaattgatcaactgccagtcacggccgacgaaatcgcagaacacattaaacgtgacgaagaaatgaaaaaggtcattgaacattgcaggaatggatggccaaaaacagcaaacgaatcgaccatggcagcattttatacgcaccgactgcgaatcagtgaagtcaacggctgcctgctcatgggcgatcgcgtcataatcccatccgcactccgttttcgcattttgaaggcacttcatttcacccatcccggcatggtcagaatgaagagcctggcgaaacaatttgtctattggccaaaaatagacatggacattgaaaggtgggtaataaactgtgaggaatgtcgttcagcagccaaagcgccatcaaaagtactgcttcatccttggccatcatcaaccgaagtctacgaaagactgcacatggatttcgctggtccttgtgctgacggaaacaaataccttgttgtggttgactcctacagcaaatggccagaggtgatcaaaatgaccacgacgaccgccagcatgctcatcgaaaagtttgtttggttgttctcgcggtatggttttcctaaggaaatcgtcacggacaacggtccgccattcaaatcaaatgaaatttcccaattttgcagaaaccattgcatcaaacagacattttcaccgccattccatccgcagagcaacggacgtgccgaacgattcgtcgacacattgaagcgccaaatgaagaagtgcgcccgagacgacgtaaattgggtgcaaaattcgcttttggcctaccgaagcacgccgaacgcaagtttgaacgggcgaacgcccgctgaattgtttttgggtcgtccggttcggacaattctttcccttgttaaaccccaagttgacaagcaggaaaaaggcaacgacaagtacaagcagcggatgatcaaacaattcaatcagcaccacggcacacatgaacgaaagttcggcattggtgaccaagtgcagttcatcaactaccaacatggcacaaaaacttggttgaagggcatgatcgagtcaggcaatggtgtagtttggaaagttcaggctccgaagttgaatgccgtagtcacacggtattccaatcaaatgagaaaaatttatcccatcccatacaaagaacaccatgaacagttgcccgacgaacacccacagcaacaaccgccaaacgatcaaccggaagaagttcaacccagatcgccacgtcgtgtacgatttgcggacgaactaaacgaaccactggagagagcacaatcgccaccaacactgagacgatcaacacgcgaaagaaaggcaccgaagattttgaacccggatgcctcaaaagccagatatgattatgtctatcggg

SEQ ID NO: 66744 - DNA, 344 bp, Heterodera glycines
  Genomic contig location: Contig_ID=SeqID_37753; Location=322..665; Strand=-
  SCN-specific regions: Sequence locations=1-24,70-139,161-322
atgttaagcggtaaggaaattaggaaaataaaaatttaaaaaataaattaaattaaaaaaataaatattgatgacagaaaccgtgaaaatcggatttatcggagccgggaaaatggcacaggcattgggtaagcggagcaaaagaaaattgagaaaattcataatttaatttgaaaaaaacaattgtttagcgagaggacttatcaattcgggtaggaattgggcaaaaagaaaagtcggataaatttgtgataattagggcgttatccatcagagaatttgatggcgagttgtccaaaggtacgtaaaaccaagcaaaagcaaaaaaaaaattatttaataaa

SEQ ID NO: 66745 - DNA, 749 bp, Heterodera glycines
  Genomic contig location: Contig_ID=SeqID_37754; Location=157..905; Strand=+
  SCN-specific regions: Sequence locations=1-749
atgagcgaccacacaagagcgaaacgcaacgtgcaacccgaacaactcgcttcacagctttccgctgctcaacttgccacaacaatggcactctcgcagctctacttgaaggaatgccagcgcaacgtgcgcgtcagcaacccaacgcttcaggcacgaaaactcctcaagcgcgaaaatctgcaagcccgatggatcagcgaaacaacaatcgaagtgtttccctgcgttccaatctccctatccaacatcagctaccgaacaacaaaggactgctacaagttcattcctgtcacaatccatctgctaaacacaacacaagacgcattcctcgacccggagatgcgcatcctctcactcatctcaaagatcgcaagttgctctcaatttcgctaccatcatctgcaagtgcaacaaaaacccaacttgtgggtgcgaatcgactcaaaaaatggaaacgtccaacgattggcacaaacagccatccacgagctctacgaaacaatcctcaacaaaacggacaacgatttggatctccacccactgatcttccatcagtggcagctcgacaacgacaccaactttgctaactttccgcacatcgacgaattcgaagactcggaagacttcaaaaacaagctggaacaacacacgacccaacgagccgaagcactcggagctttacccggcggaatcgaaggatggactatcagatggctccaagaacggctacaggaagcaatccaatg

SEQ ID NO: 66746 - DNA, 83 bp, Heterodera glycines
  Genomic contig location: Contig_ID=SeqID_37755; Location=24..106; Strand=-
  SCN-specific regions: Sequence locations=1-83
atgcgtttctccaccttgggcagtgattgttcttcttcgtattacggactccccggaggggtcgaagagccaattacgacgag

SEQ ID NO: 66747 - DNA, 427 bp, Heterodera glycines
  Genomic contig location: Contig_ID=SeqID_37756; Location=240..666; Strand=-
  SCN-specific regions: Sequence locations=1-174,196-427
atgcttaaaggatgtctgtacgttatcttagcgttgattgctgtcagtttgattcgttgggcgaatgttagaggcgatttaagccttttggcccttaatttctcctgaaaacttagaaaattcaacataactctccccaaaagacatatttctgtacgcaaaataaacagaaatgtgaaaaaagatttgttctttcttatagcttgttttatcagtttctttttagtagttgttgagatttttcttagttttccaaagtgtccttattctaatgcaacaccccaattttggaaaaaaattcgtaaaattttttccgacatcctttcgtattcttattgttagaatcttaatatttcagaattgctacgtacagttaaaatttcagatcgattggttcatgggaagtggtcaaactcccaaaaaatag

SEQ ID NO: 66748 - DNA, 1585 bp, Heterodera glycines
  Genomic contig location: Contig_ID=SeqID_37757; Location=1..1585; Strand=-
  SCN-specific regions: Sequence locations=1-292,314-898,920-938,962 -980,1003-1287,1309-1585
atgctttccttgctctccttactgctcgcttccggcacagtgcttaaggctgacaccgaacgatggacgtcacaaatctatccgaacccacggcggaatcacacgggctgcaacacgtgggaaaactccacgctgtgcgaccccgaccacattctgacggaccaatggagggcacagatcaacgagaacatccgaagtcaaatgacaagtagaagaggggattggttaacgggaaaaagcggaaaaccaaagaactgacaaatgccaatgtaacgttagcggaaaaggcgccggcagaatgccaaaatcaaagcgagaggatcactatttatgtgctgctggccaaacaaatttggacaccaaataacaaaagtatccctggaaacgatttggtaggtgacgaaagaacagatttaataacgccaattcattaattgttgacttttttagacaaattttggcgatgaattggcccatcggtacggccttaatgatttgtcatgcaaaacattccttcttctgattggaattgaagcagcaaaactcgcttatgtgagggttggtaaaggcggccctcgcggtgttctcatttgtcggttcctccgtttgttaagacgggaaaagactttcgaatgccggcggatttgatgcagcgggtgttccacgagtacaaactgttcagcgcaaagagcttcatggcaggactgaacaaaataatagatgaaatcggcacacaattggacgatcctttcaaggtaaaattggaacgaagaacaaaagggtctgaatggaaatgaaaggagcgggcacagaccatggccagcacagccctcggcaaatgccaccgacacggcagcaacttcgctatccgagattgtgaacgcattgatggaaaagaacggggacggagagggagggccaaatggaagcgcaacagcggcgccgagcgggggccaagtggacggggaagtgcgagtggcggagagggaggaacagcaggagaaaacggcacggcagtacaatggcacgccaatggtgacggcacaatggtaaagagaagggagtaggggggtgatcaatggataatcaaaaggggaagggctctgacgccccaaacgatcgacgactgttaccaagggcccatgccatcagacaaatgctcgtttctccttactcccgtggatgtttgtcaaccatttgtcttgcgataaatttccaccacttgccataatatccgaggccgacccgcaaactctttttaaaacagccaaattgacaacagagtggtcgcagaaggaaacagtagaattatctggcagttcggcagatttaacacaatggctcgaatacatcatgaaacccgaataactgcccctacatatttacactatttaaacaattctgtttttttcaatttgttacaaattattaaaaatgaacaaaatttgtattcatcaagtaaaatgttgtcattactgtccatgtcattatgaaatttgtaaaagatgtaggacacaaagtctattgcattttggcaccgtacacttcccctgggcagaaaaatgttggatgtgcccaatatgtg

SEQ ID NO: 66749 - DNA, 400 bp, Heterodera glycines
  Genomic contig location: Contig_ID=SeqID_37758; Location=1..400; Strand=-
  SCN-specific regions: Sequence locations=1-245,269-400
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgt

SEQ ID NO: 66750 - DNA, 288 bp, Heterodera glycines
  Genomic contig location: Contig_ID=SeqID_37760; Location=64..351; Strand=-
  SCN-specific regions: Sequence locations=1-68,143-288
atgttttgctgctcaattttcttcttttttcttttcatagaaagtttctgtgcattgaaagcaacaagttaaatttttatttttaaaagcaaaaattgaaaaaaatttttaaaataataattttaaaaatatttgaaattttcagcccatttgaatttttcaccgattgtcagtgaactcgcgctgaaaattgttgaagaatgtttggatgaatacggacaattggtcgaaactcgaccattcataaaaagaatttcgagccccgaaacggtgttcaaaaattattga

SEQ ID NO: 66751 - DNA, 653 bp, Heterodera glycines
  Genomic contig location: Contig_ID=SeqID_37761; Location=60..712; Strand=+
  SCN-specific regions: Sequence locations=1-546,608-613,636-653
ttggccgagttcaaagacagacgggcgaacgccagcgaaaaagtcattaaaatggaaacaattcgggagagcatcggcgacaaggcggagcaggtcaaacagttggagcagctgattgccgccaccggttgcgagttgtccgagacggaacgtcaattgcgcaccatggaacgctcgaagcaggcaaaaattgatgttcaaaaatcaattttgctatggttttcaaggagttggaaacgactgtgcagcaaaacttgcgcaaaatggcactcgacgtggacagcatcaacggcacgctggacaaaatcacggagattggcgaggtaaatgtcaattgatatttttagcattttccttctctttgttaatgtatagtaatcatttatggcctataggtgttcctgctccttttgacggctattgtcatttgcgagtgcggcgcaggaagaaaaaatggtcaggcgggatgtgagcgacacaccgttggacggggcggcggaggcgcaaccggccgaaacggagcaggatcgaagcggggaggaggacgtggcggcggtcgcggtggtggaaaaggcaatggccgcggcggtggaagaggcggcggcgggaagggaggagggagggcgcagcagccggaagctgaggaggacgag

SEQ ID NO: 66752 - DNA, 797 bp, Heterodera glycines
  Genomic contig location: Contig_ID=SeqID_8030; Location=832..1628; Strand=+
  SCN-specific regions: Sequence locations=1-765,796-797
atgcgaatcgaagtcggacgaggaaaggctcagactagagatacgatcagagccgaaacaaaccgcgataaaagtgcagtttgggatggaataactgaacacagcaatccatgggatggtaatgatgaaaagttacagttaaatgtgcatggcgtggacatttgcgtcagtgacgaggtggtctcccaactggcgccgttcattgaaaaccccgcagaaaatgcacaccctccagcacttgagctgtccgtacagaagtgccggattgaaattaaagtaaatatttgtggggtttaagaagttatattaaaataaaaaaacttggacaacaggacccgaagaagaaattcccaattcggattggatttgatgaactcaaattcgaagacggaccagtaagcagcaaacaaacaagtgcttcctagtgattgaacctggcatatccgcgttttgttcctccatctcggggatttatttggccttttgattcttttttattgtggatgatcgaatgttgaacgcttttgctgaccatttgtttgaaactagttcctgtctttctctccacagttcattagaaatgcgttcgttgtttgttatttacgggatcgtttttctttcttttttctaacatatcgtgctcaatttaagtctctgttgatgtcatattgtactgtgttacaacaccaatgaaaaatgatcaatgaaatattttcggtaacgaaaaaaaacttatttttataattttagaatctatttgtttccttaattttattaaattcatattatttatttca

SEQ ID NO: 66753 - DNA, 890 bp, Heterodera glycines
  Genomic contig location: Contig_ID=SeqID_8030; Location=2840..3729; Strand=-
  SCN-specific regions: Sequence locations=1-294,317-345,367-367,389 -501,523-552,576-615,650-749,772-890
atggctcgtttctttctctgttcagcgatattttcccctctcctccttctgatgctttttgacaaaattggggagaagggaatggtcgaagcgggctgctgttgttgctgcaagtgcgtgggaaaccatttgagcaaattcccccccccccccccctccgccaatttttatgaaagagttttcgatatcttagggccgtaattaagccattttcgtaagacacgagttcgaacctaaaatcaaaaaataaaacaaaaagtcgaaaatatgagttgtatttgccccaattagcaagtgctgctgctgtccctgctgttgcacgtgctgttgttgtcacaaagtgagtaaaaattgtaaatggtatcagaaaaacaattaaattatttttacaatttcaggggccaatttgcataaaggtgggcacaccaatatttaattcatcggttattatctccgtcataaaattaacttgaccaccgatcactctgttatgggggaggctcgaatttcacaaaaattcaagaattgaggatttcgagcaataattattctcccgcttcttcctgctgtccatctccgccccccccccctccgttcagttgccctgcgtttgtccctgctgctgtaagtgttgctgctgctgctgtcagcctccctcatgttcgactcttcctaacccttcacttttaagccttttccctttaggccttagctgcggcaggcgaaaacgcgcggccattcgcttcttcaaaaggaaggcttgggaaaaaagccaagcggaggaaaaattcgcaaaatatttattcagccgatcggtttgagcagaaagacaaaaaatagctgatcagcgcttaattatattgtgagatgaaaggatttctattaataaa

SEQ ID NO: 66754 - DNA, 228 bp, Heterodera glycines
  Genomic contig location: Contig_ID=SeqID_8030; Location=4420..4647; Strand=-
  SCN-specific regions: Sequence locations=1-228
atggattatgtgaaggtgctccttcccccctttgttctttactttcgttttctctcaatttcctcctttttcactttttcagagtttgcctttgcacgacggagtggaaaaacagcagaagaaaatggtcggagatgcattaaatcaaaacgttgaggacgaaaatttgcgcgtttatttgttaatggaaatacaggccaagggattttaaacgaaggcaaaaataaa

SEQ ID NO: 66755 - DNA, 96 bp, Heterodera glycines
  Genomic contig location: Contig_ID=SeqID_8031; Location=384..479; Strand=-
  SCN-specific regions: Sequence locations=1-96
tctccaatccgtcctttcgaattctgttcaaaaggctttcagacaatcattgtcgcctttccctctcctcccaaatgcacaccgtcgtcccaacga

SEQ ID NO: 66756 - DNA, 56 bp, Heterodera glycines
  Genomic contig location: Contig_ID=SeqID_8031; Location=655..710; Strand=-
  SCN-specific regions: Sequence locations=1-56
gtgaccccccattttttgactaactcacagaccactaagacgaaaaaaccaactta

SEQ ID NO: 66757 - DNA, 507 bp, Heterodera glycines
  Genomic contig location: Contig_ID=SeqID_37762; Location=10..516; Strand=+
  SCN-specific regions: Sequence locations=1-336,497-507
atgccggagccaatggagttggatcaagagcccgggacgtcaacgtcaacaagttcagcccggcccggaccatcaacaaatcaacaagtgatcagctcgctaatgctgatcagcattctttgcctactcttcaccggcacggcacaaggacaatcaagtcgacaaaagcgattcgccgaaatcaaaacatggcatggcggccatgtttccaacttcttcaacatctttacggagcgcgaccgacgagcatcaacgaaatacagcccttacgttcaacgatacataaacaaggttctcgcattaaaccgaagtttgagccaatcaacaaatccgctgacaccgacaactccgacatggacaacgacacaacccacaacaaccacaagtcaaccacgcacaacgacaacaactgcgactacaacgaccacacgcacaacaaattggccaacaaagtcaaacacacggccaaccgcacgaataacaacgacaacgccaatgccatggtaa

SEQ ID NO: 66758 - DNA, 636 bp, Heterodera glycines
  Genomic contig location: Contig_ID=SeqID_37763; Location=338..973; Strand=-
  SCN-specific regions: Sequence locations=1-194,216-259,284-449,472 -522,545-636
atgaagcgccttatggtgctggcggtagcggggaaggttgccgaggtgaaggcggtcgggcattcgtccggctgggaagaggacgagaaggattggtgccgcgtcgccagaaaggtaactgaaaaatgaattgaaaatgaccagttcaaattggcaaaaccatgcgtttcggtctcaaaaaaaaattttttgtaaattttctgactcaaaactttgtttaaaaatacatggaaacaaagcgaaagtcatcactgtttcaataaaatataatttcaactatttttggattaaaaatggaaatttgttagagcttttgttcgaattcggattagaattggtcgagagggatgccgaattctcgaaacgtgtttttagaaattacaaaaaaaaaaaaaaatttctgggaccagtaaaacacattgttgccgtttaattgcagcctcaagacttaaaaaagtgaaacaaaaataaataaacttataatttaagcttgccatgacgtcgacaagatgggcagagattgaaggggaggaggagaagagggcgtttgtcaagcgggaggtccggcggttagagggatgggccatgagaacggcccggaaggagttggacgccgaatggccggatgttttgcgg

SEQ ID NO: 66759 - DNA, 944 bp, Heterodera glycines
  misc_feature (908)..(908): n is a, c, g, or t
  Genomic contig location: Contig_ID=SeqID_37767; Location=291..1234; Strand=-
  SCN-specific regions: Sequence locations=1-376,416-452,482-944
atggaaaatatatcaagaattaagtaagtaccaatttcaattcattttctggcgaaccactagtcaggatcttatccgatcagagttaaataaaatataaattaagcgctctgaaagctctatcgaactatatagagaagttggaaaaaattagaaaaaacttattcaagaaccctgaagatttgtcgggaatttattttgcctaaaatagggtggaaaaatattgtgggataattaacttatgatgaatttcagattttgaacttgagaaaattttaaaaaaattacttctttcggactcggaaatttataagaatttttttaaattcataaataacccaaaatcgatgttgttaattttctatttgttaagttatttgttaaataaataatttcagctttttgattcttctagaatggagtcctttatccatatttcgcgatttatgtccatatttccacattttttattttggcatttatcaaaaaaacctctattcgagattccccatcagctaaattggcctttttgaactctaaataccggaaattttccgaaaaaaaatcattttttttaattttctcgaaatattgttaaattcaaatttcccaaatttcttaaaaattggtaacatctgtgtaaaaatttgtttaactaacgttataacgccgaaatttcattccaaacccactataacatagaaaaagcaacgcttatcgcttaccaaatcattggccaaatggaaaatcaatgaatagttggttaacaaccggacgccattcgtatttggctcccaatttctgtgcattgtgaatccaaaagccacggactgcttttgggcggaccaccaatttctcggcgttgtacgtttcggccgcgcggatgccatccgacaacaatttgcgcnaactgaactcagttggactgctcactaacaaataaa

SEQ ID NO: 66760 - DNA, 566 bp, Heterodera glycines
  Genomic contig location: Contig_ID=SeqID_37768; Location=1..566; Strand=+
  SCN-specific regions: Sequence locations=1-566
  Gene Ontology: Mol. function=DNA-directed RNA polymerase activity; Cellular component=DNA-directed RNA polymerase II, holoenzyme; Biological process=transcription from Pol II promoter
aactcctgccgagactgagacaacaccggccgagactgagagttcaccagccgagaccgagacgactccagccgagactgagacaactccagccgagactgagacaactccggccgagactgaaacaactcctgctgagactgagacttctccagccgagactgagacaaccccggccgagactgagacaaccccggccgaaactgagacaactgcagccaagactgagacaacttcagccgagactgatacaactccagccgagactgagacaactccggccgagactgaaacaactcctgccgagacagatacaactccagccgagactgagacaactccagccgagactgaaacaactcctgccgagactgatacaactccagccgagactgagacaactccagccgagactgagacaactccggccgagactgaaacaactcctgccgagactgagacaactccggccgagactgagacaactccagccgaaactgagacaactaaagccgagactgaaacaactcctgccgagactgagacaacaccggccgagactgaga

SEQ ID NO: 66761 - DNA, 129 bp, Heterodera glycines
  Genomic contig location: Contig_ID=SeqID_37769; Location=396..524; Strand=+
  SCN-specific regions: Sequence locations=1-129
gccgctccagcggatggcataagaggtccacacgaccgacggaaggcaaaatacatacggcaagacaacaacctgcaagctttagtcgctgatttgaccagcgtgatccgcttgaataccttcgcgcat

SEQ ID NO: 66762 - DNA, 49 bp, Heterodera glycines; identical to SEQ ID NO: 60106
  Genomic contig location: Contig_ID=SeqID_37770; Location=402..450; Strand=+
  SCN-specific regions: Sequence locations=1-49

SEQ ID NO: 66763 - DNA, 227 bp, Heterodera glycines
  Genomic contig location: Contig_ID=SeqID_37771; Location=1..227; Strand=-
  SCN-specific regions: Sequence locations=1-87,109-227
gttcgctattagccaataaattttcaaaagtttcatttgaatcttttttttcaatcacttagattaaaagaaaactcttagaataataagaattgggcaaatgttaggcctcggatgggaatcgaacccactcgtgcaccctttccatgggcaagctctaccattgagctaccgaggcacatccgccctttcttttatggattatcaagcccgctttccacgtttta

SEQ ID NO: 66764 - DNA, 1091 bp, Heterodera glycines
  Genomic contig location: Contig_ID=SeqID_8033; Location=899..1989; Strand=+
  SCN-specific regions: Sequence locations=1-37,67-141,178-375,400 -401,423-446,469-753,775-1091
atgaggtagtctattatttttacagatacactatcacaaaatttttcataatctttattgtgttggattatgttttatgtatatcattgcatttttcattattttatttttattagggtgggaaataagtcctgtcatagcattttattttgttttataattttttatgatttttatcagcttcccaaaatgcaattttttcgtagttttttgaatgaatcttaattccgagacctagcaataggaaaaaacaattatgaataccgtacctattgaattagtaccaccgggggttctatttttcaacccccctcgaaaggggggttatattacagagggaggttctaattcagaggggggttttttcaacgctcatttttcaaaaacccaccaaaaaatggctacttattttgtaaacatttcgccaaaaaattgattttttttgtaatttcatttgttttattcattctccatatttttcatcttttacgaatgacggacgagagaaacccttctgcatcgttaaaaaaggtagttcaaaattataggttttaggtacctacctgttcataacttgttcattatacaattaatttcaatttaggtgtgctgttactgcaataacatctgttctggagcgcaccagtgccgcaaatgctcaaagccgtgccatgcaattgctccgtgctctttttgcggccgaggactacgagggattcagcgcaaaagtcacctgctgcaactgttggctcaacgatgatgacgatgatgttgtgatggacaaaaaagcgaacttcgccggtataaatgaagcgacaaacaatgaccaagacgacgacgcattcgaacaatttgccaacagccaaatcatcggagaggacaatgacaagattgatgcgtcggcttcatcatcaactcacaaacgtcgcggatacataatcgaagagaaaatccgcattttggactgcgccaagatgtcgtccattcacgtcgccagcagacgcttcagcatggaccgaaacacaatttgaggctcgaagaagcaggaggcggcactgaggaaaatgtaaatttaagtgttgtgtttttca

SEQ ID NO: 66765 - DNA, 583 bp, Heterodera glycines
  misc_feature (129)..(129): n is a, c, g, or t
  Genomic contig location: Contig_ID=SeqID_8033; Location=4931..5513; Strand=+
  SCN-specific regions: Sequence locations=1-583
atgtgcttatttcatttgtctcaatcggtattacgttatgtacaggtaaaaatacctttgttgcccctattattttacttcagagacatggtcttatccgtgaatatgaagctaatgaaaacttagaanaatatatacgctcattagctgcactcgcttttcttcaacctaatttggttgagggttctctagacatattgtatgcacgggctccaatggtagctcgtcctgtttttgaatattttagaaagtaatgttgcaaattattcgtctttaattagatgttttagaacctatataatcagggataatggtgaacagccattatttccggttgatagttggaatcatcaccaggcggttattgatgatttatgtagaacaaacaatgctcaggtatcaaacttgaggggtcaaaccgatttgttattaaaaataatttaggaagcatttcatcttcgctgcccgtcaaaatcccgacgcgtcataatcccgatgcgtcataatcccgatgcgtcaaaatcccgacgcgtcgaaatctcgactaagctaaaaagagtcataatcccgataaatttaaaaa

SEQ ID NO: 66766 - DNA, 592 bp, Heterodera glycines
  Genomic contig location: Contig_ID=SeqID_8034; Location=410..1001; Strand=+
  SCN-specific regions: Sequence locations=1-47,69-154,178-236,258 -285,309-558,581-592
atggaaacgtatttaagaagttagagctaattaagtaaaaatggtcattttcgaggtaggtatttttggtggctgattttgagaaaacgaagagaggatacagaagctgagaaatagtgattaaatagagcaaagttagtactataagaatactaaaatataaagttttatttcataaaaattgaattattgggggggggccgagtctgaaagtggtttccagaaacggcatttttcaaaaccatcaaataacaaaattctttaataggggtcttggaaattccgaatttaattgaactagttaaaccgaccacgctgagttcgaacatagccttagatttgatctctgaattctcactgaacctgtacagctccaacttcatgcatggaattgaagcagtacaagctcaagtagcaaagataggtcagatttaagaccatattcggattctgctggtctaatttacagaaaaagtttgtctttgttgtatcagctttcattttcgaccataaaaaatccgagaaaaattagtaagccaatttccaattttggcatggtttggaaaaaaggcagaaaaaatcgatcaagcaa

SEQ ID NO: 66767 - DNA, 495 bp, Heterodera glycines
  Genomic contig location: Contig_ID=SeqID_37773; Location=1..495; Strand=-
  SCN-specific regions: Sequence locations=201-242,277-311,385-495
gggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggtgcgggtcgccgggccaccgggtggcccgacttaacaccaaaatggacacccttgcgagcgcactcccgttttaccgattaagtaaggaatcgat

SEQ ID NO: 66768 - DNA, 921 bp, Heterodera glycines
  Genomic contig location: Contig_ID=SeqID_37776; Location=239..1159; Strand=-
  SCN-specific regions: Sequence locations=1-20,42-276,298-553,575 -808,830-921
atgccaaaacaaaacgaaatcgttttaaaatattcctttctggacttgacttggtttcttgatatcgaagctgttttctacgctatttctaaaacggttgtaccaaacccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 66769 - DNA, 756 bp, Heterodera glycines
  Genomic contig location: Contig_ID=SeqID_37778; Location=143..898; Strand=+
  SCN-specific regions: Sequence locations=1-287,309-756
ccgactcagcgacttcgcttggatggaaacattggcgtggctcggtcgtgcagaagtgggcatgaagctggcgctggtcaacacccggttcaacatgctggtggacaagcaattcatgctacggcagtggcgctttggcgagtttcacatctgcgagcgggaaggagcacaacgaggcggcgcagaaatcatgacatcggaagacggcaccaacttcatcacgttgccactgcccaccacgccgatgccgagcagtgtcgtcggcttccaatcactctccatttggttgaaaaaattcaatcaattttcacaatttccccccatttttgcaggttcatcaacgcggacgtcatcaaatttctgcgccggattcgccgtctgttcgccgaggacatcgcactggaattctccactcggcacacggagtttcgcagttggcaagtgattgcgcgacatgtttggccactgttacgggacgggatcagcacattggtgtgcctgaggaagtgcgatttggccatgctgcgcaaacacgtgtcgccgaccgtgctgttcgactgccctgacctgcaccaaattcgcacggatatggtgcccgagtgtccgtccgatgctgctgaaaatactgacccaacatgccgtgagctgtacacgtggattcactcgccgcgcgactatcgacaagcgccgatctccgtgaaactcatcaaatggaggcagaccaaatgggacgagtttatgaacaatttgtgcagg

SEQ ID NO: 66770 - DNA, 225 bp, Heterodera glycines; identical to SEQ ID NO: 50965
  Genomic contig location: Contig_ID=SeqID_37780; Location=434..658; Strand=+
  SCN-specific regions: Sequence locations=1-225

SEQ ID NO: 66771 - DNA, 159 bp, Heterodera glycines
  Genomic contig location: Contig_ID=SeqID_37781; Location=684..842; Strand=+
  SCN-specific regions: Sequence locations=1-159
atttataaacgggcgcgaagcgcccgtctgaggccgcgaagcggccttaatagcccaacaaatttataaacgggcgcgaagcgcccgtctgaggtctcgaagctgcgttaatagcccaacaattgagaaacgggcgcgaagcgcccgtataagcccaac

SEQ ID NO: 66772 - DNA, 191 bp, Heterodera glycines
  Genomic contig location: Contig_ID=SeqID_8035; Location=130..320; Strand=-
  SCN-specific regions: Sequence locations=1-53,75-191
atgccattgcacattagcaatttcaacggcatttgccaactgaggccggcccagtttggcattgtgttggaatggatgaatttgggcagtgtttgggcatttctcagtgaacaaaaaacgaattcggcaaacagtgtaaagcagttggacagcaaagatttgttgagaattgccattcaagtatgggttgg

SEQ ID NO: 66773 - DNA, 366 bp, Heterodera glycines
  Genomic contig location: Contig_ID=SeqID_8035; Location=627..992; Strand=-
  SCN-specific regions: Sequence locations=1-12,51-62,88-163,185 -236,273-331,353-366
atggccaaacgctttgttggtgagaatgtttttaaaattttatttgaaaagatattaactgctaattttatttttaaaattaaaaaagcaattttaaatccattttataaagcaaatcaaaagaaaaaagcaagctttgcgacaacatctgctgcagatgataataaatttgcaacaactttggcaactgaaacatgggctgtgaaaaccttgattaaattggtaaaataaattcgtaattttattaaattttatttttaaattaatattttccttatagcttccaaccatttccaagaaggaattgaaaattggaccgaaaatttcttcggtaaaaattactaaatttaatgtttaaaaaataaa

SEQ ID NO: 66774 - DNA, 677 bp, Heterodera glycines
  Genomic contig location: Contig_ID=SeqID_8035; Location=1152..1828; Strand=-
  SCN-specific regions: Sequence locations=1-55,87-180,255-367,402 -542,564-677
atgaatgttcccgtaaaaaattgagtgagaaaaaaaaattcaaaaaattaggtagaaatttttaaaatcaaaattttaaaaatattggtgataaaaagaaagaattttttgtggtttattggaagaagtcgccgataaaccttctgagcacgatcggcactaatcctgaagaaatcattgaaatattttcttattataataaaacatatttttaaataaattcaattttaatacaaaataattttaaaatttaacataatcatttgtcaacaagtgtcagtatttcttatcaagtaattattccttttatgtgatgtgaattcttttattgataaggacctttcaagaatatttatctgttgaacccaaataaatattaaaaaaattattgttatttttttgttaaagttaaacaaatccgaaatattcatggaatctacagtatatttatttgacattatggactgtaaagacatcggtggatattgcaattttacagattttcaggcaaaaattttgtactacaatacaattatttgaggaaataataatttcttatttttagacatggtattgtgaatggaaggagatggatttgtttgaagaactttgcccaatgccatcaatgtaaaattaatttgcctaattaatttgaaattttttcatcaacaaataaa

SEQ ID NO: 66775 - DNA, 959 bp, Heterodera glycines
  Genomic contig location: Contig_ID=SeqID_8036; Location=473..1431; Strand=+
  SCN-specific regions: Sequence locations=1-152,199-530,555-712,753 -899,952-959
atgaaatttgaagaactgaatggcctggacgccgaaaattttgtgtcaaagttgggcaaaatttttgaaaaatcagcttgggtagtccaagaagcgtacggagaaaagccatttgaaagcgttgaccaattattcaatgcaatggaacggggtaaaaatttttaaaattaaaaaagtatatatttaaatattttttaacagttttaatgaatgctggacgagaaaaacaactgaaattgatccaagctcatcctgatttggcggggaatgaaatgtttagtggcaatctaactcagcattctacgagcgagcaggttggtatcagagatgctcagaacgtcccgaaatgctcgatcccgagatcttttgctttatgaataccggcccgaaaatttttgaccgttgccacccaacccaaattttttttctcatctggaaacattcctggttggatttgcaggcatgttgagggtcggggaaaagcccaaaaaaagacaggggattcggcgagtgtcgaaggaagtttttagaaaattaaaattaatttaaaaaatcaatcctaataggctaatgctgggcttagcgcattaacggctcagcaattggctgagtttaattcgctgaactccgcttacaagtctcgcttcaattttccgtttattattgcgcttcgagaccaaaaagaaggtagtaatataatttcatatgtatcatattttaatttatttatttaataaatttttaaattttttggcattgatggcattttggcggcatttcgtcgacgacttaacaactcggaagaacaagaaatcaatgaggcactctcacaaattggacgaattgctcgccatcgattggacacattgatgatggagtcgaaatgagaattttatcgaaatgagaatttaaatgttaaaaaatgcttttataaaattttaatgctttattgtataata

SEQ ID NO: 66776 - DNA, 635 bp, Heterodera glycines
  misc_feature (626)..(626): n is a, c, g, or t
  Genomic contig location: Contig_ID=SeqID_37782; Location=426..1060; Strand=+
  SCN-specific regions: Sequence locations=1-150,177-356,378-573,595-635
  Gene Ontology: Biological process=regulation of protein activity, epigenetic
atggtaattacaaaagcgtctttttctaagcgatttcgtaattgttgtgcccgactcggcgacgggtgccaacaactgtgcagctatgatcagaacttgggcacggtaaattttttgttaattaggattagcgtaaaatattatcccatattttgattttaaaatttttatctattcttgaaaatctataaaatctcttaccattttcattttgcctttttcagatacaattggccgtgctgaccggaagtaagaaaaacaaagcgtatacagtatccactgacactaatccaacccccctccctcctactgtaagggtgtccggtgagtcgcgtcggtgaaatgatggtgagaaaatgaggcaaaaatgaacaaattatgaccaagtttaaatttaggtatgcgctagtggaaatgaggtaaaaaaaagggggaccaattaaaaaaatcacttctgaaaaagtaaaaaattaacggaaacaaaacattgtttagtgattttttaaattgttatttttagcgctaattggcataatgacttttttatacccgcctctttttcgcatgaaattgaaaaaagattttcaattttttcaggacgccaccgcctgttgccaagcatttgncgtttttga

SEQ ID NO: 66777 - DNA, 304 bp, Heterodera glycines; identical to SEQ ID NO: 51570
  Genomic contig location: Contig_ID=SeqID_37790; Location=297..600; Strand=+
  SCN-specific regions: Sequence locations=1-304

SEQ ID NO: 66778 - DNA, 1070 bp, Heterodera glycines; identical to SEQ ID NO: 37791
  Genomic contig location: Contig_ID=SeqID_37791; Location=1..1070; Strand=+
  SCN-specific regions: Sequence locations=1-612,635-644,666-667,690 -1070

SEQ ID NO: 66779 - DNA, 1850 bp, Heterodera glycines
  Genomic contig location: Contig_ID=SeqID_8038; Location=87..1936; Strand=-
  SCN-specific regions: Sequence locations=1-93,119-299,321-643,665 -1174,1196-1373,1398-1850
atgatgccagagaagcgacgacaattcgatcattggtacgagcagcatcgcgaagagccttttcaactcgatgaagcactagcgaggtaaaacatttttaaattaaaatatttattttggactttttcagttattgtacgaatgacgttgaaattctaatggcagctctcgtcgcattccgccgcgagttttttgatgtgtcgaagcggaacgaatatgtcgacggaatcgacgaccgggaaaaccacgatgggattgatgttctacgggaatgcatgactgttgccggtgcgtgcatgaagcacttcaggttgaaccatctgccggcggagcaccttgccattgtccctgaaaagggctatgacaacacccagaaccagagcaagctggctctccgctttcttttctggtatgctgaggaaaacaacgtacaagtgcagacagcctactcacctgatggagaaaaaaagattgcaaactacactgtggacggttggattgaggcagaagggtgtgtaattgaagtgaatggtaatttttctatatttttaagcaatttaaaaaaaagttgtttgcaggttgtgtttggcacggctgtagaaaatgctttccttctgacaacatgatgttgcccaacgggaaaactgctggagaacaaagggagcgcgatgccaagcggttacagttcttgaggactcaagtgacacgagttgatgtcttctgggagtgcgagattcaacgaatgttggacagaagcagggaaatgcggaaaaaatttgcagaataccatcctacggattggacgtcgaagacaaaccctttttcccgcatttggccaagatttttggtttatcaccgttcacctccacggctcacatccccgcctcgtttgaaaacaaaaattgaaccaagaccacctccaccgcgtcctaccgccaagagagaaaaacaacaggcaaagctggattggaagaaaaaccaacaccctactccagcgcctcgggcgaaaagagagccagaacttaagctggacccgcggccatccacgtctaggcaagccgggtacttccctcccccgacaaccaaaatagaaccaaaacatgcaccaacaaagaggcccgtaccataccgtatcccggaaagagagccaaaaatcagagaaaaaccattacagcaacaacaacctcctcctcctactgctgtcgtcgaagaaatgccctatgttcctccgcctaggagggggaccaaacgcccccaccccgtaaatgatgagaatggtgaggtgcacataagaaaacgggtgaggcaaccgagaagggtaagggtacagtattcgccagagccaggcccttcaacatctgcacaagcttatgaacaacaacaacaacaacaacaacgtgaactgtttgctattcagtcaaatcagctgaccatgactcagcggattgaacggctatacatcaaatgcaaccattatgcagatcgtatgggcgttcggggaaatacaattaataccgcaaacggcaaaccgttggcgcatagcaatttgcgaatggccatcaagtatataatagaccggagagcgggccgccccaccattaaaccaccaggagcgaacctattggaagagcggcttaggaaggacccaattttgtattcatggacggccccaccaaagagaccatcacagagcaaaaccacccgaacggaacggacaatcaagaaggaatttcgcccaaaaaatggagctgatcaacaccactcttgacaaaatgtacaatgatccatcatccccagcggcattcgcaggtgttacagcgctgtggaaagaggcgcgaaagacgattaaa

SEQ ID NO: 66780 - DNA, 1217 bp, Heterodera glycines
  Genomic contig location: Contig_ID=SeqID_37792; Location=124..1340; Strand=+
  SCN-specific regions: Sequence locations=1-133,155-731,753-810,834 -891,916-931,953-983,1005-1050,1083-1217
ctctttccaaaattggtggcgatgagttggctgacagtgtgcaaatgcgtcttcttcgtgatgaaaatgcgcgtcttctctcagcgctcggcagtgttaaggcggacaaagccgtgctgaagaaacagttggaccaactgcagcagaacgacgcattggcggagcaccaacagaccaatgttttgaagcaggtatttattggcacaagacgaattttaaacactaatttttctcaattcgcttttctctcattaattgaaaaaattttaagaaattcgaagccgtaattaacgaatgacagaaaattaaagatttttttgaataatcgacaaagcctccattcctggtttttacatttttttcaatcaaaaattcatagtttggtttttcagataaattattaaccgattacaacaaaaattgtcggaacaggtcgttctcccctgcgtcgtttcccccttaaaattaaaaaaaagtttggcaaattttctaaaaatcgttgaaaactttttcgaaatttttttaaattttccgatggggaaacgacagagggggttgaatgaactgcacctaaaaaagccttcaatggttaaatgtttttttttcagtcgaaactctcaccgacgagaacggaaaagtcgcagcaacggcatgtgttcactttgcacgacaacaacaacggattcactgggtgcacgtcggcgcacaaccaacaacataaatcaccgcaaaacatcagcaacagaaacagccgccgctgttccccccgctgcccacacaaccggcactgtcctcctccccctcctcgtgttcatcaccagcatcatcatcatccgccgcactgtcatcatcgcccgcaattcctccatcgtcttcgtcgttgtcccatgtatcgtcttcgtcttcctcattttccacaattccgccacgtccgcccgccatccgcgcgtccgccagctttccgctccatctcggctcttccccctcctcgcctcctgtttcattgtccttccatcaacaccaccattcgtcctcccctccatcggccagtggtgctgttgttgttgttggcggtggtgttgacaacaagaaacggcccaccaccgcgccggagggcagcagcagcaaccgaaggacggtggtggcaaacaacgggggacgaacaacgatgctcggggcaaaaggcattagcagcagtaacagccaacggcacatga

SEQ ID NO: 66781 - DNA, 531 bp, Heterodera glycines
  Genomic contig location: Contig_ID=SeqID_37793; Location=360..890; Strand=-
  SCN-specific regions: Sequence locations=1-51,74-155,177-267,289 -336,358-437,475-531
atgtgtgtccaatcggcacccgaaacacgcgcaaacaccgaattacgtcaggctgtccaggacaaacttgacgttgcacaaattcaactgaggaccaagtgagtcattccctaactgccccctttttggacaaaatttctgggaaccaaaaaaactttaaaaatttcaaaattttcagctattttctggaaaatgtagcacttcatctttaaagctttttttattggttacgatttttttgaaaaactccggttcgaggcccccagctgggtttatttcacagtaaatacggatgcataaattctcatttcagagcgctgctcgagtcggacgccggcattgatgtggagatgacaccccgtggtcgtgaggtgctggacacgctcagcttccagctgtgctcactgaccgacctgtaccgggtggcgaacgcgtacggactggaggaggtgaagctgagtgtgctgcactgtgccggccgttacgatgccgaagtggtggagggcgtgtggcgtgacttcttgcaaaaag

SEQ ID NO: 66782 - DNA, 672 bp, Heterodera glycines
  Genomic contig location: Contig_ID=SeqID_37795; Location=169..840; Strand=-
  SCN-specific regions: Sequence locations=1-210,232-391,415-537,562 -624,664-672
atgaatcgctacaccaaaatggtcgacgacgtaacgggtgagtggtgtgttgaaaatttcagggaatgccatatgtttgttgaatttagtcaaacaaaaaaggatttatgacccaaaaattctgttctattttgcgatgcgcaatttccgtactgaatttttctgtgattttgtggggccaactaagaaaaatcagaggtccaaattaattaatgatttatatagcatttaatgagtgttaattatgccattccattgtgattaagcacgccttttaaagacgtccattcttcccgagcacatgaaaacatttacgcggaaagagtttcgtgaagcgccaaaaattacagacgaattggcggccgatgatgagcttatggtgagaaaagtgttatttttattaaaaaataatttgtgttttaaattggtttctaattatttttagccatatatgccacgaccgtattacagccgacccaacagattggacaaggactattttgactttgacttgcaacattccgtcgacatgtaaatgattttagaaattatttttattttattgacaaaatacgtccaattttaaggtaccgtagaccagaaggaaaatatttaccaacaccgtaaatttaattttatttttaatttcacaaaaataattaacacaataaa

SEQ ID NO: 66783 - DNA, 612 bp, Heterodera glycines
  Genomic contig location: Contig_ID=SeqID_37799; Location=1..612; Strand=-
  SCN-specific regions: Sequence locations=1-45,69-612
tctgtattctgtgcattttgtgtaattggtacgacccgggaatgacaaggcatttctctttttctatttacgtaagactttgccctgataaaatgttctctggataacagaagtttgaccggaagttatgcgaccaaaggaagcaacgaaaccgtcgcaacagtgctcaagttgatgaaggtcggacttttggaagggtacgccgtgagacgcatcaaaatgttcaacgaccgcgtgtttctgtcacgctacagacggagttattggttcgggacgagatattacgctttggacaacaacttttttcttgacactcgcgaaacatgcgcctatcgaatgagggaggaagagcgggacggattggaatacgaagagaatgcggacgaaccggtgctggacattgtttaccagtgagtagttgtgtgcaatttgacaagagatttgcaaaaagaatggatattgaacggaacacagatgccaaaagtatgcccagttttgctgcggattggattgctgcaaccgattctgaccaatgggaaccgatcgccatggacccaaagcctatacgctccacgcccccccccctccatttggtgcttgcccttttgagtg

SEQ ID NO: 66784 - DNA, 845 bp, Heterodera glycines
  Genomic contig location: Contig_ID=SeqID_37800; Location=48..892; Strand=+
  SCN-specific regions: Sequence locations=1-268,290-845
  Gene Ontology: Cellular component=integral to plasma membrane; Biological process=development
atcattcggtccgagcctatcttcggcttcatccctaggattcgcttcagtgacaagggttcctacgtcgaatcggccaccaaagactacgaccatgtgagtcctccttttcaattatttactcctttttctcgcttaagatggccttcaaatatttgtcatgggcactctttccgcttttgggcagttacgccgtctattcgctggtgtacgatgagcagaagggctggtacagctgggttctgtgagtttgtcggcgcattttccctttgtcattatttccttcttcaagtggcatgttgtacggctttctgttgacattcggctttattatggtacggatattcaaaattcccattcaattagcaaaaacgccgttcagatgactccgcaattgttcatcaattacaaattgaaatcggtggcccatttgccgtggcgaatgctcacttataaattcatcaacacttttattgtgaggccactcaaacgatactcatttagtcccctcttctattaaaaggatgacctcttcgcctttgtcattcgaatgcccacactttaccggctcggctgttttcgcgacgacatcattttcctggtccattaaatggctttgtagtgcgatatttgggaacctgcatgcgcagattgaccgtcataaaatttaaaatatctaaatctgcaaaaatctgtccgcaaacttttttcagtactcgaaaccccttttttaagatttacatttaccaacgatggatttaccgagtggacccgaaacgtgtcaacgaattcggcaccactggcgatgatcagacgggcacggaggaatttcgggcatcgaggcg

SEQ ID NO: 66785 - DNA, 864 bp, Heterodera glycines
  Genomic contig location: Contig_ID=SeqID_8039; Location=1329..2192; Strand=-
  SCN-specific regions: Sequence locations=1-44,80-168,190-210,241 -577,599-864
atgagtaagttctgagattcatatatttttcacgaattttccagaaaatttaatcaattttttttacaaataattaattgctccttgaaattccaatcaaaaccaccaaacttcttatggcgaacaaaagttttaaaagaaaacaaaaaaaaaagtcaaaatagcattaatttaatgtaaaagatttaagcaaacctttattttgaattgaaaaaatatttaaataaatataataaaaatgcgtgcctcaatgccgcgtttttgccgccacttgagccccggacaagccatccgccggcataaaaggacgagcccgaagtgaaagcagtggtccaataagccaaaaagaacatacagagccctgcgagcacagcgattgggatcaaagtgcggttgaaaaactaaaatcggaagcaaatgccaccatttgggaaagtgatcaaatggggcgtacggttgtcatactgtaccgtggtggccgggtcaaagcgcgggtatttgtcatggccaagcacttgccacccaagcccatggctaagctctccgatttgtgagtcgagcatttctacaatacattaataaaattaaactcaaaataaaatatttttcacccgataaaatttggttggaaagtaaaggtttgtcgggttttttgtccattgaaatcttaattaggaaacagattttaattgataattcaattaaaatgaaatcaaaaactcacagcatcatgtggcaaaacgacaaagaaacggaagtggaggatgcgatgctcacgacgaggatatccatccaaaaggacaatttgatgcttggagaaggagacactgcagcagaaaaaggagataaaattgtttaaataaa

SEQ ID NO: 66786 - DNA, 339 bp, Heterodera glycines
  Genomic contig location: Contig_ID=SeqID_8039; Location=1..339; Strand=+
  SCN-specific regions: Sequence locations=1-339
tgcgatgccaaaaaagatggcgaaataaatctgcgcgagttcaaatgctttgttaaatcactgctcgcctcatatttggtggacgaggaccggaacaaatgcatcacggaggaggagctggagagtttttacaaagaatgtggattaaaagaaatggaagaggaaatgatgggagacggatcagtgcgaaaagagtgatcggggagaggacattgggaaaagagcgatcaattgataatgtgatcaatcgataatgcctagcaataatatggaatttatcggtataagatatatgattagaatggtcacgtagaaataaataaacgacggtgattagta

SEQ ID NO: 66787 - DNA, 1922 bp, Heterodera glycines
  Genomic contig location: Contig_ID=SeqID_8039; Location=432..2353; Strand=+
  SCN-specific regions: Sequence locations=1-19,70-308,330-393,415 -482,563-779,801-884,917-1163,1185-1521,1552-1572,1594-1682,1718-1922
tatttacatgatgaaaaacaataattatttttgttaattaatttttcatatattttttattttatttatcgctactggccaaaacagccgtctcttccgatgaaaaatataacaacagctgctcattttttggccatttgtgctcaaatgctgcaaaagtgaagacagcataaacaggaaaaaataacaactgccattatttggcaaaaagtggaaataaaatgatgaccctcaaatgtttttaggaccaaattttgaaaaaagagagcaaagccatgcccaaccaaatgaatgggaataattatgttttttccttaaatattaaggaaatattttttttgtgaataaagaattgaatggcaaaattcgttgttttcatttttacgttggcattttttgcgagcgcaacaaatggccaagttgtgacgggacaatccgaccgaacgcagcaaggcactttagcatttgaagccatttatcggaaataaaaaataaataaaattaaaataatttaataagagatttatttttcttccaaattatatatattaaaagttaatttgtgcagaacttgcgctgtttggctggacagttgggctaagaacggcctattgccagcaggtgccagcccaagaattagtcgatccgttcaaagatgcagttgtacggatgctgaacagacattgccgaaatgcgtcggcatgccggctgaagaaaaggtcggcggatgtttaaaagggataattaatatgtgtttttgtggtttcaaatactggacaatgaatgagtttttaaaaagatatttatagtagaaacaaatttgcgtaattttacggatttatgtaaaaaaaaatttattcccctacaaatgaaaaacctaatccaaaaaattaaaattttatttaaacaattttatctcctttttctgctgcagtgtctccttctccaagcatcaaattgtccttttggatggatatcctcgtcgtgagcatcgcatcctccacttccgtttctttgtcgttttgccacatgatgctgtgagtttttgatttcattttaattgaattatcaattaaaatctgtttcctaattaagatttcaatggacaaaaaacccgacaaacctttactttccaaccaaattttatcgggtgaaaaatattttattttgagtttaattttattaatgtattgtagaaatgctcgactcacaaatcggagagcttagccatgggcttgggtggcaagtgcttggccatgacaaatacccgcgctttgacccggccaccacggtacagtatgacaaccgtacgccccatttgatcactttcccaaatggtggcatttgcttccgattttagtttttcaaccgcactttgatcccaatcgctgtgctcgcagggctctgtatgttctttttggcttattggaccactgctttcacttcgggctcgtccttttatgccggcggatggcttgtccggggctcaagtggcggcaaaaacgcggcattgaggcacgcatttttattatatttatttaaatattttttcaattcaaaataaaggtttgcttaaatcttttacattaaattaatgctattttgacttttttttttgttttcttttaaaacttttgttcgccataagaagtttggtggttttgattggaatttcaaggagcaattaattatttgtaaaaaaaattgattaaattttctggaaaattcgtgaaaaatatatgaatctcagaacttactcatccttaaaatcctacaaagctgaaaattcggaaatttttgattgtttacgattggctatttccaataaaactcagattattgtggtaaaaatggcatattgcctattccaaaagcttatctctcacctttagaagaacaatggaaatcattgaagaacaaaa

SEQ ID NO: 66788 - DNA, 623 bp, Heterodera glycines
  Genomic contig location: Contig_ID=SeqID_8039; Location=2792..3414; Strand=+
  SCN-specific regions: Sequence locations=1-281,366-623
atgccaatcattgcgccgaatgtcgaagaaaaagccgcagtcgaccaacaacaacagcaaaaagttgccaaaaaaggtgccacaaacattcagccacaacaacacgaagcgttgcccaccagcggcgccaaagggcctcaggcggcacaaaatggtcggcaaatttccatttcacaattagagtgatgtccgaacaaagtccaccatttaaattaatttttaacatgtaaaacgtaattaacatgctccctttgactaattaatgcacacaaataaaatcctttttttattgaatataaaaaagtataaacaattattttaaataaattaataatacgacaatataaatttaattaatttttttagggatccaacaaaaatatttgggcccggcaaagggttcgctttcttcagtgtccggctcgagcagcacaaaacgccgagagatggaagagatggatgacatggtgcccgaaattgtggtgatgcacgcgcacacctcgtcccaggaaagcagagaaacggcggccagcggaggccgacgcgtgtcgaccgccgcggaaaaagggtatcgagaatctcgacaaaaaagttatgtgtttttcaaaaattacccaggataa

SEQ ID NO: 66789 - DNA, 1038 bp, Heterodera glycines
  Genomic contig location: Contig_ID=SeqID_8040; Location=163..1200; Strand=-
  SCN-specific regions: Sequence locations=1-23,45-302,428-488,510-1038
atgttgctggcaattgtcttttttgtgtgttccattgcttttccccaaccaattttttccgtgataaaatcaaagcccaaaaatttggtattgatcgaccgccaaatttatgagcaaaaattggcagaaaatgatggcactggggaattgcgcgagtttatccaaaaattggaggaccaaaacgaaacgatggccaaagtgatagaaaaatgtgaagcaatcgaagaacgggaagacgcgaaattggccaaaatttacttcagtttaaaaacaaaactcggagaaataaaaggaggagaaggtaattgggtaattaaattaattaaggatgatttaaatgggcaattaaattaattagcgaggtaaataagtaattaatgagaagaatggtaattgggtaattatttaaaaatttaattataattaacagggattctttttttatgtaaatacattttttttcctggattctccatagcctaattagtaggaaaaacactttcttttttgtgtttgcgaacaaaaatcgggacttttatttacattttttttcatattttgagaatttatataaatttcttgtgaaatttagatttttttttgagaaatatacttctaaaaaatcaattttttttcaaaaacagataccaaaaattaatttttaaagtactaaaaagtgattctaggcctatttgggtcatttttattgcattcctatttcaccctttacgaagaatttttccaaaaaaaataaccgttaaaaaaatttttatacatattttcgtacatatttgggagtttttgtacatatttcatacatattttagcattttttatacatattttatttacatatttcgcgatttttcttacataaaaaaagaatccctgataattaaagtattagaatctgtgtgtgatgtagcagcagttgagagactaagaaaaaatgcggtcgaagcagtgtttctgttagccaaacgtatgaaaatccaacgggagaaaattgaagacaaagcaaacaaaaatgaaaataaa

SEQ ID NO: 66790 - DNA, 283 bp, Heterodera glycines
  Genomic contig location: Contig_ID=SeqID_37805; Location=557..839; Strand=+
  SCN-specific regions: Sequence locations=1-283
atggcgcacccagccggagatgtggtgagcgattggtgcttttcattttcttctatgtcatttcattttttcaatttttcagaccgacgcccaagtgctggagatgtcttccgaccaaattgacgaacgcgtacgacagctcgacgaagaaattcgcgtcatgagggacgaaatgcgcaaaattgcgtacaacatcaaaacaatgggaacgaagacgaaggagaacaacaaacagatgcagaaagtgagcaaacaaacaaaaggaggaacgacaaatttatga

SEQ ID NO: 66791 - DNA, 498 bp, Heterodera glycines
  Genomic contig location: Contig_ID=SeqID_37806; Location=47..544; Strand=+
  SCN-specific regions: Sequence locations=1-42,64-139,161-498
atgaacaacgagaatggaactcttccgagtgtcagtaccattaaaaagaaagccaatgccacggggggaggttatggcgtcgtaattcattccttcgattcgcaaaacaaaaacagtgcacaaagcattgtctacgtggaccacagtctgtccattcattcagactgactctcggtttgctcattcgctgctttttgttcagatcgacctctttatgttgtgccacgctatctcttcgacgtcacttatctgaccaaccaaggcttctccaagtcgcaagtgaacaaacggtccatcgaactcggattcggagctaacatccaatttgaatcccgaggcaaccaaattgtctatttcgaccgatgttccaagggacaggactggatcaagattggtgaacaactgctcttacaggacaaggacaggcgatttttttttgaagacaaggcaaagaattacgtgaatataaaatcaaaagcccattcttggtcctcttaa

SEQ ID NO: 66792 - DNA, 345 bp, Heterodera glycines
  Genomic contig location: Contig_ID=SeqID_8042; Location=3151..3495; Strand=-
  SCN-specific regions: Sequence locations=1-124,157-242,294-345
atgccgataaaaaggcggaaaagatggattgattttgtgctttttgtggatcagaaagttttttctaattgatttcatctttgatagagttttatgttgaaaaaaaatgtttagatttttgtggatttaaaaaaatttaattaaaatcaaaaaaatgacatttttagaaaataattgctctaatttttattgggttcaaaaatgtgatggagttctcagaatttttctgtcggtacttatccaaatttaaaaaagtaatgtaatgaaaaaaattattaaatttttaattaattgaaagactaccacttttttttacaaaaaatcaaaataatattgaataataaa

SEQ ID NO: 66793 - DNA, 1157 bp, Heterodera glycines
  Genomic contig location: Contig_ID=SeqID_8043; Location=95..1251; Strand=+
  SCN-specific regions: Sequence locations=1-164,186-210,232-338,363 -759,782-870,892-968,1048-1157
ttttgtgcccagccaagcggagaatggtcgttggatggtctgtttggcggcacacgaattgtacgggcacgagtcgcgcagtgccagcattcagttggatgtgctgtacgcgccaaaagtgcgcattgaaaccatcccggaggccagtcaggtgcaattttgaaatttggaaaatgtaaaaatttttgttttgggtcggtcgtccgagtcatttttaaaatttctaaaaaacttttggattcattcttcaatttataccggcaaaagttggccgaacaataataatgtcaattatatttcctttttgcctaaataattatgtttttctcttatgaagcaaaatattaattaaatttatataagcaaaattttcatttattagaaattacagatttacgaaggcgggtacatccgattgcattgtgccaccgatgcacgtccgaatgatgttaaattgcgctggagttgggacggcgagcccagacggttggaggtggtggacgcgcaggtaaattattaattagtgaattaatttaaatagcaatcataaaataaacaatacaaatctaaaatcattggttgttaatacctaagaatttataatgtttatgaatttttatcaaagcttcacagatctgaggacaaaacgcattttgtggttttaatgagtcagggagggtttttttctattttgaaatgaggatctgttattttattttataatagattagggagttttcgctgattatttttaaaatatttccaaacatggttttctttaaagattgattttttgatgatttaaaaaaaaattggtaatcttatcgattttccaaactttgatcgcttttatctgatcaatatgggtgtgggaaaaagccaaaggttttcagaagtaatcgaggaaattttgctgcaatttcacgaatcacctaaaattttcaattatttttctggaattacaaatctatttatattaaatatttcatcaattaatattatttattaaaaattgaaattattataataaagcattttttaatttaagaatgttctgattaacggactacgattcaacgacaatggacgtcgtgtgacgtgcacagcggagaacaccatcgatgttggcaccggcgtgttcgagttggacgtgccat

SEQ ID NO: 66794 - DNA, 944 bp, Heterodera glycines
  misc_feature (830)..(830): n is a, c, g, or t
  Genomic contig location: Contig_ID=SeqID_37813; Location=1..944; Strand=+
  SCN-specific regions: Sequence locations=1-23,60-502,524-944
ttcggaatatgcgagttcggccatttttcaccgcccattttttcccaaaagaattttcctccgtttttaggaccgtgtcgaatacagtcgcacttggcagggcatttattttaacatcgccggccattttttctccgtttattgcatatggaagctgatcatttgcacggcaagttcattttttataaattttgtttgaaatttaccttttttcaggttaatattgtgttcgaccgcgtcggaaaggtcgacccaatcaccaaaggcattgaaatcattgtcaaacactttggctaccaaattgacgtaagtcaattgcctttgtttttgctaatcatttgctggcaaatgccttttttcatcgaatttcccaatttggccctttttaggtccctttttggtcccagcagtgctcctttttggtgatcggtctgatcgccgtcacatccatccgcggccttttgctgaccatcgccaaattcttcaacgccatttccaatcgccagtcctccaacctcattgtgctggtccttgcccatgtcatggtctgttgtgccgatttgaggactgttcagtgccaaaaattggcatttttttaatttcagggaatgtatttcgtgtccagcgtccttctgattcggatgaatatgccgcccgaatatcggtaaacctatcaaattactggcaaaatatgctattttaatcaaaaaaaaaagtttttcctggacaatttattaacttacggtctttcaaatcgactattaaaaaatgtcagacatttgctttctctctctctctctgttcagaacgatcatcaccgaagtgcttgnggaactccagttcaatttctaccaccgatggttcgatgtgattttctcctttccgcactctcttccattctctttttgtacttggcgcacaaaagacaccaaatcaataggcaa

SEQ ID NO: 66795 - DNA, 1582 bp, Heterodera glycines
  misc_feature (773)..(773): n is a, c, g, or t
  Genomic contig location: Contig_ID=SeqID_37814; Location=125..1706; Strand=-
  SCN-specific regions: Sequence locations=1-118,149-161,183-232,268 -271,297-332,354-364,411-424,458-502,524-716,749-783,840-840,870 -921,1044-1046,1074-1081,1157-1228,1296-1431,1467-1582
tctccccagagcggagcgcatttttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggttcggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaangaatgtcttctattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaaca

SEQ ID NO: 66796 - DNA, 1558 bp, Heterodera glycines
  misc_feature (41)..(41): n is a, c, g, or t
  misc_feature (918)..(918): n is a, c, g, or t
  Genomic contig location: Contig_ID=SeqID_37814; Location=17..1574; Strand=+
  SCN-specific regions: Sequence locations=1-224,260-395,463-534,610 -617,645-647,770-821,851-851,908-942,975-1167,1189-1233,1267 -1280,1327-1337,1359-1394,1420-1423,1459-1508,1530-1558
cggacggggcattggtggtgccaacgctagcccacaggacnagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatagaagacattcnttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggagagaccggcagaaaagccaaccgaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagt

SEQ ID NO: 66797 - DNA, 495 bp, Heterodera glycines
  Genomic contig location: Contig_ID=SeqID_37815; Location=1..495; Strand=-
  SCN-specific regions: Sequence locations=1-437,461-495
ttctgctcctcgctagcgcaatggtctcaatgctttgcctcatctccgggctgttccttctcccgccggacattcactctttcagcagcacaccttcagagcaaggcgtcgattggcaaattgaatttaatttcgaatttctttgtatataaaaccgttaatttaacagatgccaaccgccaaattccgctgacaaccgtcggccgattgtcctgtgtcactgaggcgggatgcgttttgtctgacacctcgcaactgaattttttggtggtcggcgacatcggaggtttgttttttgggcacattttcattcctcaaaaacatgcctttagctcaacacaattttcaaaatttcagctgtgttttgttcttttaacataaaattgaaaaataaaatgcgaaaagcggaaaaaatttagagatgtaaaacgtaacaattcacagtttttgttgttttaaacattatttttaggccttcccgtctttccgtattat

SEQ ID NO: 66798 - DNA, 866 bp, Heterodera glycines
  Genomic contig location: Contig_ID=SeqID_37817; Location=144..1009; Strand=+
  SCN-specific regions: Sequence locations=1-3,25-191,249-282,334 -449,472-866
atgtttaaaactgcaatgcaactgtcaattattgaaaatggaatttgttacacaattattatcatttgtggattcaaaattgccaaatttgtcaataaaaatgcatacagaaatgcaacatgtggacaacaggttcacaaacagttgacaatcaatttgataattaaggtctattttaattaaaaagaacgatttttaaaataatgaaatttttagaaatatattttaaaaattatatgataaaaattctcaatttgaaaaacttcttaagaaaattggtagaaatttttaataatttattgataaaattgctaaaatctattaaaaaaaaatcaaatgcatttttaaacaaggagttatcattctaaaagcggggcttaatgatgcccaaaacaaatgagatttcaaaaagaaatctgataccgtacactcaattacaaaatttggccatttaattttttttttaattttgcaatttgcttttaggccctgctaccgttagcgatgaacatcctcaacttttccgtcgccatacaactgctattcttccagacggaaatgtcgccaaattttttgtttcttcaaatgtgtgcgtccgttcccgcctattggctgcccgtgctcaacccgttggttacgatatgtacagtcagcgactaccgtagtgctgtgaccatactcattcggtccacaacgagaagccgaagtcgggattccggtgtttttgctgctgctgatctgccccaaattcgtgtaatccgcccaacgaattatgccaatccgatcatcaacaattatgtttaatgaaggagttatttgtaccaaaattgcatttttttttcccctcttgaagcaaaatttcttta

SEQ ID NO: 66799 - DNA, 152 bp, Heterodera glycines
  Genomic contig location: Contig_ID=SeqID_37818; Location=454..605; Strand=-
  SCN-specific regions: Sequence locations=1-152
tcgctgttcaccttcgagctgccctacgcgtactccgccgacgaccggctcgacctgaacagatacgacccgtacgagctgttggcccgctgccggcactttgtgcagcagagggacctgctgaacgcagtgcgggtggccaatctgatcag

SEQ ID NO: 66800 - DNA, 429 bp, Heterodera glycines
  Genomic contig location: Contig_ID=SeqID_37819; Location=473..901; Strand=-
  SCN-specific regions: Sequence locations=1-429
taagtaaaatcgtaattacgctcaaaaagcttttcaaacaattttatgcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatagtaattacgctcaaaaagctcctcaaacaattttagcgcttccaattccttctacaatcgcctttatacatcccattatgagcgctaaaattatcagagtgccgaaaatcgc

SEQ ID NO: 66801 - DNA, 242 bp, Heterodera glycines
  Genomic contig location: Contig_ID=SeqID_37821; Location=667..908; Strand=-
  SCN-specific regions: Sequence locations=1-53,75-242
ttaaacaaattaagcaactaattgctaacatgacatctttgaacaccacggcaccaaataattatgaactatttcttttgttctgcggcgatgccgttgaattattgaccacatttgttggcattccgttgtccattgccaatctgattttcggtggctcgcacatcggtcatccacccgaacatcgaaagccattctcatcttccagagtttctttattctcttggtaaatattgaataaa

SEQ ID NO: 66802 - DNA, 834 bp, Heterodera glycines
  Genomic contig location: Contig_ID=SeqID_96; Location=680..1513; Strand=+
  SCN-specific regions: Sequence locations=1-180,210-337,390-418,440 -771,795-834
atgggaaagaaacattcaacgagagaatggaataaaattgaaagaaaaattgcaaaaaaattgggtacaaatcggaacaaaatttatgaatggaaaagagaatttggaatgatcaaaaagcattattatacggatgaggaaaagcgtaaaatattaaagcgatttgatcaattatatgacaaaataaatgaaaaattaaataaaaaattgaagggaaaaagaaaaatatgtcaaaaaataatagcaaaacatttgggcacaaatatcagcagtatttattattggaagaaacaatttcaaaaaggaaactcatcagtgaacaatcaaaaaactggtgatgaaaaaagagaaattgttgaaaaatattttaaaacaaaaataaaatttatgcaaaatggaaaacattcactgaaggaatggaaagaatttagagcaaaaattaaacaaatgtttggtgttaattattggacaattgaaagataactgtcaaaaaaataagtgaatttatcaaaaaaatcacattttttatccatttcgctagtacaattctaatcaaacgtgctaaaatttgaggccaattggtcggagggggctcgtctcttttgctttgcttcgttcggcttttcctcttctcggtccaaataattaattagcacagaaaggacaaacggggccaatgcttattaattaaggacggcgaaatagtcgggaacagttcaatttatttaatttaaattcaatgcgaagacgacggcaattaagagtccacacacaaaatatttaaaggagaaaaagtctgaggtccaaatttttgtgaacaccaaataagaatga

SEQ ID NO: 66803 - DNA, 1070 bp, Heterodera glycines
  Genomic contig location: Contig_ID=SeqID_96; Location=4678..5747; Strand=-
  SCN-specific regions: Sequence locations=1-211,317-559,615-875,930 -1070
gtccggggcaaatttttaattggcatatttgtgcccgatttgggtgtccatcaatttcattcttggccctctgcaagcagttggcaacgaatttgcgcacattcaaatgctaccgtaccaagagcagctggtgtacgatagcaaattgccagaattacgggctaattgacggtcccaccgtccagggcaaggccgtctgcaggcaaatttctttaatattttttttcaaaaaataatttacgaaatttaataaaagttcgttttcaattaaaaatgttttttttataaaaaaaccatgaattaaaaataaaaaatacgaggtttacattttaaagccatttaaaataattgtctaattgagctgaaattttacaaaaaaaagacttttgctcaaaaataaaaaaagcgtatttttcagaattattttcattgtcatcaagatttgatcaatgttggaattttttgaaattaactatgaatgttacagtctaaaaaaactaataaacaaattttcgtttaccactaagattcttaaatgattttttcatctttttgttccaaaaaattaaaaattgtaattaagtaacaaaaaaaaaaaatttaatttttaatttcgtaacgcctttttatcatttaaacttaattttaaaaatgcgtaatacattttttgaaaatttttttttgattagattcgctttcgggaccgttggcgttccgtctgtacccaaatgacaaattggaccagtattgacacgggcaccgcgtgccgtaccatgggctatgatgacggcgcattttggcgcttttttcagcgcaacaacgacacttacccatttgtaatgccggcgcccaaatgtacacaacgccaaagtgggaaaattaaaaaattttaatgccaaatttaattttatttattttttgaaatttaagactctctgtggaactgtccaggctttgaggacaaagaacatattccgttgtccgaaaatttgtgccaaggtgaggacgacattggcatttattgttggggaaggccaactttcactggatgggctcgccattggaaaggt

SEQ ID NO: 66804 - DNA, 510 bp, Heterodera glycines
  Genomic contig location: Contig_ID=SeqID_96; Location=1839..2348; Strand=-
  SCN-specific regions: Sequence locations=1-297,319-510
atgatcatcctcggtcgtgattcgctggtcaaagacgagaccgttgatcagatcatggaacagtgccaacggatccaacaactgtgttcccgttttccgtccgtttcgttcatttggctgcctccaccgtatgttcgtcagtacgatttggcctatcacgaaatgatcggccgtctttctgaactgctcggcgattggtttgttttcgtgactccgtttggtaggagtttgattgaaatctggcattatggcgattcctttgatcggagtagtgtcaatgcagatggatggatgactgaaaatggcattaaagcattgtcggcgtggatcagcacacaaattccgaaatggccaaacaacagacaacttgggaggattcgaacggtccgctccagcgtttcggtcactaggagagtctatgggttgggtctatgcgaccgccgcccgaattctcgttctcgatcgccgtttagacgccgcgacaaccgccaatcacaaccattcgtttga

SEQ ID NO: 66805 - DNA, 1430 bp, Heterodera glycines
  Genomic contig location: Contig_ID=SeqID_96; Location=3023..4452; Strand=+
  SCN-specific regions: Sequence locations=1-3,32-73,96-121,143-248,270- 778,810-889,911-943,984-1259,1281-1308,1338-1370,1406-1430
atgaaaatattattaatatttttattattatgcgcattaatattcaaaaaagcaattaaccaaattgaggctggcaaaattatccaagaaaaaagttttgctgaaatatttggccaaagatgggacgacggagcagaagaagaaaacatctgtcaaaatgatcaaataattcatggagaaattgctgatcagaataaccaatttggacaaaatgttcgtcaatttgatcagaattttgatgaaaatgtggaagtgaaagaagaggagagtgaagaaatgtccacagattatgatgaattgggcgaccaattgccaatgccaacaaataatggacaaagttgtgataaattttcaaatgaaactaataaaaataaaagagaaactgtggaacaatttcataaaattaaagaaaaagttaagcaaatgggaaagaaatattcaaagaaagaatggactaaaattgaaagaaaaattgcaaaaaaattgggcgtcagtcaagagaaaatttacaaatggaaaagagaatttggaatgatgaagaacaaaaattattcagttgaagaaaaaagaataatgttaaagcaatttgatcaaatatatgcaaaattaaaaatgaaattaaatgaaaaattggagggaaaaagaaaaaaatgcaaaaaaataatagcaaaatatttggacattgatattagcagtatttataaatggaagaaagaaataaaagttggaaaaatggtgaaaaatcaaaaaaatgatgatgaaaaaacggaaattgttgaaaaatattttaaaataaaaaatgaatttatgaaaaatggaaaacattcacgaaaagaatggaaagaattttatataaaaattaaacaaaagtttggtgtgatttttcagacaattgaaaaatgggcaaagaatttaggaattgaacaaaataattcaaaaggtgaattttaaataatgttttaaaaatttttttgtttttttttcaatttacagagcgaaacatgttatcaattgctgaaaaaatggaagtcattaaacaatattatcaaatcaaaaaacaaaatccaaaattcaaagaatacgaaattgccgcaaaattgggaattccaatgagctcattagacaaatacaaaaccaaatatggcaatgaatccaaaaacaaattgctataatgaggacaattattattattatcccaagaagattaaatgaaaaattacaatgaaaaaaatttgaaaatttcatttttttcttgagaatttgtttaaatttgagtttgtgataaaagtttaatctctttttttcatctgtttacaaaaatattttaatcattaaaagcgtcgaatggtctaatgttttaggtgattaagtttaaaattatattaaatgttcatattattttaatcttgaaaaattggcaaaatatgtaa

SEQ ID NO: 66806 - DNA, 854 bp, Heterodera glycines
  Genomic contig location: Contig_ID=SeqID_97; Location=87..940; Strand=-
  SCN-specific regions: Sequence locations=1-208,232-542,582-592,614 -792,817-854
atgctgcggaatattggcattttgtcattgttggcatttttcttcctctgtggcacaattaatggacaacaaccgccgctggccaatgggttggagccgactcgacaacgaattcgcaacactctcggcggtttctactcgggcaatgtgacactgtacttccgtaactcgccgtacaggtgccatgaaaaaaatgggaaatttattcaaaaaagggcgggacaggggaaataggtaaattggacacaaaatgtaaaatttgggtcgcaggcgagtcgtgatcccacccaaatcccgatcccgaacaatccctaagattttgagaaaacgatcgggagcgatcccgagtcgtggtcccattcaaattccgataccgaacaatccctaagattttggaaaaacgatcgggagggatcccgagtcgtggtcccattcaaatcccgatcctgaccaatcccgtggcttttatttcggaatcccgctggatcatcgggatttgcttaaaattaaaatttaaatgttgtcgcccaggcggtgccgatgggcgccgccggggaaagaaaattttgtaaaattttaactaaaatattctgaaatttatagaaaattttttctttctagagttgagcgtgaattaattgtcgaatcgggcgcaacaatcacaattgagacgggcgtacaaatgtattttgacacgggcgttggcatgaaaggtgggtgtaatgtgacaatcggcatttttgatcggcatttttaaaaatgccttaacctggattctatgttgtatgtggacctggaattcctggacaaaaatccagcaaattccaggtccaggcttgtcatggcctggataa

SEQ ID NO: 66807 - DNA, 765 bp, Heterodera glycines
  Genomic contig location: Contig_ID=SeqID_97; Location=1274..2038; Strand=-
  SCN-specific regions: Sequence locations=1-20,51-325,380-593,649-729
atgaattatgtcttggtatgtaatattaaaattttaaacaaaaattttttcattttacagacattttttgctgaaaaaattttgaattttccgatggaaaatccaagccaaatcgatctgtctccgtttttgcttttctttaattcttcgccctttctccccgccggcgtcgtctcacaacagtggacaaataaatgcatttttcccattcacattttatctatcgtcatcctccgtccgacctctgatgactgtgctgggccaaacagcgctaaggctaacatacccaaaaataaaatgcccacaataaaatgactcatcgatgtaaaaaataattatattttaattttaaatgtatatttttttaatgttttttaatcgacccataactaattgtttattgaaaaagtaattagtagggctgcttaagagtcgaaatttccgagactcgagatcaagacccaacccccccccccccaaaaaaaaaggccgagaaatttcagtacaagtttttttgagaatttttagaatgtatataaatattttcccaacaaaacattttttccaccttttattttattatttttgtgggcaaataattaaataattatcatcattaaatatttcaaaattcataaaaatttaaaaggcctatgctcggcctaacagctaagaccaatccaaagcacccaaaaaaatataaaatattcacaacaaaatgattcatcgatttttaattttaaattaattatttttgaaaataaa

SEQ ID NO: 66808 - DNA, 2890 bp, Heterodera glycines
  Genomic contig location: Contig_ID=SeqID_97; Location=4872..7761; Strand=-
  SCN-specific regions: Sequence locations=1-324,352-454,494-496,518 -728,761-1083,1119-1172,1202-1346,1410-2135,2159-2249,2301-2396,2418 -2432,2618-2717,2742-2890
atggcttttttggaattttgcaataactcagctgcggttgctggtgctgcaccggccgtcgtccaacctcaacacgttcaagacataattccttggtgagaacgccgccttctcgaagcttcttggagtacagccgatctgtttgccatctgtagtcactgattttggatttggcgacacgattgaaaagttctcgaaaagctttttcccattttgcataaattcattttttgtttttaaatattttccaacagtttctcttttttgctcatcagttttttgctttttccatttttctcaattcagctttgtatttgcgtaatgagttttttggaatgtttaaaattttggcaatttcgtcttctttgaattttggattttgttttttgatttaatattgtttaatcttttccattttttcagcaattgataacatttttctctctgtaaattgaaaaaaaaacaaattttttttaaaacattatttaaaattcactttttgaaatgttttgatttatctttaatttctcggcccatttttcaattgccgtataagccacacgaaaattttgtttaatttctgctctaaattcttcccattcttttcgtgaatgttttccattttgcataaattcattttttacttttaaatatttttcaacaatttctcttttttcatcactaattttttgctttttcaccatttttccaacttttatttctttcttccaataaaaaattgttttgatatttgtgcccaaatattttgctattatttttttgcatttttctctttttccttccaatttttcatttaattactagcgaaatggataaaaaatgtgatttttttgataaattcacttattttttgacagtttttttttcaattgttggcacatattttggccttttttgagctttttagcacatattttggagcttttttcaatttttggcacatataaatccgttccctggcaattacaacaaaaaatagaaaaaaaaaaaacaaccttcaaacattatgcataatacttttaacttacataagcaacaaattggaaaatgaatgaaatgccgaataatatataaatttttaagaaatttaaatttatcaaaacctaacaatgaatggccctgaaagcttaaaaatattctcagtcaatccgtgacaccttcactttttctcttgaattcagatttatatctttctaaagatctttttgtaatatttaaaatttccgcaatttggcgatcgttgagctttgggttttggtttttcaattgataatattgttttattttttcagttttttccgcaaatgtataatgcttctgccctgtaatatattaaataataaaaatttttaaatttaattaataaataacaatttgtttaaaaatttcaccctttgaaagaatttgatttaagccaattttcttgtcccattttttctttgcgtgaatgttttccattttgcataaattcattttttattttgaaatatttttcaacaatttcaattttttgctcaaaaattctttgatttttcatagttttcccattttttagttttttcttccattgataaatgcttctgatatttgtgcccaaatgttttgctattattttttggcattttgtcctttttccttccaattttccatttaatttcgtttttaatttgccatatatttgatcaaattgttttacttttttatatttttcatcatccgtataataatgctttttgatcattccaaattctcttttccatttgtaaattttcctttgattttcacccaatttttttgcaatttttctttcaattttctcccattcttttcttgtgaatttctttcccatttgcttaactttttctttaattttatcaaatttttccacaatttctcttttctttttgtcaattccatttgaaaaatgatcagaaatttgtccaaaatttattggcaattgttccaattgatcacaatttgttgcactttcttgtttcacttgcaaattttcatcaaataattgatcaaattgtgtctcatgtaataattgagcattaatttgatcattttttgcctcattttggccatccatttgttcaattcttccattttgatcagtttctttctctccattttcctccgatttttcgtcccatctttggccaaatatttcatcaaagtttttttcatcgtttatctttccagcataaatattatcagcatttttgaaaattaataatgaaaataatattattttaattttcatatttcttaataaacccattaaaatgattagaaatacttttacgaattcatttttattcccatatttatgctgatttattgcatagctttactcagcaaatctacttattttttaaaataatgtttacattttttcgaaattctacttattaatgttttattttttataaattatactcattttgattaaatgaaattatattatatttttttaattattttgaaaggtgtcattttaagaaaattttgaattaaaaattctatttttcaaaaaaagcataaataatataaatttttttttataattttcgaatttttagggtcccgttttaattgccaactcaacaatttcacataatcgtggccatggaattgttattgagagcacattggatggacgagcatttgtcaaccaaagtcgaattgaggtagcaatttaaaaattaaaatgaaatattttggtaatttattttaggctaattatggcgacggaattttttatcgccaaaagcatgacggattgtcgtcaacgcaaaaccgtcttggccttgaaattggcattccgctctcaattttggacaaaaaatcggcattaagtgaataa

SEQ ID NO: 66809 - DNA, 982 bp, Heterodera glycines
  Genomic contig location: Contig_ID=SeqID_97; Location=5475..6456; Strand=+
  SCN-specific regions: Sequence locations=1-3,39-129,153-824,846 -878,942-982
atgaaaattaaaataatattattttcattattaattttcaaaaatgctgataatatttatgctggaaagataaacgatgaaaaaaactttgatgaaatatttggccaaagatgggacgaaaaatcggaggaaaatggagagaaagaaactgatcaaaatggaagaattgaacaaatggatggccaaaatgaggcaaaaaatgatcaaattaatgctcaattattacatgagacacaatttgatcaattatttgatgaaaatttgcaagtgaaacaagaaagtgcaacaaattgtgatcaattggaacaattgccaataaattttggacaaatttctgatcatttttcaaatggaattgacaaaaagaaaagagaaattgtggaaaaatttgataaaattaaagaaaaagttaagcaaatgggaaagaaattcacaagaaaagaatgggagaaaattgaaagaaaaattgcaaaaaaattgggtgaaaatcaaaggaaaatttacaaatggaaaagagaatttggaatgatcaaaaagcattattatacggatgatgaaaaatataaaaaagtaaaacaatttgatcaaatatatggcaaattaaaaacgaaattaaatggaaaattggaaggaaaaaggacaaaatgccaaaaaataatagcaaaacatttgggcacaaatatcagaagcatttatcaatggaagaaaaaactaaaaaatgggaaaactatgaaaaatcaaagaatttttgagcaaaaaattgaaattgttgaaaaatatttcaaaataaaaaatgaatttatgcaaaatggaaaacattcacgcaaagaaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaactgaaaaa

SEQ ID NO: 66810 - DNA, 1213 bp, Heterodera glycines
  Genomic contig location: Contig_ID=SeqID_98; Location=2123..3335; Strand=+
  SCN-specific regions: Sequence locations=1-291,313-414,436-441,463 -544,569-651,673-758,781-1044,1067-1213
atgctgattgagtttatgaaccaaaaacaattgaaacagcatgttaaagaaccgaccagagaaaatacgattttagacttagtaatgactagtgaatcagaattaattaatgaattaattgtattggaacatttttcaacttccgatcataaaatggtcggatttaaaataaaagaaaaattccggagtaataatcccagtgtttatagaagagattttaaaaatattaagtcgggcgatacttgaaaatcgaattgatttatcaataaactcagtgtacaccgttgatcaaaaatataaagaattcttaaataaagtactgaaattatatgatacttttataccaaatagacctcttaaaacaatcgtatcctcaaaaaataagagatttattttcagagaaattacggttacataagcttgtaagaaaatttcctgaaaaaagtgaaatcatttaaaaattacaaaattatttctaaggaaatgaaaaaacaattgtacaaattaagaaatgaacaagagtcaaaaattatttcccaggggcaaaattcaattaacaaatttattagaaataaattctcaaaagttaatgaaattcctacgttaattgatagtgctggaaatatgttttccagtaatgagcaaaaatgcgaaatattagcagaaatatttcaaaaatcttttttagaaaattcagttgttaatggttcattgactcaatcagcacagaataagactaagctttcggatattgaattaaatgttggcataatttggaatatattaagaaagcttcccaggcgaaattccacttcaccggataacatttcgtacattttattaaaaaattgtgctgagccaattacaaaaatattagctgacatatttcgacttgctttgtattccggtcaaattccggaaatatggcgaacatcattagtggtaccaattttcaaaaaaggcgaaaaaactgatttgttaggcgtttgattctgtaccaattgatttattacttcaaaaaatcaaaaagattgaaattgaaggaaaatttttaatttttataaatgatctgccgccctttattgcaaatgaagcatcatcagttggcataaaaatctatgccgatgatgttaaattatattatgcccatgaaaatgatgataaaacaaatcatttagataaagcagttgaggctttggaaaaatggtcaaaa

SEQ ID NO: 66811 - DNA, 505 bp, Heterodera glycines
  Genomic contig location: Contig_ID=SeqID_1042; Location=631..1135; Strand=+
  SCN-specific regions: Sequence locations=1-94,116-129,151-166,192 -200,222-297,319-505
atgcagaggtattacccgcctgcctcaaatttaaaaaaatcaaatcactgtcaaactcctcacacgccaaggaataagattttcctaattactccaagcaattcataaaattaaatccgcctctatatattatcatttttaaattaaatacgccaatgacgaacagcaataaaaagaaaatcaaatttgatctttccaacatttccttcctcttccgcctccgtgcggacatcaaacagccgctcacaatcagaagcacttgcggtgcacatcctcatgttcagcccggccaatgcaagaatttggaatttgtcatgagtcatgatgttggaggagattgagtgtattaattaggcccgtacccagaaaatgtgcacaaaatctaataattttaatgaggaagggagaaaacttaaatcgggtcgtgccaaatcgtccgccccttttttggtattcccttagaaagcacccatccgttaccgtaccgccgtttggcatcccttga

SEQ ID NO: 66812 - DNA, 809 bp, Heterodera glycines
  Genomic contig location: Contig_ID=SeqID_1042; Location=2296..3104; Strand=-
  SCN-specific regions: Sequence locations=1-84,106-241,280-405,428 -642,665-809
atgagcagtgcaatttgttgtcgcaccaaattagtgagtggttggttaatgggggagggggaggggagggtgccaacgcagcagcagtggaaacaccaaatggcggcacaaccgctcgctttttgtttatgttgtgacagccggcggtgcactaatgaattagtgccgtaacgatgtgagggagtaaaaaaaaagagccttcaaatgggacagaaaattttgcatcaattatcttgtttacttaaaaattcataaaaaaaaatttaaaattcataattacgggagccatcagtataaatgagtgtttctttgtcttattgatgccttaaaaataggtgcagcgggaccgggacctgaacaaggacaactgagtaccaaggtcccggttttgaccgggaccaggaaattcccggcttttttcccggtttttccagccaaaaagtcccggtttttcaacccaaaaagtcccggtcccggtcttgcccaaattttccggtcccgctgcactctacttaaaaatttggagactgatctttttttttgtttggatttttatttgtgataaattttccagaattatgtgacacttacatacgcctatgcataaaatctgtttcaaatcttaatttccccaattttaagtatcaaaattgaaaaaacttaaatttgaaaccgattttaagcataggcgcaaatctctgcacacgtgcgggagcgacataagcagaaatgtttgaaaacacagaagaattaatcaatttgtttattcaatttcataaatttgaaaattttaaggaattaaaaataaa

SEQ ID NO: 66813 - DNA, 2467 bp, Heterodera glycines
  Genomic contig location: Contig_ID=SeqID_1042; Location=3717..6183; Strand=+
  SCN-specific regions: Sequence locations=1-410,432-491,592-634,658 -694,716-1031,1069-1216,1249-1546,1582-1604,1640-1662,1698-1720,1756 -1778,1814-1902,1924-2163,2233-2351,2373-2467
atgagcgactatcatcatcagcagaagggcggtggtggcagtggctacccacaacatcaatccagctacggatatccggcaatgtgagctatatatgttggcacacaattggtggtcggtcggtgagcaaatgcgatgtatcggcacgggaattccatggaattcttttttggcgattttttgccaagcgttgaccgtgaaagcaaaaaatgattggtgttgcttatggttctcgagtcatgaaaattgcttgtttcggttgaatgggatcgggattctcgagggggattcggtcccagttaaaattgattgcgcgcgaacttttctaaaaacaaatttttgtgggagacagaaatggttcaacagagttcagcagatggagttatatacatacagtagggctaatttacatgatttatgggttcttttctgttttgtgaccccccctgaaattttcaaataaaaagtcatttctagggtaatttggggcgtaggcttagggttcagcttaggcctaggcttaggcttcagcttaggcttaagcttatgcttaagcttaggcttaggcttcagcttaggcttaggcataggcccaatacgtattcagcgacctcgaaaacccataaaaatatgttttccttgtaatttatgaatttcaaatttatgttcgaattcgggttcgggattcggaattttgaaaaataaatgccatattcgtgatcagcgccccaaattaccctagaaatgactttttatttgaaaatttcagggggggtcccaaaaccacaaaaaaagttcgatttatgttttgttttcattcattttttgttgggacttttttatggatttattttgaggatttcaagccgtttattgtggctcctctgttcgcacaaataatctaccaaaaactttttattttccaaggcattgcaacatttctcggtcgtatcttgaactcaccgaattggagcgaaaatgtttagaacaggtagaggaggaagtcgtaaaaattttttcattaatgatcgtaatatttaaatttaattattatttaaattttattttgcagaataataaatcatgatgtagctcaaactttatcatatttttatggtcaaataaaatatttgaggatgttattccgtttaacatcaaaaggttgtttataatttgattaactttgagctaaattatgatttattttctgaaaatgaatttaaaaataataataataaatttaaatttgctattattaactcttattattttcgttttatatgtgctaaaaatttgcacaaatcgtccattgaaccgatcccgatgaaaaaaaaaaattgacataaaggctagcagtctgcaaaaattttcgattttttggttggagtgccatgtgacagaaccgtttagtgaactattagtaagcctcagggcttctagttcacgaggcggggtttatatttaaataaatacggattttgcgaattaattctataacaatagcaaaattaagagaaaatattgacaaaacggtagattaatttattatgtaattaataatagtaattaagagaaaatattgacaaaacggtagattaatttattatgtaattaataatagtaattaagagaaaatattgacaaaacggtagattaatttattatgtaattaataatagtaattaagagaaaatattgacaaaacggtagattaatttattatgtaattaataatagtaattaagagaaaatattgacaaaacggtagattaatttattatgtaattaataatagtaattaagagaaaatattggtgctttctgttgtcctccattgtcactttttgcttgtcaatgcttttggtggtcatttggagggtatgtcaatttgaaagtcatttcaacaaatatttatcttagagtaatggacaaaacatatttatttctttaggcgattaattcgacaaaatgttgatcaaaaaaagtggagaaaaatctcatttcaataaaaaaaatttttttttgtatgaatataaatggaattgatcatcactgttgtttttggcgtgccaaaattttgtcgggcaaaagtttttttcagtttatgtcccaatcaaaaaagttggaaatttatttgttaccaaaaattttcataattctttctaaaatatttttaattaagttacaattatttttcagtaaaataaaaataaaattttattaaattaaaatgccaatttatgatttttgttgcacatataccacagattgtcacccatgtgtgttttcaacagcgcgaacggggcgccggtgttgagccacttgtgcagcaacatgacgacatcgaagggtacaaacaacaacagcaacaagcagccaagggcggtggggtcggcggtatggatcagttgcgcaaggaggagccggtccaaattggttggatgaccgaggccaaggattgggccgg

SEQ ID NO: 66814 - DNA, 388 bp, Heterodera glycines
  Genomic contig location: Contig_ID=SeqID_1042; Location=5933..6320; Strand=-
  SCN-specific regions: Sequence locations=1-232,254-388
atgctaccgggacgggatcccggcattcccgatctgggcgttttgtctaaaagaaacgggaccgggagctggttaaaagctccggcgtgggcccctgctggtcccgtccggtctctaataattatggcatggcatacccggcccaatccttggcctcggtcatccaaccaatttggaccggctcctccttgcgcaactgatccataccgccgaccccaccgcccttggctgcttgttgctgttgttgtttgtacccttcgatgtcgtcatgttgctgcacaagtggctcaacaccggcgccccgttcgcgctgttgaaaacacacatgggtgacaatctgtggtatatgtgcaacaaaaatcataaattggcattttaatttaataaa

SEQ ID NO: 66815 - DNA, 2018 bp, Heterodera glycines; identical to SEQ ID NO: 1044
  Genomic contig location: Contig_ID=SeqID_1044; Location=1..2018; Strand=+
  SCN-specific regions: Sequence locations=1-198,220-1430,1482 -1674,1696-1857,1880-1892,1914-2018
  Gene Ontology: Mol. function=calcium-activated potassium channel activity; Cellular component=plasma membrane; Biological process =male courtship behavior (sensu Insecta), song production

SEQ ID NO: 66816 - DNA, 833 bp, Heterodera glycines
  Genomic contig location: Contig_ID=SeqID_1045; Location=274..1106; Strand=+
  SCN-specific regions: Sequence locations=1-2,42-189,211-263,312 -485,519-524,551-593,615-616,640-833
  Gene Ontology: Mol. function=calcium-activated potassium channel activity; Cellular component=plasma membrane; Biological process =male courtship behavior (sensu Insecta), song production
atgggtgggtggggaaggagaggaagtggggtgtctcgtgagcccagcccaggtgccaatgccatgaaatcctttttagccaacattatgcgtgtcatctccatcaaaaactactcgtccgacatccgggttattgtccagctgatgcaataccacaacaaggtgttgttcatacatttttcatgccattatatgcaattttattcaattaatttgcttcttttttttaaggcgtatttgctgaacatcccaagttgggtaagtttttattcatttactataatattttaaattatttttatgatttatatgtaacaaattcaatattcattttgtttcaaggattggcgacggggtgacgatgtgatctgtttggcagagcttaaggtaatctccaaagatgggtagtgagtttttaaaagaattatttgaaaaatacgagagaaaaagtccgagcgtttaggcaatttaaaccgaacataaaatttaatccgggaaaattttttcaatcaatttaattgcgcgttactacatatacatatgtatgtaccggaacccgtcagttggaccccggcacgtttgggccccagcggttttttggctataacttttttctttgtcatccaaatcaaacattgttggtatcattcgaaagctgtaagtgtcctctattagcctgcaaaattttgaaaaattatgtaaaggttcaaaaaaattatggccagaacaactcaaaaaaccagattttccaacttttatggccataaatttgtacaaaattgacgcaattttttgtaaatttgcagactaatagagcatctgaagggctttag

SEQ ID NO: 66817 - DNA, 3210 bp, Heterodera glycines
  Genomic contig location: Contig_ID=SeqID_1046; Location=326..3535; Strand=+
  SCN-specific regions: Sequence locations=1-134,167-355,404-838,872 -962,987-1008,1031-1038,1060-1102,1154-1258,1334-1353,1378-1412,1436 -2126,2222-2347,2372-2500,2522-2549,2574-2776,2798-2868,2890-3210
  Gene Ontology: Mol. function=calcium-activated potassium channel activity; Cellular component=plasma membrane; Biological process =male courtship behavior (sensu Insecta), song production
tcgcctcacatggccgaatggctgaacgaatatttgcgaggtgctggcatggagtaagtaaattcatcaattaacaaattaatgactaggtcatttcgtaaaactgacatattaagtgttttttcaacaattacataatttttatcataaatttaattaaaattaacaaaacatacattcttgttatcattcgatagcaagtaaattttcctctactcgccaagcaaagcaaaatttcaatgaatttcatcaagtttaaaaatatttcttggaaacgaaatacgatagtatgataatttgaaatcttatccctgaatattgattatgaaaattttttttaataaccatttcacagtatatttttttaaagacatttaatttttcaaaattttattaaaattttgaacgagttccaaagtctgtgactgtttcagaatgaagttttctcaattaatgttctacatttctattacaatttaaaaaaatttcaaacaaaatttttcaaaaaaaaaactacaaattctttcgaaaattttgaaaaaatcgcttcaaattttttctttaaatttttctaatatacatacctaattcctaattctaaaagagaattggccccgagaccccaatcgagtgaaccagaaccattacactcttgcatatatctcaactaaccaatcatttgattgattgcattttcaaataaatgccattgactgaccctttctttctctatgctaatttggaggatgtacaccgaaacgatgagtcactcgttcgccggaatgcgcttccgagacgcggctgagtgagtacagcagtactgttgttgtgtggtgcgaatttatatagtaataatttttttttaatatttccctccaataatttgtaaggctagactttcaaaaaattgaaacactccctaaaatggaattcattaaatttttatgaaattaagatgttttttcttgaaatatttaaattttttgttgcttttcctcccccatatacatattatttaattaattaatttgttttgccgtttctgtgcattgtttgtctaaaaaagtcagtcagaattttgaactagatatgagtattatgcaatttattaattaataattttatatatgtaaaatttaatttataattttttgttaatctccttaaaaatatttcccaccaaatttagtccaaacatacaccagattggctgtcattgtgagttactcgccataaataaatatttttggcttggagcaaaaaataaaataaaatatttttttcagtataaagtataaaaaatcgatttttaataaaaaaaattaaaaaaaaacgaaaaacattttaagcaaattgatatttaaatgtatttatatttatgagtctaagctccaacgcataacatattatcttcaaatattcaataaaacttaatgaatgtcattcatttccagctatctttgcggggcaggcatggagtaagcgcttaaataatcttacactttcgataggttctttggccttacattgggattttttttaccaaattttttttcctaattttgtctagtttcaatgaacctaacatgcccaatttttttttttctaaaatcaaaggctattttcgggcatatccgtaacctgaaattttcgaccggcaggtggagaacctgaaaattctttttttttctctaatttttaatttctccccccccctggttacggagcctgttgtcggtagtatttctgtcacatccattgcgtcatttctccttttttgggatgtacaccgagacattgagccactcttttgtcggcatgcgtttcccagacgcggctcagtctgttttttttctttctctttttgttatctgagtgctgttggtgatcggatggaataatatgggtcagagaaagcctaacaaaagtgcctaacaaattggcaataatttgcttcagcttttaatcttatctctgctcgcaccagagacgtccccaggaattctgcttggacgggatactttttttgtttttgtttttttgcttttacctcactttttcgatgcgcttttttgggtttagtgtggataagtttggtctatgaatgagttgggtgaacccgtcaattatttttattttaagctttaagattttcaaatattaatttttatttttttagaattttgtttttcattatttgactttttttttaatatttttaaattttactatgtattcatttcattcgaccagggaatttacatcttttaagttttttacatcccttttcaggcacaaaaaaaatcataaattgtttttctcgatggcaattatatttctcagttgatgaatcttatattaatagataataatatatagttttcgaattattacttaaagtaaaaatttcagcctaaacggttcatgggaaaggtctaacttccgaaaaaatggggtgtgtaatatcataacagccaatcgaattgaatttctgactgactttttgctgttgttttgttgtatgtgtatttaaatcttcataaatcacgaaaaatccatttttaaattcaaaatccgttcaacaatttgcagacttttgttcactcgtctgggccttttgctgttggccattgagctgaaggatgatgaaaagaaggagtgcaacattgccattaatccgggcccaagcacggtgatccaatcccaaacccaaggctttttcatcgcccaatcggcggatgaagtgaaacggtgggcccacttttttgggtggagggagagccactcgagaattcaactcgagaaatttctcctctcgagaaatgggaacgagaatttcgggagttcttttttctaacattttagttaggggctttatttttaggattttaccttatgctaacatatttcttgcaaaacttccaagtcatcctaaaaaaaaatcttgtccgtatgcgtcagttctaattgctaaaaatatgtagaagcccctaattatagtaaatcgttgaaaactttttcattaccgtacacgcttcattttttattcctaatccactgaatttgctgctggcttactgtattttttccttactgtagtgccttctattggtgtaaaatttgtcacgctgatgtgtacgacgtttcgttgatcaaaaagtgcaaatgcaaaaatttgtcactgtttcgcaaaggcggcaaggcaatgat

SEQ ID NO: 66818 - DNA, 1727 bp, Heterodera glycines
  Genomic contig location: Contig_ID=SeqID_8044; Location=2576..4302; Strand=-
  SCN-specific regions: Sequence locations=1-31,53-205,239-1310,1332 -1727
atggatcaaactgatcacagtgccgttggtccctcctcatcctcgccttccctcccagtttcgtccaccgtcccgcgaaatgcgcttttattcgacccagcggcaccggcggaagttcaacagcaacaaaatgcggcggaggaggaggacgaccaattctatgaactgacggccgaagacttgcgcaaaatgctcaaagcgttgcaggatgagaggtaaagaaagaggagagttccgacttgtttttcaattgaatattttggtccataaattggcatattcttccagcaaaagacagaattcgctgttgccaaccaaactgatgaaagagagggaccaacagctgaagcacaaggcgtacaaacattcgattgtgcgctttcgcctgaacaatggtcaaattttacaggcgcaattcctctccaccgaaccaggtttttgctaattggccttttgtcccaatcccatgttccaatttatcaaattaaacaaaatggagaaattcagtttcggcactgttcattttcctgcgccaaatcatttcgccaacgattcgtttcgaattgcgccaaattccgaccaccagtggaaaattgaaatcagacgactcgaccacttcgctgttggacgcgggcattacgccgaaaagtgtgctcattttgaaaattgtggcggccgacaattcaccggaatcacctgagcaaatgaacgccgaccaaatttttgtggtcgacagttttcaaagctgcacacaaacggaagcaaaggccgaagctcaaaaatggtaaagttcaacatggatttattctccttaaaattgtataatcgttatgttatgggtactaatttggtttggatccactttatgtatttgttcgaaatggttatttgaaaaattcagcgatttatgaccataatttaaaaaatgtccgagcctccaaaatttcttccgtcccaaaaaatcagaaagtatttggaaaaatgatctgtggttgtcaaatctctctttgggctcttgcttaaatttctgccacgtcgattcaattgaatttgtgtattggcaataaacgattttgataattaaaatcaaaaattagacaaaactagtacaatttttgttcacttggccaactccactccaagtccaaatttaatgataccctcaaaaatagccacttaacgcttcattgcttacaattagtttacttccgcattcttaaaacttttttctcattttaggctgtcgtcaaacaccgaattccgtccctatttggacaccattttgcacatgttgccctccacagacaattcaactgcaacagcagcagcaatgccaagtccggtgatgccttcctcgtcggcaccacacgacagtggcggcggtggcacgaacagtcaaagcagaaacaacagtcaacgaacaacgaagccgagttcagaactgccgaaatggttgaagcggaagtgatcaaaagcaaaagccaagcggtgatgacagacaacagaacggacacattaattaatgccgaattatttttgtttgccttttcttgctgtttatttatttcggtaatagtttagatggtacacccccttttttaaaaatttttttcaactttcaaaaaatcataaaaacatgttctaggggttttcggggtcgctgatcacgaatccgacatccatttcgaccgattccgaacccctgacccggattcgaacaaaataaa

SEQ ID NO: 66819 - DNA, 100 bp, Heterodera glycines
  Genomic contig location: Contig_ID=SeqID_8045; Location=20..119; Strand=-
  SCN-specific regions: Sequence locations=1-71,95-100
atgccggagcagttcacgcttggtgttcagcagccgtccgacccgatttgccacgcgtgggaatgtgcacgcgacgcaatccaacaacaacagcacgatg

SEQ ID NO: 66820 - DNA, 1101 bp, Heterodera glycines
  Genomic contig location: Contig_ID=SeqID_8045; Location=1363..2463; Strand=-
  SCN-specific regions: Sequence locations=1-122,149-260,290-444,466 -538,560-766,790-1101
tacaaaaatgatgggaagcgcgtctatttgccatgtgcgttcggctgctttaatttacattacccgatattctaatccgttttcagttgaccccaagccaattttggagggcactcgcatcaacaggtgcctctgcctggatcattctgtcccttttttaatttgtccatttcaattagtccccattatctttgtcaactgattgtccgtgagcctggcattcaacgctttacgcttgtcattgcgcaagtacaaatatcatatattaatttattttaatattaatttagtttaccatatccatctctcccaatattttcttttacagtatgaaaagatgaagaccatttactacagtttgcgggtgtattcgagcgcagattttcgttgcggtaatatgccaatgccgtacaaattccaccgcaaagtgggttaaggaaacaaatttcattgaaaaaattgaaagtaaattttaaggaagcggcggaatggcgtggcccaactgcaggcggatgtggaaacggggcgagcagagagacatttcagtgagcaaattggcaaactttaccttaagcgcgttgctcataattggactttctcaaaactgattataaatccgggatttctcgagactaaagagcgatcctcctctcgagcagctttatcaattttttttaaaccaatcaaaagaatcgccaaccattaatcaacaaacattgatttctgcagaaacaatcccctctttcacctgtgtacggaagacggcagtgatgacaatgctctgctggtggaattgcgcggtcccaaggagttcagtgtcggcttcgaactcgcaccggtgtctctgaccagaaatgaccggacttttgagacaaaagactcgggaccgttcaggtaattcagctgttttgttatcatcccaaagactgtcggcacaatattgtcattccgttttccaggcctggcttcaccgttctccaattggatgagctgccggccggcacttattccattcggccgatgacttttgtcgctgggcaggagggcccgttcattctgcgcgtggactgttcatgcaaattcgagttgaagcgagtgcaa

SEQ ID NO: 66821 - DNA, 56 bp, Heterodera glycines
  Genomic contig location: Contig_ID=SeqID_37822; Location=727..782; Strand=-
  SCN-specific regions: Sequence locations=1-56
gctatagggaagctatccccgaaggattcggtctcctcataaatctgggcgcatcg

SEQ ID NO: 66822 - DNA, 191 bp, Heterodera glycines
  Genomic contig location: Contig_ID=SeqID_37824; Location=674..864; Strand=-
  SCN-specific regions: Sequence locations=1-191
aggatgggcctccgtgggcgcgagttgctcagacagacgggcaaaatcgcggcgcaaatgggcggttccttcggcgtttttatgaccgttgcgcaaggcattcgatgctgagggacggccgagagagaacgttttgtgctttttatattttatttagctgttttttgttggcctaataaattatattctca

SEQ ID NO: 66823 - DNA, 408 bp, Heterodera glycines
  Genomic contig location: Contig_ID=SeqID_37825; Location=92..499; Strand=-
  SCN-specific regions: Sequence locations=1-51,76-93,115-124,154 -352,375-408
atggcattaatcactttaagagagagggaggattactacgatgccgtacgagcagaagaggaggaggcggagaaggcaacattgacaagcagtacagcagcaaacagaggcaacgaaaagcaacaagaagaggaggaggagcaggaagaagcgagacaattacagcaaatgatggcacttctggtggccaacattgacccggtgccaatggtttaccgccaacagcgaaaagccaaaaacgatagcacaaacgatggcaccgacaaaggcagcaaccgcgttgacaatggtctaaagtggacggggaaacgtacgacgaacggacagaagcgggcaaagacgacgaagagacagacgatgatgatgacgaagagcatgaaacccgcaaaatggttgacacggaattga

SEQ ID NO: 66824 - DNA, 1210 bp, Heterodera glycines
  Genomic contig location: Contig_ID=SeqID_8047; Location=261..1470; Strand=-
  SCN-specific regions: Sequence locations=1-409,432-952,978-1210
atgtccatgattgcctactcggaggatgccgacgatctgtcggattccgaagtcgtggccacttttctgctgtccaacacttcaaacatttggcttaggggccttcagttcagtttggccgaaagcatggagcagttcgtttgcactgcgatgctttctctgactttcgcttttcctcagatgttttgacgccctcaaaaattccggccttcccatcagtgcagagccaagcgaagacggaatgccatggtgtaacgcaacttgggacaccgttttatgctggtaggacgaacagtgacgaaaagcatatccgatcagccaaaaccgatcatttggactgactgtgccaatgaatgggttttggtttggttgaataaagtcactcttttccgctccccctcagttccatcattcattttgcttgttttaggcccgcgatccccggaggtcaatcggtgtccctcaggtattgtgctttcatatgagtcggatgattatggcattgttttttaaggtgccctcctctcaagggattggacaccaccagtgagtcatttcgtttggcattgccttgggggggagaagtggccaatgccatccagcagactaatccctgattaatttgtcagagtccatcaccaaattctgtcatccgtccggccaatggatgggcaaaacggaggacgatttttcccgtccgcatggctggacaaacttcacaatgtgttttactcaagaggcaggcactttcattaattggcatttgctcctttggcctttatttttctgatcagcgactgatttgtccgttcttcaggtcgtggccattatgcagaacatggacaatggcactcttctggtgattttaacaaaatttttcaattggtctttttccttgtcagatggcacaagaagtggcaaaaaacgtgcgcaaattggagttcgtcgggctcggcctttctctgatctcacttttcttcagtgtcgccattttctccttgtttcggtcccttttaattaattgcctattttattatttcccctttttaggcgtttacgtgtatttcgcaacttaattcacctccatttgatggtcgcactgctcgccgtcgttctcattcgtctcgtcctttacattgacctcattttcaccgaccgaatgggccaccaacaattggtcaatccgcacgggaaaacgatcaacactatg

SEQ ID NO: 66825 - DNA, 214 bp, Heterodera glycines
  Genomic contig location: Contig_ID=SeqID_37834; Location=102..315; Strand=+
  SCN-specific regions: Sequence locations=1-214
atttagaaacgggcgcaagcgcccgtctgaggccgcgaagcggccttaatagcccaacaaatttagaaacgggcgcgaagcgcccgtctgaggcctcgaagctgccttaatagcccaacaaatttagaaacgggcgcgaagcgcccgtataagcccaacaaaatttaaaaaacgggcgcaaagcgcccgttcgaggccgcgaagcggcctaaaa

SEQ ID NO: 66826 - DNA, 947 bp, Heterodera glycines
  Genomic contig location: Contig_ID=SeqID_37838; Location=31..977; Strand=-
  SCN-specific regions: Sequence locations=1-68,92-292,344-541,567 -628,650-656,683-947
atgcgtcacgcaatgcgaatgtttctcgtcccggaggacgtctttcagtcggtatttgttcaaccccaagcagcagcagcagcagcagcagacggtgccgacggcacaccaattgggcttttgcgctcgcgcatccaacaaattgagcgcagcagggagctgaacgaagagcagaaggccgcgcaataccatcaggaattcaaacggctcaacaaactggtgcgcgagcaggaggagcagccgatcaatgttcgacttcagcacgaaaaggagagagaaaaaaatgcagcaacgccgccgccgccgccgccgccgccgccgccgccgccgccgccgccgccgcaaacgatcgatcattcaacgccaaaaagattggagaaaaacattgtaccatcagcgtttgggttgaggaggcaaagacaccactacacacaaaaggcgggggcattatcaaatcgcagacctgcccaaaaacaacaaagaaaagcagcagcagcagcagaaacaccaaacagcagtggaaatggagaaacggaaaaagaagagggtgatgaagatgatggggaacagtgggacgacgcacaatcatcatcgtccacggcgtcaacaggtggtgccgcagcaaaaagagtgctcagagcaagagatggggaagcaggaaaaggaggaggaggaggaggagaaacggctgatcgccttcaaccaaaacacaactaccagatgaccaaaaatgcactgatcacacacattcgaaaaaaggggcacagtctgggagtcagtgatcagggaaaggttttgcgcgcagatgggtccgagtttaaaacgagcaacgtggaggcaattgtcagccatttgttgaacagggacaagcgaagcgaattcaaagggccgcctgtgggctataaggaatttgctgaaaaggcaagagaggatccgttgctaaaaaa

SEQ ID NO: 66827 - DNA, 297 bp, Heterodera glycines
  Genomic contig location: Contig_ID=SeqID_8050; Location=624..920; Strand=+
  SCN-specific regions: Sequence locations=1-7,29-297
atgtcatgtaaaataaattttggcctaaagagcagattgaagaaatattgataatattttatttgctaaattttttattttgggctaataaaattagagaccggaaatttcaaatttgcagatcccgctgcgggactggaactcaaaattttttgcgggactggatcccgcgggattaatcccgcaaatcccgcatttaaaatttgcgggatcccgtgcgggattgcgggattttggaaaatcgaaaaaatttcaattaaattcaaagaatttccaaaaatcaaaaaatgctgaaaa

SEQ ID NO: 66828 - DNA, 1049 bp, Heterodera glycines
  Genomic contig location: Contig_ID=SeqID_8051; Location=1722..2770; Strand=+
  SCN-specific regions: Sequence locations=1-202,227-542,569-615,637 -1049
atgttaagcttcagaatgataccaacaatgttggatttagatgacaagaaaaaagttatagtggaaaatcatgctggcgcccatccgtgagcgcccaacagaggtaaaccgtcattctttattacttttcttagaaacgaccaaattccactttcttggcatcattcggctgccttaagtgttcgttcttctattagcttgcaaaattaaaaaaaaaatttattaagtttccaaaaattattgccagaaaaattcaaaaaaccggattttcgaacatttttggccataattttttgaaactcagttaacttttttgaaattttgcaggttaataaatgacacagggctatcgaatgatgctaagaatgtatctaagaaaagttacaaactctcaaaatatgccgcattaaatggctaatgactccaccgcccttctttgaattctttttccttttatgaaaaaaaattatcttttcttcgtgcaaattattttcacaaagcttttccttcaatgaatttggcacaatgccaaaaaatttgatggccctcctcccccgccgcccaaaaattgttggcacaatggcccccaatttctggcacagcgcaaaacacattgattttggccaccactttttaaaaacataaagcatgacactgctgctggtcgtcgtcgttggcgccgcggtggtgatggagagcctagccttggccgcagcaaatcggtgcgccaagatcagctcagcagagcgccgtcgggtcgccgtttgctcgaaagattggtggaagagaaacctgtgacaagcgtgagcaccaaaataacaaaaaggtcctgctgtgcaattgcattttgtcgcccgcccggtgggcatcgaacccacggcatttccataccgcgtgggaatgctctgaccgactgagctacgggcacggtgctatttcgttattaaaaaaagccataaaaagggcgttataaaaaaactaacaaaaatgaaattttcaacaaaaaaatacccgtaatttttctcaaaacctttatttttttttatata

SEQ ID NO: 66829 - DNA, 169 bp, Heterodera glycines
  Genomic contig location: Contig_ID=SeqID_37844; Location=76..244; Strand=-
  SCN-specific regions: Sequence locations=1-169
atgccattgtcagcaaattttaccaaattagcagctttttcaattggcattttggcgttgctaccaattttatcagcagaagcgcaagcgatggaaactgcagatgatgagggaattgacgcgcagaagctgctttttctcgcttgtattcagggcaaattggaatcgg

SEQ ID NO: 66830 - DNA, 304 bp, Heterodera glycines; identical to SEQ ID NO: 51570
  Genomic contig location: Contig_ID=SeqID_37845; Location=185..488; Strand=-
  SCN-specific regions: Sequence locations=1-304

SEQ ID NO: 66831 - DNA, 141 bp, Heterodera glycines
  Genomic contig location: Contig_ID=SeqID_37845; Location=692..832; Strand=-
  SCN-specific regions: Sequence locations=1-141
agccctccgtctcatacgcaagcgcttttgtgagtataaaatttctcaaaaaaagagatagccatttttctgggatagagtataaatttaaaaattccctcaaaaataaaaggtctattgcgcaccgccctccctatcata

SEQ ID NO: 66832 - DNA, 691 bp, Heterodera glycines
  misc_feature (651)..(651): n is a, c, g, or t
  Genomic contig location: Contig_ID=SeqID_37847; Location=14..704; Strand=-
  SCN-specific regions: Sequence locations=1-23,48-140,168-232,279 -447,479-691
atgttgaggacggacaaggacgagctgaaggaggagaagcagcggctgaaggaggtgagaatggacggcaaaaaaaacaacagcaacaacaataaagcgatgaaaataaacattttgttggcacatttgtatgaaaaaaactttattttttaaaatttttcgggcgggggacagtgaattgtgtacgggaaatttcggcattttctttggcatgcaaaaaaaaaaatagcggttttaataaaaataaatttcaaatattaggttatttttaaaaaattccaggtctttctgtgcgccaaccaacagggctgggccagtccgaacgctgttgcgcatgtgaaccgttgcaatgtgtcgctgggaatggacatttggctgcactgttggcttggccaaatgctcaaccagtttgtcctcaaattcatcattttttttattaccattttcaaaaaaaaatcaaaaattaatattaaaaaaactggaaacttcgaaaatataaatttatcggggaggggaagggaaatcagctcagctatttgatttcgtccgtccgatggttagtcaattagcattcattgtcagctcttttccatgcagaactcggattgccaccgtggacgagggtgaattggctgcggaactgtgcctggncaccgcgtcactaacccagtggcgtgcctgtgcgaaatga

SEQ ID NO: 66833 - DNA, 541 bp, Heterodera glycines
  Genomic contig location: Contig_ID=SeqID_37848; Location=103..643; Strand=+
  SCN-specific regions: Sequence locations=1-4,29-83,105-168,201 -203,253-350,420-541
atgaaagaagaagaagaagaagaagaagttgttcaattgtattttgaggcaaagcaatcgaaaaaaagaagaattcaatggccaaagaacacagtgaaaaggcaacacaatttgagaaaagatcaaacaaatacaacgacacactcattaagcaattaattaattatgtcattaaaatttaacaaaaatcttttccttttgagattaaaaatgaaaaaataaatacaataaatacatttaacaattttatttctatagaaaatgttgcaaattgtcgctagtctttttcataatgtccttatcagcttatcactttacaatatgaaaaaagtgagcaaaaaatcgcatgtgacaggattcgaacctgcgcgggtcaaaccctttgcgtcttaagcgcaacgccttaaccactcggccacacatgcagtggacaacggacccaaattatcattttctgtgtgaaagggcataaataaataatcagtgattggtatttgaccacccgaatgtcacgccaaaataagcacaaaataatcaaaaa

SEQ ID NO: 66834 - DNA, 392 bp, Heterodera glycines
  Genomic contig location: Contig_ID=SeqID_37849; Location=355..746; Strand=-
  SCN-specific regions: Sequence locations=1-202,247-392
atgacagcaaaaaggatgggagacggtaatttgaatgtgattaagtgataagcggataatgagagacaaatgggtggagataattagtaaatagtcattgaacattatgtaattagatggacaaaaagcaaaaggaatgtgagacattattaagtaattaagacattaaaaatggagacggacaactgacaactgacaattgattaaataaaagataaatggataaaattggagccataaaatgagtgaaaattccgtttccagaaattgttgatgttgaaagcagcggaagatctgaagaagcagcagatgatgaaggagcaagaacggcaagaagtactcagcaagcgaattgtgccattgcccgaattggactcacgtggcgacggtga

SEQ ID NO: 66835 - DNA, 1473 bp, Heterodera glycines
  Genomic contig location: Contig_ID=SeqID_8053; Location=1236..2708; Strand=+
  SCN-specific regions: Sequence locations=1-1428,1450-1473
atggtcatcacacgcagtccgattttgacacggcaacgagcgttgaatttggagattgccgttgacagaaatggacatcagattaatgtcggtggaaatcagcagaactctccacaacgccaaaatcacagtgctggagaaagttttccccaaaatcagcaaattgaaaactcgccaatctcacccactgaactcgcgggctttaatggggaaaatggtgatgacagttctcttgttttagaaccaaatatgaccgaagaggaattgcgcagacgcttgttggtggtcagcattgaacgtagccagccgccagccaacggaaatgccggaaatggagaaaacgccgaaggtttgcgaaacgcaatcagggaaaatgatggacgaccgaattttggagtaaatggtcaaacatttgcccaccaaaggaggccgcatgacactttcttatcaaatttgatgaataatggaataggaaactttcctcaaaatttggtccatgtaccgcgcacttctaccccaactcgaaatgttgaatttgaacagcaaataggaccattcccgtttgttgttgaccgcaacaacagagcaccaaccccacctttaaacatacggcaacaaattttccaccccatcccactgaatgcacaccgcattaaccaagtgtcggttaacgcgcaacgcaacattgacgttcagtacgtaccaaataattgcgttaatgtcccgccaaacgtacagcgtcattgcgacattcagtacaccgctcctaaccctgtcgccgcgccatcaaacgcgcaacaaattcaagcaggaagtagacttattcaaaacattccaatgcaggctcagctttggcagggccctgatggaaaaatgactttggtttacccccaagaccaacagcaacaagtgcagatcgagcaacctaatttggctcaaaatcatcaaaaattcactcgccaggtctttcagattccggaaacgaatcaagagcctagacatttccctacctacccccaaccgaatgttgcgccaagcaacctcgaattcaacttgattttggaaagaattccggatctaaatggaaatgagggtacagattctgtgcgccgctttttcaaaaaatttgatgcatacaccgacggatggccaaacgcgaaacgaatttcggcgttagaaagcaaagtttacaacaaagcagaaagagcttttgaggcagcaaagtcaaagcgccttaccgagtcaaaaaatttggaaatttatctcatatgcaatttcaaccaataaatttgaagaaattttgcactcaattttgaaaaatttatgtccatattttgacatttttgccattttatgtccatattttgcgatttttggtccatattttatggccatatttcgcgattttatatccatatttttaccatccctaatcatgaattaaaaatggcaaagggcgaccgattgaattaa

SEQ ID NO: 66836 - DNA, 1067 bp, Heterodera glycines
  Genomic contig location: Contig_ID=SeqID_8054; Location=109..1175; Strand=+
  SCN-specific regions: Sequence locations=1-68,90-307,329-329,351 -559,581-785,813-894,919-922,944-1067
ctggtggaacgacaaaacaatcggcgcacagtaaaggccaataccgcacgaaaagtggtgcaaaaagtggagagaaaagaaggaaggcatcaatgcctttggaaatggcaacacaaactgccaaaaacaacgccaattttcaaaacagtccgccattgatgccgcagcatcggccaactcccggcactttctcccctccgccgaatcgttcgctgtttccgccgcaaagccttgggattgttcaaatcggaagtaattcttgaatattttatgttgttcacaatttccctcactttagcctcacttcctcctcaaaatgagcagcctttgcttcgctttgccccttttttgcctcctccgccccctcagcacggcattttgcgtccgcccgtcccgctttttgtgcctccggcggccgatgctttcattccatcgcaatttgcgccttcgtttgactcgtccgcaacggcgtcaacaatcaatgctatgaacatgaacatggtcattcccccgttgatgatgctgcaccaacagcaacagtccaacaacaatgccgagcgaacgacggcgacagcggcggcgacatggacactttttgaaatgttggcaaaaggcacaacgccaaatggtcagcaacagaaaaacgaaatgggacaacaatcgcaacagaataataacacaaacagaggacaacaaaatggcacaacagaaaatgagggaccaataaatgtgtaagttgtgaagagaaattttgccaattattttgtatttgaaataattttaattatttgacaaatacaaaaaacacatgccaggtgttttcgacagtgattgaatttgagtaaaagctaaaatttttggtgattcgaacgatgcgaaccaaactcgactcgagaacaaaaaaccaaacgaccgaaacacaaaaggcaattctttccaacaaattcagcacttctccttcacattctttggttgtttgttcaccaaatttgctgagaaactcagaaagtgacgcgcaaattgatcagctaatggatcaaatgattgctcaaagacatgccgacgat

SEQ ID NO: 66837 - DNA, 598 bp, Heterodera glycines
  Genomic contig location: Contig_ID=SeqID_37852; Location=604..1201; Strand=-
  SCN-specific regions: Sequence locations=1-158,182-477,501-598
  Gene Ontology: Mol. function=catalytic activity; Cellular component =endoplasmic reticulum membrane; Biological process=GPI anchor biosynthesis
tttttgactgtccgttttcagttggcttcgtccctttcactttttcttccgccgtttgtgccgcgtgcactgtcatggctcattttgacctcgtcgttctgttcctttgctgctttgaacttgtccattccgatgtcttcggtcccttcgctttgttttgcttttgttccttcgcttcttccgccactcttttggctcattttgcgcttctccgatcgtcggatctgttccaaatttcgtcttccgattttgttgaatattgccgaacttttgtcacaattctcgcgtttggttacgcttttactccggtgataaggtgagaaagggggataaatgaccaataattgtttaattgcaattttaggacattgaccacttcaattagcactgacaccatttacgcctgtgccattctgctctttttcgccagtctttttgtccacgactacggcataaatgtgccggtgttcgttcgtgccaatgttttattttctttttaacgatggcatttcccgttttagcgtcagtttgcctttgtcggcaaatctttgcctcgccgcttccgtttttttgatttctcgtctccaatccgactttg

SEQ ID NO: 66838 - DNA, 180 bp, Heterodera glycines
  Genomic contig location: Contig_ID=SeqID_37857; Location=634..813; Strand=+
  SCN-specific regions: Sequence locations=1-180
atggtcgaccgctttcagaagggtcaatgtgcagcagttgaacaacagcaaaaacagaatgaactgaacaacacgaacaacgatgaggatgcagacgaacacgatgagttggtgcagcagcgccagcagagaacgccaattgcgccaataatgcgccaaaattcgctccatacgctccca

SEQ ID NO: 66839 - DNA, 127 bp, Heterodera glycines
  Genomic contig location: Contig_ID=SeqID_37857; Location=1..127; Strand=+
  SCN-specific regions: Sequence locations=1-127
cagctttcttctggctcctcctcgtccgcgtcgggtgcagcagcgggacgcgacgtgcacgtgcggacgccactgaacgacccgcggtcaccgtttaagccattggcttacacatcttttgagccgg

SEQ ID NO: 66840 - DNA, 363 bp, Heterodera glycines
  Genomic contig location: Contig_ID=SeqID_37859; Location=130..492; Strand=-
  SCN-specific regions: Sequence locations=1-363
atgtcgcgtaaggcgcgggatgtgatgatcaaactgcgcgaggtcagcatgcgacttggcggtgctcagtatttcaagaagcgcagcaacgaagccatttcttgtgaggtaaaatgtggtggtaattgctgggcaatacgaaatgatttactgatcggaggctgtcttttaccccatttatcatatgacagctaaaatatacaataaaaatcactatgctcccttgtcgcctttcctcattgtttttcgtatttatttcccctttttcagaaatgtggcaaactcgtcatcaatcgtctgtctgatcacgcttactctcacttggaggggtgcgacctgttcaagtgccaacagtgcaacttg

SEQ ID NO: 66841 - DNA, 257 bp, Heterodera glycines
  Genomic contig location: Contig_ID=SeqID_37860; Location=423..679; Strand=+
  SCN-specific regions: Sequence locations=1-257
atggcgcattttatgcaaattgaaaattctgccgaattgtacagtaattctgccaatattcgcaatgcatcaaaactgtgcccaatgcgtttgtttgtaggtgccatgttcagcagattaagggacgatttcgccaaaatcgaaggtagcgaaaagtggcatttcgatgtggtacgaggtctggcatatttggatttggaattttccgatgtcgcattgaagaaacgcagaatcagcgaagaacaatgcactaaaat

SEQ ID NO: 66842 - DNA, 744 bp, Heterodera glycines
  Genomic contig location: Contig_ID=SeqID_37861; Location=168..911; Strand=-
  SCN-specific regions: Sequence locations=1-104,127-464,487-518,550-744
  Gene Ontology: Mol. function=axon guidance receptor activity; Cellular component=extracellular space; Biological process =regulation of protein activity, epigenetic
atgacccatttgttagaaggggcgggcgatgccgagttgggctgtgggggacaatcagttcaaagagagagatgtaacgacacaaagtgcgaattgtcaccagtgaacgacggagggcaatggggcgaagtgagttaccgacccccgggggataaaaaccgcaaaatcatttgccaatttacagtggcaaccgtgctcagtgagttgcggcatcggatttcagttcagagaaagactttgcgcagacggaccatgtgccaacagcgggaagcaggcgaggacatgcaacgttcaggtgaattccaaagccaaagccttggccacttgcctcttaggactgttcccgcgtcctcggcatgcccgtgtggagtgggtggtccctgtggagcgtttgttcccggacctgtggccaaggcattcagcaacgctttcgacgatgcttgaacggactttgtcctcccggggaagctttgagagagcaaaagcgatgcgttcttggcccatgcccgcaggcagttcacacaaacgacacacacacacacacacacaaaacccttttattttcagtggtcaaattggtcccaatggaccaattgtgcgtcttgcagtgtttttgagacacgcaaaagacacaggcaatgtgtagtgaaagtggcaacagcgaacggccaacaggaagagactgagttaggacaggaggcatgcaattcggcaggtggacaaagcgaaagcacggaaatttga

SEQ ID NO: 66843 - DNA, 60 bp, Heterodera glycines
  Genomic contig location: Contig_ID=SeqID_8056; Location=658..717; Strand=-
  SCN-specific regions: Sequence locations=1-60
atgactgttttttttcgtatccgattaatgagtgatggtccccaacaggaagcgcatttg

SEQ ID NO: 66844 - DNA, 845 bp, Heterodera glycines
  Genomic contig location: Contig_ID=SeqID_8056; Location=1576..2420; Strand=+
  SCN-specific regions: Sequence locations=1-135,158-170,249-259,281 -311,337-502,524-630,652-845
atgttccataattcgacgtattttctcattgtttttttgcttcatgaaattctcatttttacgtcggttcattgtacgatggctaaaaaaaagctacatcaacagcagcgggaggaaaactttgatagtacgacgtcagcattttcaccaaaatttgaggtatcatttagaaaaaataataaaatatatgcatatatacatttagaatatatataaatattacatacaaaattttcaaaaattttttacatgattttattttcatacattgagaaaattaacgcttttatgaaacattgatttttcagaaaagcatttattttattttatttaacttccgattaataaatatagaattttcagctccaccgtcgacatcataagcatcgactgcggcgtgccgtcatcaaaatttgcgtcgatttcaaccggcagcccattgcatgcaaatgggaaacagaggcacagttgcgcaaaaagctgatggcatgccatttgagcatcatcacaatgccattctgccatcggacagtgccgaaaattacgcggaaaatgcataaaattcaacgggaccggcgaagaggcggaattttctccgcattatagacaaaagcgtgaagaatttgagaattgtgaatttctattaatgaattctaattaacaaatttttttatcattcttgagaaaattactataaatttttttgaaaattttagggcgttaaatgctcaaatgatttcaaaagttgctgaaaacatatttttcatccctttcagtcagctgaaagtccaggaaaaaatgcatgcgcatataatttctaatcttgtacttaacttttttattaa

SEQ ID NO: 66845 - DNA, 441 bp, Heterodera glycines
  Genomic contig location: Contig_ID=SeqID_8057; Location=968..1408; Strand=-
  SCN-specific regions: Sequence locations=1-172,195-349,373-441
atggttttgggctttgaattctttgctacattatccttgcttgccaattggatggtttcggtatcagtttgctgctcgactgttacggtatttttggcatttccattctttacttgggtattgtttgaatttgctttctttacgacggtatttttggtactggaatcacaattctttccatttgttatataaacaaaattcaggacaacaaataaaagcatccaaatgttcaacatttttattttggtttcaaagaatttttttcgaattatacaaaaagcggaatttttttctttttggctaatacaacaaatataaatggatgcaatttaataatggaaatttatattttctcttcagatgatgtggcatttgtgatgacgttgatgaatctttcataagcacatagaatgaatgcaatgatgaaacaatgccaataaa

SEQ ID NO: 66846 - DNA, 1229 bp, Heterodera glycines
  Genomic contig location: Contig_ID=SeqID_8058; Location=419..1647; Strand=+
  SCN-specific regions: Sequence locations=1-137,160-299,331-362,385 -507,564-1101,1123-1229
atgtccactgtccaattgtccggttttgtccaaatgtccacgtcgaaatatccactgtctaaatgtccagatgtccactttccaaatgtccggtcatgcccaccacacgcctccccaaatatttgtttttgatttcaattattatttcttaaaaagataaatttcgggaaacaaacgaatgtgttttgagtaatttgattttttttttttgagttcctttgtgtctaatttttttgaaaatgaacggaattttttgaaattttgcaggaaaatagagaacacttagagctacgaatgttatcaagaattaaaaatttttacttgtgaaaactaacagtatatattaattattacaaatatgtcgtgtttttatcatttccgtagttttttgtccgtaattgttgaaatggcctcgtgtctaaaatgtacaacccgttattatttgcatttacatttttcatagtatcgcaatttgaatgggaattggtttttaccagttaacaatcgaaaaaaatgttttataaatttttttattataatttcatgtataatatttaatttatgaaaaaagccaatttaagaattttttttcattgggttgcatttttgtttttattgaatatttttaaagaaaaaatggttaattttttaggattactgaaattgttgttgaaattattttggataattgcgaattgttgaaaaaaattgataaaagcataacaaattttattgatgcagaattagaacaaaaaattattcaacaaaattgtgacgcattgaaaaatgacaaaaaaattgacgatgcaaaactgtctggtgaacaactaccaattctgatacaaaaacatgggcaaaaaatgttagaaaaactgaaagaaattgaaactgaaaagaatgttgacaaaatgtcccaaattttggcaccgacaaatgagcaacaacagcagcatcaaccaaattggcacaatgatcaaaaaatgcaaaaagctgtgataatttttaattttttgcgggaaatttttgctgttctacaaagcgattcaaatgctaatgatgatgatgatccaatggccaaaaatgccaaaagtgtcattcaacaatttttaacaacccaaagccaaaagcctacggtagtgccaatgccaagtgaactaatgggattggtcatcaaactttggcctatcatatacaacaatgcaccgcagaatcaacgaaaaaatcagtag

SEQ ID NO: 66847 - DNA, 698 bp, Heterodera glycines
  Genomic contig location: Contig_ID=SeqID_37864; Location=1..698; Strand=-
  SCN-specific regions: Sequence locations=1-143,191-198,220-229,251 -263,296-321,345-381,403-560,597-698
  Gene Ontology: Mol. function=amino acid-polyamine transporter activity; Cellular component=integral to membrane; Biological process=transport
cctatcgagactcgttcgtcgatgcttttacggtgccggagagtgttggcacgggacaaattgccatcgcattttactcgggactttgggcatacaacgggtggaactatttgaacttcatcacggaggtgcgccttgaagagaattttatttaaatttatattctttattttttttaatattttaaattgactcggatatctatttaaatgataataatttagttaaaattattattattattattatttccatacttaatcaaactttatttttcaaaaaactcgcaaaattaagatttttgttcttttaactaccttttaactcaataaaacatttcataaccttatgatagttgtaaccaattaggaattgattcccataattaatttcttattggtcaattaggaaatggtcaacccggtgcgcgacttgccccgtgccattttcatttcctgcacattgtgcaccctgttttacgtgctcgcaaatgtggcattctatgctggcacatcgccagacgaactgctcgaatcaaaggccatcgctgttacagtgggaatttatatttaattattttttgttaattttattttgttcaatcacaaattcaaatttaaaatttttcgccattgcacagttcgccaacaaattttacggtgcttttgcgtttgcaatgccaattttggtggccggct

SEQ ID NO: 66848 - DNA, 1081 bp, Heterodera glycines
  Genomic contig location: Contig_ID=SeqID_37865; Location=19..1099; Strand=+
  SCN-specific regions: Sequence locations=1-313,370-510,709-734,756 -921,983-1050,1072-1081
gagaagaacgtgcgtcgccttctccgaaacgttggacgaagtgcgtgtacagcatcggacaacaaatcgacaagacgaatttacgttttaacatctttttttctttaaattcgccttataaattttcccaacactttttaggaccaaatacagcgtcttacagcagccttagaagcggagaaacagaaaacgaaactcgaaaataagtttttttttaattcggaaactaaaagccaattaaaattaatcgacaaattttaagacgaggagttggcgcgtgaacgggtggcccgtgcgcaagaaaatctaaaacataaaataagttttttacaattttttattatttttttttaatttttatcaatttttcaggaggaaattcgtcatttgtattcccaaattcactaatctgaagtcagaaaatggggcgactcgaaggagaccatcgagcgtgaacgagtcttacatcaaatgggaaattgaggacctgaagataagttaataagccgctttttaagaaaaaataatttaaattaataattttattttttacacttattaataagtttttagtgcttttttacgaaaaaataaaaatttattaatgctctttgaagaaatgataatttaaagaaataatttattatttactattattaataaatttacagtaattatttaattcatctataatatactattaattaacttttcacaagcaaatcgggctgctggttgacagcttggaaacagctcaaaaaaaaatcattgagctcagtgacagtttggaagccgctgatcagaaaattgctcggctcagtgacagtttgaaaggcgctgatcagaaaattgctcagctcagtgacagtttgaaaggcgctgatcagaaaattgttgaactcactgtaaatcattgaattgaaataatatcttttaaatcaatttgaaaatataataattaaataatattttgattaaatttccgtcaaaatcaggcggaggtgaaggatttacgagctgcggctgaactccaagtgcaaaatggtgctgtgccgccggtgccgaacttggttgcagaacg

SEQ ID NO: 66849 - DNA, 418 bp, Heterodera glycines; identical to SEQ ID NO: 53014
  Genomic contig location: Contig_ID=SeqID_37867; Location=314..731; Strand=+
  SCN-specific regions: Sequence locations=1-2,30-32,155-206,236 -236,320-325,358-418

SEQ ID NO: 66850 - DNA, 998 bp, Heterodera glycines
  Genomic contig location: Contig_ID=SeqID_37867; Location=1..998; Strand=-
  SCN-specific regions: Sequence locations=24-43,69-328,361-366,450 -450,480-531,654-656,684-691,767-838,906-998
gccgcggtaattccagctctcaaaatgcatagaatattgctgcggtaaaaagctcgtagttggatctgtgctagccgtccggtgcacactttgtgtgttactggttcggttggcttttctgccggtctttccccgggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtga

SEQ ID NO: 66851 - DNA, 804 bp, Heterodera glycines
  misc_feature (787)..(787): n is a, c, g, or t
  Genomic contig location: Contig_ID=SeqID_37870; Location=1..804; Strand=+
  SCN-specific regions: Sequence locations=1-204,226-382,404-804
  Gene Ontology: Mol. function=calpain activity
tgccacacgttatctcaccaatgaatttgctggtttggtgttaatggtggacaattacagctcggacaattgtttgaaggtcgtgttttggattatgaattaattcgttttgtttatcttttttgctcaaagaatccatttcttcctatttgcgcattatttttcgaattaattcccatatttctcatttaaggtccattccgattgtcaaaactcaacaaatgttctttccactcgttcttctttgcttgcgttcgattccatccctccgctgcatcgacaggtccttctttatcgcctgtgacttcaataattgtttatggacaatgattaaaattgcgtgtcatatgaacattttgccgttttgcaatcttttagtgattttaaatgaaaagcaaaatgagtccattttaaatgggaattgctttccctgattttttctgtaaaaaagtcccctccccactttcttcaggttgtcactcttttgacgcacttcgaaccctcccaatcttttatggtcactcatcgatgggtttaccaccaaacaaaattcccacaactgcgcgactttgtgccctgcactgaatttgcttccgctcagaattttccaccgttacaaacggaaacaatcggttatttgcatggcccttttccggtctataaatgatttgttcacatcttctaatttcgtcaaacatatcttttctatttcttttgtggatttattttttcccatcttcagcatctcatacatatcacttccattgtatattttcctcctttcatncatgaatttattgactt

SEQ ID NO: 66852 - DNA, 252 bp, Heterodera glycines
  Genomic contig location: Contig_ID=SeqID_37871; Location=217..468; Strand=-
  SCN-specific regions: Sequence locations=1-175,197-252
atgccaatgcccgcaaacgataaggtttttaatatgtcgccagatgcccaagaactggaacagcggccactacctgaaccacaacaagccgaactgttgaaacaaactggagaacaacaagaagaattattgattcaaattggtgatgttgaagatacattgcttctcaccgaacatgaaggagaagaaaggaaagatgaagcaaatcaagaattagggagaactataatgttgagcaagttgaacaattga

SEQ ID NO: 66853 - DNA, 706 bp, Heterodera glycines
  Genomic contig location: Contig_ID=SeqID_8062; Location=411..1116; Strand=+
  SCN-specific regions: Sequence locations=1-240,277-399,421-555,584 -590,612-639,676-706
atgaaaaaaggcacaggcaccaaaaagttcaagctagaagcttcaaaccaagttaaaaactggttttcgtgcgtattaggccatagcaagttagcaaaaaaaggcatatgcctcaaaatccagtccctattcataaagtaaaaacccaacttgtactgtttttcgacaaaaaaatcgtcataacttttttcaaagtcgaccaaattaaactttcttggtatggtatcattcgatagcccttaaaattttctatccaattacaaagatttaaaaaatttctgtagcttctgcacagttcgttttggcgcgatccctattttttaggcataagtttttctttgccaaccaaatccaacaatcggagttcagaattttttgtgaaaaatcgaaaatttctagaatttctggaaaaacttttaatctttgtgttagaaaaaaacttaaaaaaatacataaaatttccagcttttttattttttaagctttattccactaatattgtccaacttgaagtgagttatgagtttccaaaattagtctaaatttcctgggctcaaaaacgaaaatttttaaaaaattccactgaaacttaaaataaggtttatttatatttgtgtctaaatattttgatggtttgtcaatgttttgtaaatattttcacatttttcaaatttttcaaaatcatgagatctttaacaaaaatgca

SEQ ID NO: 66854 - DNA, 403 bp, Heterodera glycines
  Genomic contig location: Contig_ID=SeqID_37873; Location=681..1083; Strand=-
  SCN-specific regions: Sequence locations=1-213,261-375,397-403
atatatttcataacggttagtaaaattgcctatttaatgaaatgtggtggtacggtggcccgtttaattgtttatcattctctgagtacggtatttaattttttggtggatatttggctaattaaaaatgatgtcaattaaaaaggtaaataaagatcatagtttaaaactttgtggcggtctctgagtcataagacgaattttgtcctttacaaaattagtaaatttaaaatataataactttataaaagtataaatttggagagcaaacggaggtaaaagaaaggggacgagaaaatttgtgtgatgatttgtcactaattattacacacattttatcagtgaaaccatcgaagaaccaaccatcccaatccatcatcatcatttgttaacactcgcagca

SEQ ID NO: 66855 - DNA, 399 bp, Heterodera glycines
  Genomic contig location: Contig_ID=SeqID_37874; Location=139..537; Strand=+
  SCN-specific regions: Sequence locations=1-87,109-399
atgggtggaagaatagtattattagtattaaagacgaattattttcttttagaaagcccagcgcgacttggcccaggcgaaggatctcctcgggaacgtggcacaacatttggcacccattccacgtggacaacttcgcaattgtaagttcattaagtgtatcttaaattaacatttaccgaattaaattccttttagtgatcgcgtctttttttgaggtcgggtacacctttggaatgactccgccccacgaagccaatcatgccccgactcaagaaaattttaaagtgcagtttgacagaatcaccgaactgcttcaaaatgcagatgccacccgaattaacaaggcatcacagtgttagtcgtaaacactgcatgttaattataatatataacata

SEQ ID NO: 66856 - DNA, 304 bp, Heterodera glycines; identical to SEQ ID NO: 51570
  Genomic contig location: Contig_ID=SeqID_37875; Location=132..435; Strand=-
  SCN-specific regions: Sequence locations=1-304

SEQ ID NO: 66857 - DNA, 235 bp, Heterodera glycines
  Genomic contig location: Contig_ID=SeqID_37875; Location=765..999; Strand=-
  SCN-specific regions: Sequence locations=1-235
tgtataaaatttatcaaaaaaagagatagccatttttctcggttaacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 66858 - DNA, 541 bp, Heterodera glycines
  Genomic contig location: Contig_ID=SeqID_37877; Location=164..704; Strand=-
  SCN-specific regions: Sequence locations=1-263,285-541
atgacctgtaagtgtaactatttttttgctaggttcaatatcattgaaaagaaaatttcttgattgttattctgagttcaaaggaattaaacgtgccaaaaatgctttcacggtagattgagctaaaatgtttttaaatattacaaattttcagtcatacaaaacaactttggattatgtcgccaaatggtttcgcaccgaacgttatccggatcatattcaatggctttcgcttacagatcggcaactagtccatgagaatgtcattgaattggcctcaacttttccccctgatttgtccgatactttgttcgatgaagttagtcaggttaaccacattttgatcagcatcgacgaagcagaattcatgcgactgacaacagagcaaaaatggcaaagaattttcagcgctgattttcccagtctgtacaggctcgtaagcaaattaatgcaatgaggctttttgacccaaaatgaggcttttttgcttgccaaatgaggcttttgaaaattttcatctgcgaaccctgaatatattaaa

SEQ ID NO: 66859 - DNA, 56 bp, Heterodera glycines
  Genomic contig location: Contig_ID=SeqID_37880; Location=631..686; Strand=+
  SCN-specific regions: Sequence locations=1-56
gctatagggaagctactcccgaaggattcggtctccccataaatctggacgcatcg

SEQ ID NO: 66860 - DNA, 1223 bp, Heterodera glycines
  Genomic contig location: Contig_ID=SeqID_8063; Location=3829..5051; Strand=-
  SCN-specific regions: Sequence locations=1-396,418-717,753-805,827 -1006,1098-1223
  Gene Ontology: Mol. function=sulfotransferase activity; Cellular component=cytoplasm; Biological process=amine metabolism
aactgtgcttcacttcgccaatgatcgagcgtttgggcgccgagttttgcgacagtttgaagtacccgcgactgctgaaaacgcacttttcttgggccaacttgccaaaacggcatttacaacagtcagcgacaacaacaaatggcactgctcagcccaagtacattttcgcggtgcgcaacccgaaggactgctgcgtcagctatttccaccacaaccgcaacttcaaaatttacgaatgggctcacggcaaattcgacgactttttcgagctgttccttgaaggtcggctgatggcattcggcgactattttgagcatctgctgagttggttgccgcatctgagtgatgccaatgtgctctttctgaagtcagtttggagttcaaagtttattcaaaaaattttttcctatttttgctgaagtttttttttgaaattcgtcgtttttataaaattattttaaggtacgaggacatgctcaacgacttggaagggagtgtgcgcaaaattggtcactttcttgggggacatgctgaaaaactggtgaacgaccaacagacattgtcgcgtattgtggcagaaagtcgattggaagcgatgcagcgcgaccaacagcgatggtttcccggcacggcactgtaagaagaagtccaactgaaaaaaaggggggggaggggatcagaattattgggaatgagaaatcatcatttaggggctaaaacataaaataaattaaaattgggacttttggctggtgctaatgctaattgtaagagtcatgcccatcactaatgactctttttgaattaaattggggttttaaaattcttaccacatccattggttcagaaacggcgagtcattcgttcggaagggcaccagcagagactggaagaattacatgagcaaggagcaaagtgatcggatgggccgcgcgttcagacaaaagttggccggcacagtggcagagaattggtggagaacggaaatgcgatggaacgaagcggaggaggaggaggaggaagagaaaaaggaggaaaaggaggaggaggaaaaggaaaacgagcaggagcaaagagaagcaaagaagaaggaggaagacgactcgggcatggaaagcggcgacgatttgttggaacgaagcgccaaagtgtcggacgattcattgcgtttgaacggctcgcccgccccgcagggaccgacgacgacggacagcaaatga

SEQ ID NO: 66861 - DNA, 379 bp, Heterodera glycines
  Genomic contig location: Contig_ID=SeqID_8064; Location=92..470; Strand=+
  SCN-specific regions: Sequence locations=1-379
atgcggcaaccaactcagcagatgctcaaaatagtcgccgaatgccatcagccggccttcaaggaacagctcgaaaaagtcgtcgaatttgccgtgagcccattcgtaaattttgaagttgcggttgtggtggaaatagctgacgcagcagtccttcgggttgcgcaccgcgaaaatgtacttgggctgagcagtgccatttgttgttgtcgctgactgttgtaaatgccgttttggcaagttggcccaagaaaagtgcgttttcagcagtcgcgggtacttcaaactgtcgcaaaactcggcgcccaaacgctcgatcatatgcgctacgacattccactagtgcagtttaatgcacgaacgatggcggattaaaaaa

SEQ ID NO: 66862 - DNA, 1419 bp, Heterodera glycines
  Genomic contig location: Contig_ID=SeqID_8064; Location=1..1419; Strand=-
  SCN-specific regions: Sequence locations=1-83,120-171,193-214,236 -559,591-613,635-730,752-1383,1405-1419
agctaaattagcctttttgagcccaaaaacccgaaaaaattttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatatatctcatatgcaatttcaaccaataaatttgaagaaattttgcactcaattttgaaaaatttatgtccatattttgacatttttgccatttatgtccatatttcgcgatttttgccatttatgtccatattttgcgatttttggtccatattttatggccatatttcgcgattttatatccatataattacactccctagtgatatgtctgtttacaccaggctattttaattaaattattgttttttttaattgattgaatttttgggaatgcgtaaaaatttttagtgaaaattttgtcagcgaggagttcgattaacactttcaatgccatttaaacaaattaaacaactgaagaaggcatttgcgaattagctttgctgtgtgcactgttaccaaaaaatttaaaaattggtagtaaatttgtctggataaatttctttgtctttctttaaaaaactatttcctccaatattcatgttcaaaagaacggcggcaaatttttcccccctctctgaacataaattcgttttattgagatttcataattgctttttaatttaacattcgattattttgaacattggcaaaaaaatttgggtgtttattttatttttttaatccgccatcgttcgtgcattaaactgcactagtggaatgtcgtagcgcatatgatcgagcgtttgggcgccgagttttgcgacagtttgaagtacccgcgactgctgaaaacgcacttttcttgggccaacttgccaaaacggcatttacaacagtcagcgacaacaacaaatggcactgctcagcccaagtacattttcgcggtgcgcaacccgaaggactgctgcgtcagctatttccaccacaaccgcaacttcaaaatttacgaatgggctcacggcaaattcgacgactttttcgagctgttccttgaaggccggctgatggcattcggcgactattttgagcatctgctgagttggttgccgcatctgagtgatgccaatgtgctctttctgaagtcagtttggagatcaaagtttattcaaaaaattttttcctatttttgctgaagtttttttt

SEQ ID NO: 66863 - DNA, 438 bp, Heterodera glycines
  Genomic contig location: Contig_ID=SeqID_37883; Location=271..708; Strand=+
  SCN-specific regions: Sequence locations=1-438
aaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 66864 - DNA, 841 bp, Heterodera glycines
  Genomic contig location: Contig_ID=SeqID_37884; Location=1..841; Strand=+
  SCN-specific regions: Sequence locations=1-351,387-521,557-684,711-800
gaagaaaatatttatgacataaaaaaatcgattttttcaaagcctcctttgggggtactcatgcaattatggggagcaaaaatccctcgcagaattaaagtacagactataggtaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagcctatagggaagctattcccgaaggattcggtctccccataaatctgggcgcatcggttcagggggactgccccgaaaacccaaaaaaaaatttttttgaataaaaattatttaaatgacctgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttattgaataaattatttaaatgaactgactagataatatttaaaataggttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagccctttctgaaaaaaatatttatgaattaattatgcaaaaaacaaataaataatgaa

SEQ ID NO: 66865 - DNA, 286 bp, Heterodera glycines
  Genomic contig location: Contig_ID=SeqID_37886; Location=428..713; Strand=-
  SCN-specific regions: Sequence locations=1-56,78-125,150-286
attttctaagaaaaaataggagttttgggggcgcggcggtgccgattggcgccgccggggaaaaaattggaaattttgatcatttataaacagtttttcactgaaaattagccaatttataggtaaaattttgaaaaattttatgggaatttaatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacctcggcccatccctg

SEQ ID NO: 66866 - DNA, 390 bp, Heterodera glycines
  Genomic contig location: Contig_ID=SeqID_37888; Location=29..418; Strand=-
  SCN-specific regions: Sequence locations=1-390
atgacacatacactatgggtaccgcctcccatcgattcgtctactcaacaattcgtctattcaacgattcgtctattatacgattcgtctactcagccaaaatgtgacgattcgtctactcggtcaaatgtcaacgattcgtctattatacgattcgtctactcgacgattcgtctactcagccaaaatgtgacgattcgtctactcggtcaaatgtcaacgattcgtctattatacgattcgtctactagacgattcgtctactcagccaaaatgcggcgattcgtctactcctccaaaaaagttcgaaaaccgggattcgaactcgaacaaactttaaagccatttttccggggtttcctacttaaaaaagcagttaccatagtctga

SEQ ID NO: 66867 - DNA, 627 bp, Heterodera glycines
  Genomic contig location: Contig_ID=SeqID_8065; Location=83..709; Strand=+
  SCN-specific regions: Sequence locations=1-59,82-198,231-390,426-627
ttatgaagtattctaatgaggaaaaattaagaaagacgaaagaatattttgaaattaaagctaaaaatccaaaaattagcgactcgataattgctacgaacttgggaattggatgggcaactcttaaaaaatggaaaaagaaacttgcctgaattacgaatttgtggtttttttgacgtgctgagccgaacctatatcaatttaataatatttaaattaattattaataacttagcttaaacttagtcaaattaatgaaacatgtggtattgggcgatagctctatgtattctcttgaatcttatgtaattaaaaaatctagcaaaaatttttacaaaaagttataactaaaaatttcaaaatttagattcaataatgtcgttccctaactattaaaaaaattttaaatttaacaaaattttatagaaatctttgagctatctaatcgtattaaggttgtataactaaattgcagtttgaacactatttacatgaattaaacgaccttacatttttgtatgaccttaaaaatatgaccaatttaattccttagtaactttttttaagaaacaaccaattataaaatttgactaagcttaagctatgttatgattaattatttagcaa

SEQ ID NO: 66868 - DNA, 3455 bp, Heterodera glycines
  Genomic contig location: Contig_ID=SeqID_8065; Location=1828..5282; Strand=+
  SCN-specific regions: Sequence locations=1-7,31-101,172-410,490 -511,533-768,790-876,906-1249,1371-1471,1515-1669,1696-1731,1762 -1850,1907-1921,1943-2201,2223-2270,2311-2372,2394-2545,2584 -2606,2628-2740,2762-2795,...
  SCN-specific regions: Sequence locations=...2817-2981,3005-3018,3162 -3180,3218-3455
atgaaagcttttattttaacatttatcaacatctgccttatcgcttcaatgccaagtaatttttgaaaagataaaaaactccttcaaaaacaaccattgtgttttaatttaaattttaaccgattttattttgaattttaaatataatgaaaatttaaacaaaaaaaaaatcgttaattttccctatttgaggcactccgtgtccactttttggcactctgcagcttgagctgaacaatttcttggaatatgccaacgaaccagtcgggtcacttcgtcgtggaaactccgtgaacattcgcggtatgtcctggcaattgagtgccgaactcactgaatcagctgctgaggacggcaccaaatatttgggattgaatttgtattgcaacaataactgcaaaattggtaagtaaattattttaatttttttatggtttatataaaatgagtaatgttaaaaaatgtatgaataaaaattttaaaaattttgccaacccaaaattttacaagaaaaatttaattttggctttatggttataggaaagtaatatgtggttgcttattagtaaaggtataactgtcatcgatctattatgtaaaacaacagttttatttgtagtccataaattttttacctttttaagttcctaatttttaagaattttcttgttttaaaagtctaaaatattttgaattgtcggcctttgaggggaggcgcgatttcgacccaaaaattggcttttagggcgtacccagtcacttgtggccaagacatttgctgtcaagaaatttatggcccgaagattgcggtcttgtctaaggcccgacaattactgtacaaatttaaaaaaaggtttcaatcacccactttgtcaatctttattatttttaaatgattttaaattggatctgtggttcactggacctgtaccaatttttaaatcaggcccttgatggtaatcggctcgatacaccaaaaatttgataggaatacagaatttcggatggcaccggaataaatagttaaatttttttttaaatcaatgttaaatttgaattgaaaattttgcatcaataattcgattaattaagacgctaattggaattgtttctcgatgctggaatttcgtataactgttggacaggttgatgttatgtcaaaaaagcttcccgcaacaaatttcactgctcaaaattcatctctgggaataacgaattttattaaaatccaggtaagtgaaatgaaatgaattaattattatatgataatgtttaatttaaatcaaataaaacattcatttatatatgctaattaataaattttttttttatttgttattcaataaatttcatttgaaaatataataaaagtgttttagaatttggtagatgtatgtcgtcatctaaaagattacactgtccaaattgttgccaatgtaaagccggaccaaccctgtgggactaggtaatcatatttattcaattttaaaaaaaattaaattaattaaaaaattgcctaaaatttccggtgccatggtaatactaattaaaactcatccatatttttaatatcattgcattattttagtctgccaagaacagatgcaattttagtgaaaacaagcaatgatcaaattggcgttgaagtgaacataaacagaaatgttggtattttaaataattattaattttaatccaatttttaaatagtgtcctcgcgctggactggggattttaaaatttcaaaaaatttaaatttaacaaaatgaaatatcttttctacaattttacttttttttcctctttgtcataagttatgagtcataatataatttttgcggcgcattttcaaaatatttataaatatattttgtttaaaaaattaatttaaaaataaataaaaaaagagatgcaaaatgctttttctttgtagcttttggcagcccattctagctcgttcaacgattttttcgccaattttcaaccgccagctgaaagtacgtcctcaacaggtggattgagtatcatgcttgatgccccatcaaccgcggaacattttgaacaactgatggacttgttgcactatggtgattgtgtgctggaaggtaaagttttaagactaaatctataaaatgcaggtctcgaaaatcaaattttataaaatttactcagccttaaaaactcaaaatttccaaaaatactaattaaattcttttcgctatgtctattttgaaccaaaaattttgaatttgtatgaaatttcttagcagattttttaaaaagttaaaatattgattattattttttaatcaactaaattcttttagttttagcccatttttatttgccgtttatatgaaatttattaacagatattttttaatttcaattttgactattattgtcaataaccataaaattctcaaaaatttttgaactgaaaagcaaaaccacgaaccttcaaaaaatttctcctctgaatgtctaataattaataaatgaggaataacctcgtaattcacatatcaatcattcattacgtgtcaattaaactatttttttaaatttaaatattaaatttatgaatttactgaattattgggaccttttcatttatttattaatttcttaagacgaaaatttggaaaatgttttgcgtttggcgcagcaattccatctgcatgatattgtaagcaaatgtgcacgatttcttggcagtacaaattgtaatattcaaacaatgaaaaaatatcaaattgcagacatttatggattagatgcactgaaggtatgggaattttattattttttaaatacacttattatgggttcgatatttaggtttttgcctattttttcctgagctccctatggtctgaacgcaggaaaacattttttgtggttgttaagctatttttcgtgtttcggcctcaaaattcagaaaaatgcacacctaagaaccgtccctaggcttttgaaacctaaagaaatgaaaaattttctcaaaaattcatctccaaatttattaatttattttttgacaacaatttaaatttttaaaattttgtttttgtcttttaagtacaaaaattatctatagtaatttttgaatgttcttattttaaatagaaatgttaaaatatatacaaaaatataaaaatgccattaactgcgcttgagtaataaattaatttttaaaattataataaataatttaggaatttattttgtacaatttgcttcaagaatccgattttgttgcgcaatattttttgcaaaatttggaaattattgagcaattgagcgatggtgccaaaattgcactaaaacaacgcattaaagaactgcttgaagcagctcagtaattactatagtaattagctgaacgatgatagatcgaaacctgagaacattctgatgaaattgttgatgaattaattattttttaaagaaaa

SEQ ID NO: 66869 - DNA, 611 bp, Heterodera glycines
  Genomic contig location: Contig_ID=SeqID_37892; Location=391..1001; Strand=+
  SCN-specific regions: Sequence locations=1-236,259-353,375-611
  Gene Ontology: Biological process=embryogenesis and morphogenesis
atggacgatgaacaatttgtggcatttgctcgtcaccggcacgccaacgccgaacgcatttcgacatggatgcacgacgaaaaacagaggccccgcgagttgggacagaaccaactgggcttctttctgatgtggttgcgatatgagttgaggtgaaagaacggactttataagtggttttgtacggcgaatagttcattgtgccagaagtttgaaggaatggaattttatttctatcatcagggaaaaagagaaggcgggatggctgtcgaccgttgaaattcgcactgaaggcctttccacggaccaagacgaccttccagtgtccatttccgtgtcttactttgcactcgcccttcaggggcccttccaacctctcagcaattattacgcgttgccatttgagttcaaaggtcacagactcaatggcactctctcgacaaaaataaacatcaaattcaggcgagtcctatcggtcggtcgaacattacgcctaccagcgccttttcgaggctctgaaatttccgcctgaggaagtgatgcgactgcgcacaactgttaaaccggcggacgtggccaaatgtgcgcagaaagtgttcgataagcagcag

SEQ ID NO: 66870 - DNA, 511 bp, Heterodera glycines
  Genomic contig location: Contig_ID=SeqID_37893; Location=177..687; Strand=+
  SCN-specific regions: Sequence locations=1-511
  Gene Ontology: Cellular component=cytoplasm; Biological process =signal transduction
tccattttcgaccaaattgaacctgcggatgtgcgtgcagtgccccctcgtgtccaccccctctgttggtacgcaatttggcgtgcaacagatcgtttccgtgcattgaatgggcgattccccggaagcattgcttcttctcagaagggagatgcaaaggaattgaaggaaatcgtcgggaaattgttttctgagactcaggtggtcgtttgttatcttttgcaagttaacaaacttccgaattttgcagaatgccgagctgatctccagccaggacgaattggttccaccggaaactatcgctgaagtttgccgttacggtggctcagagccgcacgttgtggccgctatcctcggcggctgcgttgctcaggaggcaattaaactgtgcacacaccaatacatgcccgtggacaattcgctgctgttcgatgcccattcccaacaggcggcctcttttcgggtggtcgcctcacaaagagaggaacagcggaccaggaagacccgttga

SEQ ID NO: 66871 - DNA, 575 bp, Heterodera glycines
  Genomic contig location: Contig_ID=SeqID_37896; Location=217..791; Strand=-
  SCN-specific regions: Sequence locations=1-142,166-214,236-316,338-531
aagaaaaatgaagaaaatcgggagaaaaaagtggcaaactttttgtcagagaaatgggccattattaaacaggaaaagccacaattggccaacattttcacgcttttacaaacttctttcaatactttaaaaggaggtattgaataatatttattttaattttatccaatttcactaattaatagattttggtaatgtaaacgcgttgaaaatgttgaaaaagcaaattgttgatgcggcatttctgctcactgatcacatccaaatttcgcatgatcaaattttgcccttgaatagacaaaacggcttgaacatgataaaagaattggccaaattatgggtaaacagcagggaattcaacggtaaatgtatagtagatgagaattacggtaacaaaaatgaaaatcatggtcaaaccggtgaggatgatgatggtgataattatgatagatctcgtcaatggcaacgtaaaattttacaactgattttgtcggctgttgatgatgaaccattgaaaatggcgacaaatggtatatttagaataaaaaaataaactgatttttttataaaataaa

SEQ ID NO: 66872 - DNA, 80 bp, Heterodera glycines; identical to SEQ ID NO: 51817
  Genomic contig location: Contig_ID=SeqID_37900; Location=540..619; Strand=-
  SCN-specific regions: Sequence locations=69-80

SEQ ID NO: 66873 - DNA, 368 bp, Heterodera glycines
  Genomic contig location: Contig_ID=SeqID_37901; Location=112..479; Strand=+
  SCN-specific regions: Sequence locations=1-368
atggtagatcaatttgtacaacccgaaactgcggaggagcaacaagtgaaagctaagaagccacgcgttgatgagcgatttctttggaaaatcacgcggggccaatttgtactagcgattcggctgtgttcaggttaatcaaatttttgacgaccaaattaattgacaactttcagaggactggaacaatttatttcacaacaaagacaagacacgtcggctggaagatgggcgagtggcgattggactcgagatgtgtgaagaatgtgccagaatcaattgctgtgtcagtgatatgattgccgatcaaaagaagaagccaaaaaccaccgaataattcatcaaatttttcgcattagttgtagcca

SEQ ID NO: 66874 - DNA, 148 bp, Heterodera glycines
  Genomic contig location: Contig_ID=SeqID_8066; Location=201..348; Strand=+
  SCN-specific regions: Sequence locations=1-148
tgaccagttcaagtgggacgatgcggcttcacgcgtgcggacattggacgaggcgttcaccaagctggtcgacatgaacaatctgatcaagcagcagccgccggtgccatccgtgaagagcaacaacaccaacccgtttgttgtctga

SEQ ID NO: 66875 - DNA, 2290 bp, Heterodera glycines
  misc_feature (21)..(21): n is a, c, g, or t
  Genomic contig location: Contig_ID=SeqID_8066; Location=1964..4253; Strand=-
  SCN-specific regions: Sequence locations=1-166,203-366,388-491,518 -633,664-677,699-939,1076-1628,1662-1874,1897-1909,1931-2250,2272-2290
atgccctccaacggcttttcncacgttgcggtaccgtacagcagcagcagcagcagccatcactatcccataccaccacccgccagctgcattactgtgccatcgccgtccaccgaattctcacggctcgacatttcgttggcaaacccatgctttggcctactgcccgccgtcgccaccgccgccacaaagacggcaacaacagcagcaactaccgtacccatacaaccacaacagtcaccagcgacgtactcggcgtcaggccaacaaacaaagtgcgtacatacagtatgcgctctgatatactgtagatcattgtactgtactgtctcgtcctcctctcgtttctcgggtccgggactgaactttgatttattttgaaattgggctcatattcaaattatcggtgctaattgattcggatcgattacgagtcctagtctttttttctttttgtaatttcttaattactaatctgctaattcaacaacaaaaaaaaatatatttttttaattaagcaaattggagcgacaatcagtgccattccatcatcgcaccagcgaagaatcgccgccgctagcacaaaattgcgaaaatccaatctttgatctgataatgatggcggcaaacaacaaaagcgccgcggggggaaaacaacggcaattgccacaaacggcaaatggtggtggcaccaaaaaggaggatgccgaagatgatgaacagcaaaagcacctgaagcggacggcacctcctcctcctccaccgcggtcttcgttggcacgcttttcgacccgcgcttgtctgccaatgccgtccgaacaagacgaacatgatgaattggcatctaccgaggaactgttcagaataggaggcaacaacggcattggtcgtggtgccaacaatgctgcttcccgcctaatcggcatgagaaatgccatcgatgatgatgaggataatgatgattttgatggcattggtgttggaagaggaggatggggaggaggacgagcggagaaaaggaccaaaaaaatggtagtgccaaatgaagacaataatgatgatcacgacgatgatggcacttttgccgaaaatgttggtgtttctttggccggagatggtagtgattgtctgcatcattttgtgaagaaaccgtcgatgctccatgctgttgaaaaaagcagtaatcagcacaggtggttgccgttgtttttgatcaatctttctcgtctgttcaattaggcaaatacgcgacagttttaattgagcatttggatttctgatcaatggcattttcagggggagtgccttcagaaaccgaaaaattttaaaaaaaaatcgtgaaaaatggtagagtgttagccccttctcccgaatccaagggtctggatttttcaacaaaaaaaaactaatttttttaaatagaggccgcgccgggcctttccttaatatttatttgagaaataagcatatttgaatttcgaagaatgtggaattgtacccatttcaatgccaccaaaatgccattggcgggtggcgccgtcggcgggcgacagttgctctccaattttcggcatcattttcaacccaacaggcttttgtccaccattgcacataataataataatggctcatcatcatcatcatcatcatcgtccccatcagttcaacagcaggcaaataatgattaaaatagccaattgaaacgttctcgagagaatctgggtctcaaacattactaatttcgaaattctcaaacaaaattttgaaatttttttgcttacatgcttctgttcagcagcagcagattgctcggcatcatcgccacaatcggcttcaccaccaccaagcagcaccaccaattgttgttggcccgacatcatcatccttctcctcctcaacccttgcggcatcgtcgtcgtcctcctccgcccccattgtgcttcctcctccaaaacggaagtatcatcatcatcagcaggtccatcggctgctgatggcatcgcttggcatgcgtagaaatggtgccaatgtcaacaatggcactgctccaactactgctactgttggtggtcagcatcgacgacgacgaggaacgcactttcggcaccagcagcagtcaatgttgcccaccgttccggacatcgacgacaaggaggaggagacggagcaggacgagcttcatcatggtaatcatgatggtagcaacacaaccaccaactgtgccgctacagcttgtgagggtggaacagcagcggaagacaaaagccacgagattatggcagtgcaataa

SEQ ID NO: 66876 - DNA, 171 bp, Heterodera glycines
  Genomic contig location: Contig_ID=SeqID_8067; Location=333..503; Strand=+
  SCN-specific regions: Sequence locations=1-135,157-171
aggaaaaaaaaaaattaaatctgagggaacgaataaaaatgttcaatttcttattgcatttttgttgataacaattttccgaaaaatcctaaaataagcaccaaaatcgggagggattctcgaatcgggattccgtccaaatccccgatcccgatcaacccccaatgaatt

SEQ ID NO: 66877 - DNA, 304 bp, Heterodera glycines; identical to SEQ ID NO: 55978
  Genomic contig location: Contig_ID=SeqID_37904; Location=78..381; Strand=+
  SCN-specific regions: Sequence locations=1-304

SEQ ID NO: 66878 - DNA, 320 bp, Heterodera glycines
  Genomic contig location: Contig_ID=SeqID_37905; Location=806..1125; Strand=-
  SCN-specific regions: Sequence locations=1-51,73-93,115-281,307-320
atgctcatcagacacaaaaaatcgaccggtggtggtttctcaaaaattgtcatgctcccggacggcaccgaattcaacgtcaacacgaataaatgtgaaggactctgggctcaattgaaacaaaagacgaaaagaattcatggaaccagtacaaatttaacgaattcatatatgtgtgaacaaatttttcgacttaatgctaagactaaaggaaaatctatttttaatgctttctgtgatcttcttcgccataattataatttcattcgccataattgtcttgttaatgtttaatattcattattatgtgtaaaaataaa

SEQ ID NO: 66879 - DNA, 582 bp, Heterodera glycines
  Genomic contig location: Contig_ID=SeqID_37908; Location=718..1299; Strand=+
  SCN-specific regions: Sequence locations=1-207,230-440,462-582
atggttggtggtgtcgaaattgacataaaaactgtgccgtggacagtgctatttcaaggcttagtgaaaagaaatgaacaaaataaaatgataatatttcaaaattgcgctagcatatttatttcgccggaatttgtgctgttagccgcgcattgttttgacaaaatcaaagagggaaaatactttcatttgggtaaaaaataaaaacaatttaaatgctctttaaatgctttgcttataactttgctctaaacaatccaattttaattctcgatatcatacgatagactaaatgttttctattagtctgccaatcaaaaaaatttgttaactttcaaaaaagttatggcctcaaaaaccaaggttttttgagttcctctagtcataactagggctccaatttataattgctaaaaactgccaatataattagtttttagtttctaaaaaacccccaaaatagttgctaaaaatgggtaaatatttgctaaaaactttcaaatttaggggagtaaaatcgaaaatttcttcaaaaagcaaaaatattatgccaaatcattaatgagatacataattttcaaa

SEQ ID NO: 66880 - DNA, 56 bp, Heterodera glycines; identical to SEQ ID NO: 52733
  Genomic contig location: Contig_ID=SeqID_37912; Location=112..167; Strand=+
  SCN-specific regions: Sequence locations=1-56

SEQ ID NO: 66881 - DNA, 59 bp, Heterodera glycines
  Genomic contig location: Contig_ID=SeqID_37913; Location=164..222; Strand=+
  SCN-specific regions: Sequence locations=1-59
agcccgtgaacagctcgcatcggatgcaagtgccgccgttgctgtacgcctaacagttg

SEQ ID NO: 66882 - DNA, 465 bp, Heterodera glycines
  Genomic contig location: Contig_ID=SeqID_37916; Location=118..582; Strand=+
  SCN-specific regions: Sequence locations=1-465
atggcccgccatcaagcccaatgtgttggccagctattccgtgtccgatgccgtgtccacctattacctgtacaccaaatacgtgcacccgttcatcttcgccctgtgcacaatcatcccgctgggcccggacgacgtgagttggggtggaaataaatcccgaattccggcaatttcctcatcaaacgcttcaatttcgacatttttctcaactattcccgattttcaacatttttcggtactttttaagtttacgagggtatttttaacgatacattttcagattcctataaatgtgttttagaaattaatgaaaataagttttaaggggtcgtcgaaggtcgcctgatcacgaatccgggctcagatcgagcgctaccgattcactacgatgagctgtacgagggacaaagaattgataggcttcctgtaccaataataccctcattggcgagatgcccgtga

SEQ ID NO: 66883 - DNA, 699 bp, Heterodera glycines
  Genomic contig location: Contig_ID=SeqID_37918; Location=53..751; Strand=-
  SCN-specific regions: Sequence locations=1-334,361-416,438-550,573-699
  Gene Ontology: Mol. function=protein tyrosine phosphatase activity; Biological process=regulation of actin polymerization and/or depolymerization
gacgagtcaggacatccgccggcggttgagcgagcaaatttcggtggaccagcggcgctacaaagagttcatcgaccaccaaatgctcgtcatccttggtcagatataccatatctgatcctagtattatccacacttgttttccaggtcaattggatcggccctcgaaaatcttcgattacctttaccttggcacggaatggaacgcgtccaattgggaggagctgaaggcgaatgggtgggacaaaagatagataatttacggactatctgtcggcaaaaatgagtcgaaaccgaaaaatgcctaagtatggattgaaatttgattatcccggaaaaaacttaaaatgctttttaattaaatttaactcgatttttcagtgtccaatacattctgaacgtgacgaaggaagtggacaatttcttccccactcagttcacttaccttaaaatttgggtgtccgacgaggcgaccaccgaacttttgatgcattggcaacgcacttacgactttatcaaggaggccaagtgggcaaattgccaaaaaagtgccaattttaaataattcaaaaatattccccgcagggaaaagggtgccaaagtgttggtccactgcaaaaagggcatcagtcggtccgcgtccactgtcatcgcttacgcaatgaaagcgtacggctggggactggacgaggcgttgga

SEQ ID NO: 66884 - DNA, 447 bp, Heterodera glycines
  Genomic contig location: Contig_ID=SeqID_37920; Location=537..983; Strand=+
  SCN-specific regions: Sequence locations=1-27,49-447
atgccaatggcccatggaaatcgttgtgtggccatcaaagtggtggacatgaacaaaatcgagccggagaaggtgaatcagctgaacaacgaggcggccattctgcacgaactgaaagcgcgcggagtgaaactcatcccccaactgtacacaatgtacggtagaaaaacgaaaggggaactcatcccccaactgtacacaatgtacggtagaaaaacgaaaggggaactcatcccccaactgtacacaatgtacggtagaaaaacgaaaggggaactcatcccccaactgtacacaatgtacggtagaaaaacgaaaggggaactcatcccccaactgtacacaatgtacggtagaaaaacgaaaggggaactcatcccccaactgtacacaatgtacggtagaaaacgaaaggggaactcatcccccaactgtacacaatgtacg

SEQ ID NO: 66885 - DNA, 155 bp, Heterodera glycines
  Genomic contig location: Contig_ID=SeqID_37921; Location=482..636; Strand=+
  SCN-specific regions: Sequence locations=1-155
ttctgaaaaaaatatttatgaaacaaaaaaatcgattttttcaagtgtccgtttggggtactctaacatttatggggagcgaaaatccaacgcagaattaaagtacaggctatagggaagctattcccgaaggattcggtctccccataaatctg

SEQ ID NO: 66886 - DNA, 4605 bp, Heterodera glycines
  Genomic contig location: Contig_ID=SeqID_1047; Location=151..4755; Strand=-
  SCN-specific regions: Sequence locations=1-1399,1421-1496,1519 -1841,1863-2793,2816-2923,2946-3288,3318-3557,3580-4119,4141 -4178,4200-4452,4474-4605
atgattggcggagagcgcgaactttccctgtctgcttcttcatcgtcgatcggtgcgccgaatggcaccgtccctccggcatcgtcggccaacggcgcctcctctcaaaatcgatccctcccaatttcggccgccctcctcacgcagcaacaatacccacacggacaacagcagcatggccaaattgtgaccaaagcgcgcgactttcccatcacaattcggtcaatgcgaatttcgctcgctctgctcaccaattatcatccaattttggtcggtttttatttattttttccgtttcccctcccctttttttaatttagtttttaaagcaattcctttttttcttttattttaggcctcccaaaatgaactgatcctcaccattttgctggaccttctctggatgcccaccaattcgtgggaggcggcggtggctgtcgaagtttttcgaaaaatcattggccaaccgacgcttttgaagtaaaagaaattgttaaaaaataccccaaaaaagcctttaaaatttgcagatggctttgtgcgagggaagagggcgcaaagtttgtcgagctgctcttttcccgtttgtattcattcctgcgcaaatgtttggaggaaggtgaaccttttgcggttttcgtgtgttttggacgaatagtcattccattacgctaatctttggccctcatttagctgctaatgattccccgagtatccgtgacgagaagattggccaacagggctttatcttcaaaggcacgtgtttaattcattcatcattggcatttaatttttccgctttaggcgtgtttttgccactcgacgaaacccaactgagccaaaagcgttctattctgtgcgtctttttgccatttttatttatgtttttggcatttatcttttgtcctcctctctctcccttcagcttggattggctcgacaaacacagcgcggagagaatccccgaggcgtattgtctgtccgttggttttgccactttggtcgatgcgacgggcgccgtctgttcagcggttgagagcggcgaattgttgccggcacagaacggcgcaacaacggcaaaggaggagatgccaaagtcggaggagaagtgccaaaaagccaacttggacagttcggcatccctgcctcaagcatactccggtgggaaatgggaaggcacacttttctaattgataatttaattgctgaattgtagacattgccaaagagctgttccaagtggcccattcctttctctgttcggccatttccactttactcgacttcaggttttgtgtgcctttttagtgacattccaatgccaatttcctttttcaatttatagtgtcgacgattcaatcaccgaacatttgttgacctgtctctcatcattggtcactttggcatgcaaatttggaaatgccgatgccaaacactcgctgttacgggcgttttgtcgcgcagttagtcccttacaaaatgccaaaacgagttccaatttcccaggctttgccatgccaatacttctcgcgtttcgtcgactcccactcatcggcttcgcttgcgctgcaaagcggcgcaatggccaatggttcagtcggcgccaacagcgatttgagcttaaaaggtggcccatccaatccaaatttgccattttggtcggtcattcggtgtcccgtcacattttgcagattcgtcggttgaaccaacccaagtggtcgcgatgggcactgtttgtccgagtccgcaccatccctcccaattcttcaacaccaccgtaatggtgcgtaaatccttttttgaatttattttcctatttttattgcatttcacgtttgtataacataacatttatttatctgttgaagttttagcattgcataattttcagatgaccgccaaaaacttgcaagttgcgcgacttttgatcggttgcgtccaccaaaacggccatttgctgggcgactgttgggaaatggtgttgactaccatccaggtgaaacgcgcacagggattatcattggactaaatgttccgttccgtttatttaagcactttgtttggatcgtcggcctccgtcccacttccaccggcacttttcgtgccggtggcgagacaaaatcagcctcggaaggcggcggtgttatgtccaccacgtcagcttcggccgcgagtacggtgattttgacgacagcagccagctcggaattgccggatttggtcgggaaaacggcggagtattctgcagcctttgacactaatttttgctctttgtcagaatcaccagctgaatgtcctgttcgagtcgacctcgaccctggacgaagtgtccatccatcacatcatcgccgctctttgcaaattgtccaacgagtcgatgacggtctgtctctccttattttgccactttttgtgccatccgtccaattttggccaatttttaggtggcccagacgagttctcgtgaaacatcgttcttctccatcgccaaactgctccaaactgcactggtcaaccttcctcgtttgcatgtgttctggcgacctgtcaccgcccatttgctcgaggctttaaacaattaaatttaattgtcattaatttttttttcaatttcagctttgcgctcattccagcgccgcaacgcgcgagtggggcgccgtttcgttgactcagttggtccgaagtgcgatgaaacaaacaattgcggaacaacgcgagttggaaacgaacaaaaaaacagcgaaaaacgaagagacaatcgtaaattgcctaattagcatgtcttaattgttttgattatatttttacagaagagggaacaacttattctgaaccctttggcggcaatttgcgaaatcgaatttttggatgtccgcgctaagcaattgggtcaatatcaaattcatttaactaattggattatttttaattgctcttccccacagattgtcttatgcgcattctccagtccgacagtcgccccattgagccgtctttgtggccttccgtcgtgcaaattgtctcttccgtggtgatgcccgattcgcggatgaacacaatgtctgtgattgtttgatttgcttttctgatcattttccttttagcactgatccccagctgatcgatcagtctttccgtgtcctttctctggtgatcaaagagtttctcgccgtcgtccctttcgaatgtgtccaaatgctcgtcgaaacgaacgcactttatggccaacagcaaattcaccttaacgtcgcattggcttcagttggccaattggtcggtgctttttcgtttattaaatttaattgaaatttaattttgattcctttaagtgggacatttccgactttgtgcgcagggcgcagcaaaacgtgggcaaagaggaggcggagacggcgtggctttgcatttacgccgccttgggcagactgtgcgtcgacgcgcgaccgccggtgcggaaaagcgcgtgcgacacccttttgcaaacagtcgcagcgcacggacaggcactcggcacacaaaaatgggcagaaatgctgacagatgtaagccaaagattaagaaacaaatactttcttctgatttttgagatgtattgtttgtaaaacggaaaaataaattcgtaattaattaaccaatcattatttaagttattgccaaatgcattcctctcaccccttttaggtgctcttcccaatgttggaccgtgttcgccacctcacccaaacggcgtctacccaccgttccaacacttccacgctcggcgcaccgaacttaatgattcatcactcccgagacacgtatcaaccgaatgggctaatcttctcctttaatgtgcaaagtcatttagcgaatcaaagcaatgggccgaaacgagcgtaaaaacattgggtggcgtggtgaagattttcaacgcacaacggccaatgctgctccaattgggtacagacttaatttacactaattattttttttaacaattccagaagcttttcccgacttttggtcgcagctgttaacgcacatcgaattggccgcaaaagcggacagtgccgagatgagtttggcagcactgaaaaatatgcaggatttgctgttcggtcggcagcagcaaacggagggacagcaacaacaacagacaattggcattcgtgggaagcaacaaatgtcgacaaacggcaggtggggagaaaatgagggaaataaaaacgacaattctgcaaaaaatgggccaaaatcgtgtcaacccaacccaatgtccattcatccccacacagtagaaccgagacggatctctccacaagtgcgcccttgcccgacccgttgtggatggtctgctggtcgttttggctgcgcgtcgcccaggccatcgtttcgccggactgtcccgccaatttggagttcgccccgtcgttgcgcccttcctccgacgacccctccccgttcattccgacgacaaagtgacaaaccaaaaatggacagaaaacccaacgacaactgaattttttcagaaaacattacgtacccggcctttaccatctgaccactcttctggagatgttccaacagcttttccaccgcgttcggcgtcaaattccgatcgaagac

SEQ ID NO: 66887 - DNA, 643 bp, Heterodera glycines
  Genomic contig location: Contig_ID=SeqID_1047; Location=3820..4462; Strand=+
  SCN-specific regions: Sequence locations=1-433,455-643
gccaatccaagctgaagggagagagaggaggacaaaagataaatgccaaaaacataaataaaaatggcaaaaagacgcacagaatagaacgcttttggctcagttgggtttcgtcgagtggcaaaaacacgcctaaagcggaaaaattaaatgccaatgatgaatgaattaaacacgtgcctttgaagataaagccctgttggccaatcttctcgtcacggatactcggggaatcattagcagctaaatgagggccaaagattagcgtaatggaatgactattcgtccaaaacacacgaaaaccgcaaaaggttcaccttcctccaaacatttgcgcaggaatgaatacaaacgggaaaagagcagctcgacaaactttgcgccctcttccctcgcacaaagccatctgcaaattttaaaggcttttttggggtattttttaacaatttcttttacttcaaaagcgtcggttggccaatgatttttcgaaaaacttcgacagccaccgccgcctcccacgaattggtgggcatccagagaaggtccagcaaaatggtgaggatcagttcattttgggaggcctaaaataaaagaaaaaaaggaattgctttaaaaactaaattaaaaaaaggggaggggaaac

SEQ ID NO: 66888 - DNA, 1317 bp, Heterodera glycines
  Genomic contig location: Contig_ID=SeqID_1048; Location=123..1439; Strand=+
  SCN-specific regions: Sequence locations=1-72,94-116,140-150,173 -297,319-441,463-1070,1102-1317
atgccattgaattacgcggtaagaaaatgaacgcattccaaagggtcatgggaagtgcccgtcaggcattactgccaaaaggccccaaactaaggaatccaaaagataatttctttgggagaggtgggaaggggagaagcgggttacgtaccccaccccccacaaatttttagagaaaaaatagtatttttgataaaattttcgatttcccttgttggtaccccctccaaggcctccctcatccagtctaaaactgttattaaattgcactcgaattttctaaaaattttcccgtcggcaccgacccactgtccccacttttaaaagaatgccgcaaaaagtggcatgaaaatcgtaaataagtcgtcgcccgagggcgatgtaccccaccccaaacagaaattccgcgaccgtcccaataattgggatagaattttggccaattattagaaataaaaaattctccacacctctttgatgtgattgtgcttcttcttcgcctccgtggaaagtgttcgcaagtcgcccatcaaataatccaccaactttttcggatcattttgctgaattccgccggttgaagcggacgaagaagccatttttgtatctgttctttcaccttttctcctttcgatttattcaaacaaaaaaataatttagcaaatgaaatcaatatgcaaaaagcaaaaaacaaagaaaaatgagaaaaagacaaagaaaggtgaacaattcattcatcattcgtcatcaaaggacgaaaagaaaaaacgaaacgaaaaacggaggaaaaggtgaaaattatgaaaaaagtggcaaaatgcgagatccaaagttggttggtcctaacagaaaacagtcgatggattaggcaaaagtgagaatttttgaccaatgatgacaagtttggtgtgtgtgctatagaatattttcagtaaatggagaaaaaacaatgatttaacggaaagagaaggggagaaggacaaagccaaaaaagagagaattctgaaaacaaattcacaaatggccgattttatttcaattttcttttttttcgttttggctatgtcttgaatgaacatcaaaattttgattcaaaaaataggaattgctgaaaatgccggaaataattgagtaaacaaatgggcgatgattgattggcactctctcagtgatggccgccagtggcgggaacgggtggcactgccgaaggttttgaggctatcaaacccaaaatattttcggggataagcgtccatagataatcccaaagtgcgaaaattgatgccaacacatttttggccatctgaaattggcaaa

SEQ ID NO: 66889 - DNA, 1652 bp, Heterodera glycines
  Genomic contig location: Contig_ID=SeqID_1048; Location=2532..4183; Strand=-
  SCN-specific regions: Sequence locations=1-140,183-490,513-601,624 -733,762-1108,1130-1257,1280-1652
atgcttcgtcttccgacattcttcaagggctacttgtggctgctttacctgggagttattgtgcttttcatttattatttccgtgttcctctcaaagcctatgagaaatttgagtcgcgtaaggagtttaatatttctacaatttttaaatattctattttttaagtaatattactttttaagtgctttcaatgagcatgtacttcaataatctcacgccaaaattttacgttgcattgaccggcacatccagtctcgtatccggcatcattctcatttttgaatggtggtacttcaaaaagtaaaggatattttctttcttttaattttcttatttttctaaccaataatttattattttatcattcaattctttaacaaaaaaaagagtcaaataaaagcaactaaaacttttcaattaatgagggcacttttaatgccttttcactgaaaaaagaaattattcactcataaatttgtagtctctcgccccattcgctttccctttcttcccattacgtaaattaggcggtcggttgaacaggtgcaatgccataattattaattgccattgcaccgctttggtcgccgatggcaacaaagaaaagaccaataaactttttctaatgagtgcgtaatgcatttattccataatttattgtaaatatatttcacattaaacctccaataaaacgggttgaatgatgatatttttgctgaagttagtcatttggcatggttttcaaaacttttctttcttttaagcaatgccatcgaaaacgctttggaaagtgaagacggaagcgacatcgacgaaaattacgacggcacaaaaccattaccaggtcggttttcatttgtaaattgcgtttttaaagaacgaaatttttcagagctcactgagtacgacgagaatgggcatgaaggcaacgactgcaaagtgtggcgcaatccgatggcactttttcgcggtgccgaataccaacggttcacacgcgagacgggccaagaaccgctcactttctacgatttgaatctctccgcgcaggaccaccaaacctttttctgttgcgaagccgacgcaggaaaagaggacttggaaagtgcgtatttcaaataatgtttcaaaacataattcttttttaagttatgtcaatggtttggcgcgagagggacagccaagtgcgaatttccgaagcaaaaagggcgttgaaagtgaattcggagtgtgcgccggcactgattttgtcagctcgaattttttccactttaatattttcaaaatttcagattagcagaagaattttgccaatcagttgcagaagtcgaggagacactgaggtggaattgtgaatgaatatgacatttaaaacctcatcacttctaaattttcccaggaaagcattgagaatcgtcgagggaatgtacaaacggagtcaggccgccatgtacccggaccccgagtcacagcaaagtgcgtttggatccgattaaacgcccacattggcttattgtaattttcaaatcattttctttcagagagtagggacatcaacatgttggtgttcattcgccgccggctcgccatgtgcgcacgacggcagggacgtgtaagggaggcgatcaaaatgatgcgggatgtgagtgattaa

SEQ ID NO: 66890 - DNA, 2139 bp, Heterodera glycines
  Genomic contig location: Contig_ID=SeqID_1049; Location=404..2542; Strand=+
  SCN-specific regions: Sequence locations=1-9,31-611,633-772,794 -817,839-1120,1143-1538,1560-1778,1800-2008,2040-2139
  Gene Ontology: Cellular component=microtubule; Biological process =leading edge cell differentiation
atggacgacgccaacatcgctgctattttggcatttgttagtaaactgcgattctctttttgcaatgttttcaattttagtataatttattggccgccaaaattggcctggaagactgccaatcgctgaaggaagtgcgcaatttgatgccaattttagccaattacatgtaacatttatttttcgtttcctttttccatctatctttttactttgaatttctcaccagaaagtccggcacacttactttcattgacgactctaactttggttttcgaaatgccattgatatcattgcgcatggtttggatgaggagttccattcgcatttgcgtcctgaggctgcggagagcggggatttgtccgaggcgaccaaagttgcacccattttttgtcttttcacttttctgacactaagattcatttggctatgctttacactttccgtttacttcaaacggaggcattttcgactatttgtgaacggttggaggacaaacatcaacggcactttgccactgtcgtaagcttcgtcctacaaatactgattttttgtccttgtatttatttagattgaatgtcttgacgaccgtcgctgttggacttccgctccatggcctaaactgttgcacaccgacagcaatgaggaggacaaagagaacgtcgagtcggtccaacggcgtcggaagagttcgctcaacttaacgcaaacgccgaagctcgactctgccagaaagtcgtttttccctagcgggaacagtccaattctcaaggtccgtggggttttgcgaatacatttacgggtgatggatgagcacagctgaactggttttctggccattctcgaaaaaatatttcattcttgagcaaccccaatttcaatgtaataccgttttatatacaggtcatttcgtcaccgcgaggcgaggaagtggttcgaatccatgcgcttcagcgggaagtgaaggctctgcgccaaatccgtgacgttttcggtcgcgagaaggacaaggcggaagagttgtgtcagcagaaggaacgcgaaaacaacaatctgttgaagaagatcgaaaggtaaacacatggaatgcttcgtactgttatggatgctttttactacggtttgggttaaaattaaaaatcccgagctctcttcaggatgcaggctcaaatcgcatgcattacaccgtgcgccgaacgcactccggtgctggaggatcaactgctgatgatggagacacaggcagcgacaaacgccaggcagctgcaggacgcggagaaaagagcacagaatgcggagaagttcgcggcggacttgaagtttgagttgaagaagatggacatcaaacacgacaatttggagaagattgtggaggagcaaagcgcaaagatacgaatgtcacgggacgattcggacgcggtggaacaactccgtaaggtaaagaaaacactcggaatatgtgatgaaggcatcccatctactcccttattttgtcgaacccaagagcgaatcaattgagagagttattgacgaaaataaatgcaaagaaaaattattatttagggggggggtgatatttgaacgcataacccctgcacaaatatgttaagataaacgggtttctgaaaagttttcaggagttgatagaggcgcaacaccaaaattctgtgagcgcatcgaccatcagggagctgcaaaacaaattggaataccaagagagggaattcgcaagtcgattgaatgataaggcatttctttgaattgtgatagatttccaatcggaatatattttcttaaggaccaagaaaaggacacttattggaagatgatagaccaatgcaaagcacgatcagaagagaacactcagaaggcctatgatgagctgaaaaaaacgcaggaggagaagcgcaatttggagcgcgagttggctgagggtaaacggacgatgaacgaactccttgaacttgccgagcaacagaaggaagtcatcacggcatgcgacagtgacaggacggagctggagaaggcgcagaaggagttggacacggtgcagaaacagtcggcggagagggagcgcttttggaagagcgaaatggagcgaatgcaaagggaaattgtggctcaggaaaagacgaaaa

SEQ ID NO: 66891 - DNA, 1014 bp, Heterodera glycines
  misc_feature (27)..(27): n is a, c, g, or t
  Genomic contig location: Contig_ID=SeqID_1050; Location=17..1030; Strand=+
  SCN-specific regions: Sequence locations=1-204,226-709,731-811,847 -1014
atgaatgaacttagtgccagatcaacncaagcgaatgtccagcagcagaatgacatggaacgatcatttcgctcggggatgaacagaacgcagtcaatgagcgtcacattcgtttcgcgtcttggttctgcgatgtctcaccaggaaacgttgtccaatttggactctgccggaatgaacgacgatgaaaggtgagcgaaaaagttgaaactgataaaacaaaagatatttctgatatttatgttgccaggctgaaagaattgcgcgagcggaaccggcgttatcctccgcacatgcgctcgtattatttgccggagtctgctcatctgaagaacagcgagacggatttgaatgttatgccgtgagagggaataattggcaaaatctttatcaatggaatgacccaattcgcttttttgaactcattattttttctgtgatctgaatattgatttgattgctttaattagaattatcatctcagaataaatttgacgatttgaaacaatggtaaaattagccagaaaagtcattttacggtttcaaatcttaatctttttcgaaaaatggggggggggacaaggtaaaaaaaattcagtggaatgaaaaaggagaagtaccgtatgtccaacgggtttgtgatgacacgctgataggggacgaatgcttaaacaccaaaaaacttcatgccatccaaatgtctacgtcaaacagagagagggagggagaggaccaaatttcagttaataaattgacacacgcttaatgaccatcaattcaatttatttcggaacacagatggaagtccgtcaacgtggacatctcctgcgacgccttcgaccccggcagcgaggacaccaagggcgaccgtggagtggaccaacacgccggacccagccgccaccgcgttcaagctcgagtggttccagggagacgggatggtgcgccgaagaacttgccgatcgagtacaacgtctgatggaaggatgcttcgtcgcctcaacatggacatga

SEQ ID NO: 66892 - DNA, 411 bp, Heterodera glycines
  Genomic contig location: Contig_ID=SeqID_1051; Location=482..892; Strand=+
  SCN-specific regions: Sequence locations=1-336,359-411
atggcgccctccgtttattccaatttcgcttcggatgcgtcggttcaattggcactgaatgttccccttccaaggaatgtttgttgtacccaaattgacaatgtccatacccaaattgacaatgtccacgaggtgggcacatcaattcaccaaattgtttgcagtttctcattttcagatgctttaccttttgcttcgccaccgccgtttccgtgagaagtttctcaacgacgacgataaccgcgagctcaaaaagcggcttctccgtgcgctgatgcgcgaagagataatcccatcggaagaaaactgagaaaatcggcaaaatttttggaaatatgccatttgaaaaactgctttttgattgttcattgctttatcatttcattttattagcgaaaaacatcgggtcaa

SEQ ID NO: 66893 - DNA, 321 bp, Heterodera glycines
  Genomic contig location: Contig_ID=SeqID_37922; Location=35..355; Strand=-
  SCN-specific regions: Sequence locations=1-42,79-137,159-321
tttttaggccccggggtcgtttgggccccaacccaaaaatcgaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgaca

SEQ ID NO: 66894 - DNA, 819 bp, Heterodera glycines
  Genomic contig location: Contig_ID=SeqID_37927; Location=405..1223; Strand=+
  SCN-specific regions: Sequence locations=1-347,369-819
atggctggattcattgcatgccatatgagtgcgctctcaaagaacaggagtttttgggctatggcctcatctaatcattccattatggaagaaattgttgctaatcatacaatgacgccacgcttaacagcgacagtccgttccctgattaacaacagaccagtaagctgtctggctgataccagagcaagtgtttctcttgcgccgatgagtcttatcaatgaattgaaatgcaaaatttttccgacaaatcacaccgttagttcagcctccgggcattggatcaacataacagcagcagccatggtacatatcgaaattgcaggtcagaaaatttttggcgaaataaaactcattcaggatgaagttatgagtgacagaagggattatcaagtcattcttggatgtgacttgatggcaaaacttccaccgattacttttgattttgttcaaggtctaatcagtatttcaggaaaatctgtaaccatgggagaaagaggtgacttgctttactccaatgtcaaagttgtggcacgtcatcatgttgacattcaaccaggatcctatagcatgctgaccggcaaacttgattcacaaattcaacttgatcaagttataacacattcactggatggacgactctccaaaatgcatctcgggatgatctcaactgtcgcaaagcccgtggagggatgcatcaagatgatattgaccaacccaactgatgcaccaatcagcatttgtgccggaatgcacgtagcacttgtcaatgaattgaaacaaagcgtggacggtccatggcttgaggaacaatcgcaa

SEQ ID NO: 66895 - DNA, 100 bp, Heterodera glycines
  Genomic contig location: Contig_ID=SeqID_37930; Location=1..100; Strand=-
  SCN-specific regions: Sequence locations=1-100
tgtcgttgatcactccaaactcacaaaagcgacagttttgcacttggaagcgtcgactgggcggcgtaaatgcattcgtagaaatgctttgttccaaatg

SEQ ID NO: 66896 - DNA, 96 bp, Heterodera glycines
  Genomic contig location: Contig_ID=SeqID_8073; Location=846..941; Strand=-
  SCN-specific regions: Sequence locations=1-68,91-96
atggctgatctgcaaaagttgagtggtgccgatcggctgctgctgtgccgtcgatatttccatgtgggcttcgtctgtctccctcttctctgggcg

SEQ ID NO: 66897 - DNA, 577 bp, Heterodera glycines
  Genomic contig location: Contig_ID=SeqID_8074; Location=1258..1834; Strand=-
  SCN-specific regions: Sequence locations=1-184,241-248,270-285,307-577
atggaaaaggaacgctcaacatcaaccgaggtaaggggagcaaatttataatagggaacaagatttggtggcacaaagtaacactttcagaaatggctaaatacggtataaaaactcgttttagaagaaaaaaagcaatttcttgagaaaatcgaccaaaaaatcgaaagtttccattttttgcttatttttgatataaattaaccaatttttaataaaatttaaatttatcaattttttcgacaaaattttgctaaaaaatgtctttttcagaaattttttcggtccttaggagtcaaaaaggccgatttacctcatgggggccgttctaataggggttttttggaaatatgccaatatatggacataaaatatggacataaatcgcgaaatatggaaaaatatggaaatatggacataaatcgcgaaatatggaaaaatatggatatagaaagctatcctagaagcttcaaaccgagctaaaaacatgtttttcgttcgtttcaggcctcccagagtccaggaacaaatatggatttccatataattggactccctattgatcatggacaataaa

SEQ ID NO: 66898 - DNA, 88 bp, Heterodera glycines
  Genomic contig location: Contig_ID=SeqID_8074; Location=1074..1161; Strand=-
  SCN-specific regions: Sequence locations=1-88
ggattatttttcaaaacacctcgtagactgggggataattggagactacgggattaatagagactgggctataattagagcatatacg

SEQ ID NO: 66899 - DNA, 591 bp, Heterodera glycines
  Genomic contig location: Contig_ID=SeqID_8074; Location=1872..2462; Strand=-
  SCN-specific regions: Sequence locations=1-591
atggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaaatggcaaaaatgtcaaaatatggacataaatttttcaaaattgaatgtaaaatttcttcaaatttattggttgaaattgcatatgagatacatttccaaattttggggtga

SEQ ID NO: 66900 - DNA, 3453 bp, Heterodera glycines
  Genomic contig location: Contig_ID=SeqID_8075; Location=262..3714; Strand=-
  SCN-specific regions: Sequence locations=1-33,55-296,335-677,717 -756,788-872,894-951,973-977,999-1007,1029-1104,1152-1215,1262 -1286,1346-1405,1427-1462,1561-1905,1927-1964,1987-2109,2132 -2545,2572-2754,2776-2811,2833-3428,3451-3453
tacgcaattggtgtcaccaatttggtcaacattcgccccctttttctcttcttctgtttatgcgcttcgcgtgcacaccccccccccgtttgatcagttggacaaatcgttggccgactcaatcacttggcacatgtgcagcaccgaattccgtaaacatttcgacaaatttttaaaattgattgaacaaacagaattttaatctgaattcagtaaccggattttttttttgacaccagcacattttgcacggataatttgggaaaatccatgaaaatttctgataaagaaaacacggggaaaacaaatactcaaaaaattgtttcttttcaccaaactccttccccattccctttctctctcttttttttgccaatttttgttgcgtgtatattttgctttccataaaaccttccatatttgtatctgagaaatttatgaaatttggcatcaagaaaaaaaagtcttagaaagactttttataagaaaattctaacaaatatgaaaaaacattttttgcgaaatttttatggggaattacaaagaattttcaaaaaattttccaaaaaatcgctgaaaatacatcaaaaaaatttttcttagaattttcttataaaaaaaaaaactttctttcctcagttcgtaatgaacagagaaaaaacaaaaacaaaatacgcaaataaaaattagtaaaaatgttaaatatatattaattagtattcagtattacaaaaattctctttgaattacctcgccataattttttttttaatttaaaaatatttttccaagaccctggcacgcctgaaataatttgtgaaccggacaaaattggtgtgcgcgcaagcaccaaaaaacagtttgatggcattgtttttgtgcaagacaattttgatcgtgccgaatgccgggcgggacctgaacactttcccgacccaaagtatttaattgaaaaattaattttaactttttaagaatgatgggggtaaaatggcaccattttttgattaatttgttcataaaaatggcattttccagaatcattggcatcaccgtgccattcagaaattgcaatgtgcgtcgatatcgatcggtaaaatgaagaatttattttctaaactaaatattttaattaatttataaataattttcaattcctttggctttattttcagcttaatccccgtggaatttttgtagagatggcggtaaatcttttaaaagttttattgaaaaaaaataaattattttattatttttaggttgtttttatgttccatccagtgtaaaattctaatttatttaaaacaatttatttttaaacgaattaatttaattaaaaattcacacaatttattgctcaatttttgtagtttcatgacaaaagttgaccaaatggttaaaattcaatgcttttacatggaggctgagaaagaagtcaaagtaccgatggaagtcaggcaaaaaattttttttagaagtttcataatttaattatggttaaataaatttttgcgaaatattttataaattaatttaattttatatttttaataaaaaggaaattgcatttcagtcaaatcacaacccaattctatcaacaagtgtaccaaatgccacgctgtgaatacacactgcgcaaggaccatgcaaatggcccggtagtacagtatgccgtccttggtaactcattatttttcttttttcatagaaaaaaatagttttatttaagtatcagtaagtttgcaaggcgatcgagcactataaatttacagtaattatttgggcagtaattggaaatttctgtaattgaaacaatctataaaaattaaaactgtctatcattatgatgcattgataaactaattagtttaattattttttgtaggtcaaagcgtgttccataggtgggaatgtgtggaggagctgaacggtgatcaattcggaatgcttgtccactcgtgttttgtaagtttttctaattaaaaattaattggacaattaacattaattaaacattccgttttttgattacatttataataaccacgacctttaagaatgaatttttttaaaatgaaaaaccgttatcaccagtttttggttaggccgggtttgggcccccgtttttcgaggtttggttcggttaaacaaccgtgacctaccccactaattataatgtaatttgatcattgtctgcaactttgattggcaacaacaaccagcaaataaattttttatttattgaattctgcaagtcaattttgttttcggttgataatggtttcggtgatcgggtggacattctcgactcgcgtggctgtggcttggatgccgtactgttgcgcactcccgactacgacagcacattgaggctggccaccaaggaataccatgtgttcaaggtagtccaagatcattgccaattatttgaaggctgaaaataatggcacacattttggcacgtcataaaataagaaaggaaagtcgcttcaagatattgtaattttttcaaaactttcgcttactttcaagattcttttgttggtaattttacattttttggaaaaattgaagctgaatcgtccaactcacaaaattaggctaaatgaattaaaaacggctaaattaagtatctataagtgctttttagcaatttaatgtcaatctttattggtaattttttacataattttaatctccaattaattaccagtaattgattccccttcctacagtatgcagaccgccctgtgctacagtttcaggtaaattcttaataaatgttcaagaagaaaattatattggcaaattaaaatcaattctataaaaaattgtgaatgtactgagaaacatggctgggcgtgactggatttccagttatggaaacccgtaatccgtaattattggcattagtttctcaattaccgaattccgtaatccataatgacggggggggggtccaaaaacgccgtaatttccagtaatccgtaattacgccaagcagccctgttgggaatggatggaggagtaaggttcggttcccacacgaagcgcctactaacattttgcctattttatttttcggatattaattcagcattcatttattcgtttgtccacttttttaagtgccaaattacattgtgcctaaagttggacaatggctgcgctggcataacaccgccaaagtgtgccgcaactgtgccacggcacaccgtcaccgagcagtacaccactcgaagacgcaagtcgaaaaggcagcgaaaggtgcgcagcgttgcacaagcacagcaaaacgaaagtggccaagttattggagatgaacaaaatggtggcacgaaggtggacgtgttcacaagaccaattatggtcggttttatggaaattttaggcaatataatttattaattaagggataatatagcaaataatgaaactttttagaattca

SEQ ID NO: 66901 - DNA, 693 bp, Heterodera glycines
  Genomic contig location: Contig_ID=SeqID_8075; Location=1295..1987; Strand=+
  SCN-specific regions: Sequence locations=1-289,312-434,457-494,516-693
atgatcttggactaccttgaacacatggtattccttggtggccagcctcaatgtgctgtcgtagtcgggagtgcgcaacagtacggcatccaagccacagccacgcgagtcgagaatgtccacccgatcaccgaaaccattatcaaccgaaaacaaaattgacttgcagaattcaataaataaaaaatttatttgctggttgttgttgccaatcaaagttgcagacaatgatcaaattacattataattagtggggtaggtcacggttgtttaaccgaaccaaacctcgaaaaacgggggcccaaacccggcctaaccaaaaactggtgataacggtttttcattttaaaaaaattcattcttaaaggtcgtggttattataaatgtaatcaaaaaacggaatgtttaattaatgttaattgtccaattaatttttaattagaaaaacttacaaaacacgagtggacaagcattccgaattgatcaccgttcagctcctccacacattcccacctatggaacacgctttgacctacaaaaaataattaaactaattagtttatcaatgcatcataatgatagacagttttaatttttatagattgtttcaattacagaaatttccaattactgcccaaataattactgtaaatttatagtgctcgatcgccttgcaaacttactgatacttaa

SEQ ID NO: 66902 - DNA, 46 bp, Heterodera glycines
  Genomic contig location: Contig_ID=SeqID_37933; Location=636..681; Strand=-
  SCN-specific regions: Sequence locations=1-46
atgaactggcgtggctatggaggcagcatgggaagcacatggggag

SEQ ID NO: 66903 - DNA, 438 bp, Heterodera glycines
  Genomic contig location: Contig_ID=SeqID_37935; Location=232..669; Strand=-
  SCN-specific regions: Sequence locations=1-438
aaaatggtgtaagtaaaattgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagctcctcaaacaattttagcgcttccaattccctctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgc

SEQ ID NO: 66904 - DNA, 677 bp, Heterodera glycines
  Genomic contig location: Contig_ID=SeqID_37936; Location=17..693; Strand=+
  SCN-specific regions: Sequence locations=1-219,246-256,279-285,307 -435,457-468,494-552,609-677
atggtgagttatcaagatttacaacaacaaaaaaaaattacgtaatttggaaaatggcagatcagccggtctcaaacccgtttaaacttggagtttccgaaaataggccaactgggttttcaataaagctactttcgataccaaattattaaattggttgcgataagacaatcttacggcaaaaaaacatcttggaacaagatatatgttatatctttttgtaaaagttttaaaacaaacttcttttcgtatacagaagaatggtttaaaaaagttttggtactatttggtggagttgtataaaggattcaagccggtcacaacgttggaattggcggaatttaagaaatttgtcaagttatgcgaccaacagaatattaaagatgtgggaaataacatattgaaattttataatgtgtattattagacaaaatgttaaatttaatttattagaatccaaaatgagcgaatattttatttattaaatatttttgccacgaaaaaaattataaagatttataaaaagagaaattaatgaataagaatttggtgataaaatttaaaaaaatgaaatcttttttaaatatgaatcaatatttttaaaaaatcgtttaaattcctaaaatcaaagaaggaacaggaaatattcgttcaagtaaagacaaaaaaaaaacaca

SEQ ID NO: 66905 - DNA, 910 bp, Heterodera glycines; identical to SEQ ID NO: 37937
  misc_feature (812)..(812): n is a, c, g, or t
  Genomic contig location: Contig_ID=SeqID_37937; Location=1..910; Strand=+
  SCN-specific regions: Sequence locations=1-451,482-548,593-722,753 -765,787-836,869-910

SEQ ID NO: 66906 - DNA, 155 bp, Heterodera glycines
  Genomic contig location: Contig_ID=SeqID_37938; Location=976..1130; Strand=+
  SCN-specific regions: Sequence locations=1-155
acattgcacgatgcgtcgctggtgaagtccctcctcaaaaaacgcgcaaatatcgtgccgtcgatgcgagaattctcgactcttacagggttacaataccatcaacaacatcaaccctgcttaccaaaatgatcaaaattaccatacaatgttaa

SEQ ID NO: 66907 - DNA, 78 bp, Heterodera glycines
  misc_feature (62)..(62): n is a, c, g, or t
  Genomic contig location: Contig_ID=SeqID_37938; Location=1..78; Strand=+
  SCN-specific regions: Sequence locations=1-78
gacggacgcattcaaatggctgaatcacatcaaaaaatattgaatatattgctaatgcttgncacgaagtgacgaaat

SEQ ID NO: 66908 - DNA, 146 bp, Heterodera glycines
  Genomic contig location: Contig_ID=SeqID_37940; Location=116..261; Strand=-
  SCN-specific regions: Sequence locations=1-79,113-146
atggctatctctttttttgagaaattttctatgcaacaaacgctctcgaacatgaaacgaagtgcggtgcgccgtggccattttatttttcaaataatttttaaatttaatacatattccagaaaaatggctatctctttttttga

SEQ ID NO: 66909 - DNA, 146 bp, Heterodera glycines
  Genomic contig location: Contig_ID=SeqID_37940; Location=368..513; Strand=-
  SCN-specific regions: Sequence locations=1-79,113-146
atggctatctatttttttgagaaattttctatgcaacaaacgctctcgaacatgaaacgaagtgcggtgcgccgtggccattttatttttcaaataatttttaaatttaatacatattccagaaaaatggctatctctttttttga

SEQ ID NO: 66910 - DNA, 146 bp, Heterodera glycines; identical to SEQ ID NO: 66908
  Genomic contig location: Contig_ID=SeqID_37940; Location=620..765; Strand=-
  SCN-specific regions: Sequence locations=1-79,113-146

SEQ ID NO: 66911 - DNA, 118 bp, Heterodera glycines
  Genomic contig location: Contig_ID=SeqID_37941; Location=446..563; Strand=+
  SCN-specific regions: Sequence locations=1-118
tgtccgtttggggtactcaaacaattatggggagcaaaaatccaaggcagaaataaagtacaggtatagggaagctattcccgaaggattcggtctccttataaatctgggcgcatcg

SEQ ID NO: 66912 - DNA, 1716 bp, Heterodera glycines
  Genomic contig location: Contig_ID=SeqID_8076; Location=195..1910; Strand=-
  SCN-specific regions: Sequence locations=1-24,72-262,315-351,373 -536,589-728,750-862,885-1000,1079-1187,1219-1494
atggtggaggtaaaaacaaatttcaatttataaaattgatctaaaaatatcattttttaaaataattatttcgaattttgacatttttcacccgtaattttttcaattaagaaatattttacgaatccgaaattcaaatatttgtaatttagttattactatttttgaaaaaaatttcggaaaaaattaaaaagggtggagcagctccaatgtaagggagccttgaaattcttccatttcatttatgtaattaaaataccagaattacattaagtccaattaataaattaaataattaattaatgatttattaaatcgtttttccctacaggcgcctttctgataccgtaccttgtgatgctgttggttggcgggctgccaatgttttacatggaattggcgttgggccaattccatcggtcgggctgcttgagcatttggaagaaaatttgtccaatgttcaaaggtccgggaaaaatttgtttaattttgattgctaaagttcctaaaattaaatatttgttacattcgttttcaaaaaattttagaaaattgaaaaaattattttacgaattttaaaaattttttccagttttagcaattttaacttttcggtattgacgaaatttctttttccctatttatttgtgatatgcgactctctcaaactaatgaagagagctttctttcccctaaagttgggattgaaaggagtgcaaaggcgccctgtgtagctcagtggttagagcattccacggaaaggaagggacgtgggttctaatcccaccgcaggctgatcttttgcacttacgccatccgccaataataccacatattacgcctaaccttcgattatttataattttctcccattttaaaatatttacaaataaatgtgacaaaatttttttttctatattttcttttcttcgatccttttaaattgacggttttctctcttttttggttcctcggatttacgtctaacctccgattatactaataaatttaatttttagtttttttgaaatttttccaaaattaaatttctttttaattattaaaatttcatatttttcaagggattggctacgggatttgcttcatctgcacgttcatctcctgcttttataacacagtcattgcacacgctgtttacttcttcatcagctctgttggggtcaaacaaaaattttttttttttttgaaaaatataatgccaaaaaaatacaaattttagtgggaagtgccgtggcaacgctgcaacaacacatggaacacccaacagtgccgtgaatcgctgaacgcaacaatgggaaccgaggatgacaacggacaacagctgaggacgccgtcccaagaattttatttgtaggtttaggggggggttgaaaatttacaaaaaatttcaaaaaatattttttacagatattcggtgctcgaaagtaacaaatccaagggaatggatgatctgggaggcattaaggtgataagaaaaaaatatatcaacaaataaatttattttatgattgaaaaattttatttatttttaattgtattaaatataaaaaatatgtaatatatttagattattaaatataattatataattctttttgtgaattttacttttgttaattaaaattaaatataaaaaatatttcttttaaaatacaattcaaaatattaaaaaattgttcaaaattatataataaa

SEQ ID NO: 66913 - DNA, 151 bp, Heterodera glycines
  Genomic contig location: Contig_ID=SeqID_8077; Location=139..289; Strand=-
  SCN-specific regions: Sequence locations=1-151
atggcaaattcgtggtctgctggaggcggttatggcaaccttttggccatcgatgacgacgagaacaccaccactgaggaggaaaaaagtggcactggcattgccggaggcggcggtggcgaagggttcaccgtcgggcacggcaccgaat

SEQ ID NO: 66914 - DNA, 521 bp, Heterodera glycines
  Genomic contig location: Contig_ID=SeqID_8077; Location=2050..2570; Strand=-
  SCN-specific regions: Sequence locations=1-38,60-153,175-248,272 -382,415-521
tccctcatggctatttagaccaccatcaccaacttcaccaccaacagcagcgccgctcctgcttccatcttcgtacaatggcaataatgcatggcggcgccggcgacaacggcggtggttcatcgacggtcgcgtcagtgccacaggggagcagcgcgggcgcagcggctgcggcgcagccaatgtttggtgacatggcggcgcgccatcgccggcgcagctattggctggcgacaacgacggcacagccgcaacaacaacagcagcagccgcgttcatggcacagaaacgcccgtggtagatgcggaagtgaggggcaacaagttggagcagtaaagcagcagcagcaaccacgagaagttggagcagtacaactgcagttacaacaaaaacagcaacaacaacgacaccaactaattgttggccagggtcggtgtatggctttgtattttcccctaagggataaaatgggaattttcaagtcgttcagtgccgagtttagggatttcgaaattgcgtaa

SEQ ID NO: 66915 - DNA, 908 bp, Heterodera glycines
  Genomic contig location: Contig_ID=SeqID_37950; Location=121..1028; Strand=+
  SCN-specific regions: Sequence locations=1-329,365-451,474-605,628 -742,767-908
atgtatgaagcatatacaaacgaagaaattgtttctaaattaccaatcgaagcatcatccatcggaagctatggtttgttttatgaacaactttctctttatgagatttagtttcgaaaggaaaattattcattggatccagacaaggccatctcataacatgcaatcagaactcagcaggttgtttgtgccgtcaattataaccaatcgtaatgtttagacacttccaaacttcattatgaatatcaagtatgtcgtacttttgaaagacgtccaataattgagcttcaagtggttgagtcgcacgatctaattatatgtttaacggatgtacatttgtcaattcatgatgctgtagaaccatttaagtttgtgatttacctttttttaatttggtcctctattttcaggctcttggatgtatgttctaagtacaaatcaatttccgcattttctcattttgtgacagaggtgagcaaagacgattatcaatagtttttgttttttcagagccaaactattcatattgcaatttccgcaagaaagcatttacacattttcaaatatttattgggtgaactttgtgaaattaacgactgtgcaccgattactcttcctgagaatgcccaagccgttgtgtggtatgtgttaaatacacttttttttgttagatttgcgtaaattatcctctgtaatatcaattttctaaccttcgtgctccgcataatggatttaatggtcattacttactgttaatacttattggtaatttttaaccaattttaaggtgcggtgtcaacaatttaattctggcatttaaatgcgagttccaattctgggacatggaccatttcctccacagagatgatttgatcggcgaaaaagtaacaaccaatttatttttgtga

SEQ ID NO: 66916 - DNA, 1699 bp, Heterodera glycines
  Genomic contig location: Contig_ID=SeqID_8079; Location=128..1826; Strand=+
  SCN-specific regions: Sequence locations=22-295,317-438,460-678,700 -909,932-1157,1179-1267,1291-1699
atgctggcaaaaggttcagcaccatcaacagggtggtacggatggattacaaattggtttaccgaagaagggaataatgacagcgaggctcaaaacggtgctaaaattatgagattcatttaattagcatcattttgtagaactcaaaaactgtggcaacgatgtgaatgaggcactgtatttgagcatgaagccgcccaaactgaaaaagcacaaattggaccccgaattgaaggcagtggaaagtcgaatggaagccgaaatcctacaggtaaaactggcaaatgattattagaaaataaacaaaattaaatgagtttcaattggttgtttctgcagatgcttaatgagtcgtgggatgagtcgaccattttgcgcagggacaatttattggcagagattgtgctgaacgtagccaaagtgttcttcagacttagcgaagatgaggaagaaaacgaagccaaaatggagcaaggaaaagtatgaaagaggggtgggggggggataaaattctatatgggatttagggatgcgaaaatggaccaaaataaatgtaaaaaattggaaataaataaaaaaaactgcgaaaaaattaataaaacatttagactctatcataatgggaaatatcgcaaatttccacttttactatcaacgaataaaattcaaaaattaaaatgtgttttttctatccgtctttttcccatttagccttcctcctcttcgctggtcagtgaccgcggcggtgccggcgttgagacggcgtcttcgtcttccgctgctgccgatgttcagcagttgctcaccctcgacctcagtcggctgtgcagtcgcattaatctctcgccgaaagagcaccgcacggagctgtcgctgagtgtggccgacctaacggtgcagcgagtaaagcaccaccagcagcaacaccaacggcacaggacgacggaatcgccggcagaaaactgtggcgacggagcagcatcagctgacggcaaaagggcacgcttttggggagtgccattcccttacctccccttgccctattcccatttctaaaccatttttgcatatattcgtccctttttgaattgtacattattttttcagaagactgcggaaaaatcaccacttgataccgatgaattgggcttctttggctctgatgagtttgatgaatcactgttctacgggtttcaacagaaaaatgtacaaagtacgcaccttttgctggccattggacgaacatacggcgaaaattacgcaaaagaggcaaatggaaagcaaaaaaggtcgcaaatttgcagcatttataaggaatgggtcaaatgattcatcgggataaaagacattcattacatatcggacccttttttatttcagaagtaaacggtccaatttgcgtcaaaaaggccaacaaattggtcgtcgttctgctcatagtccatcatcatctaccgctgctgctgctaaaccaactgattatggtcaccaagcggaggacaacaacgcgatattgcgcctgttctacaagcgacttgcccccaaattggaggtgtaccacgagctgaacatctcctgtgctccgctgtcaattctttgcgatgagtgtgcgctgagcggaattttcgagccattcacacaaaaggtaggcaattaacatttgataaaacaaaagcgatcaattaactgcaatcaaaaa

SEQ ID NO: 66917 - DNA, 1601 bp, Heterodera glycines
  Genomic contig location: Contig_ID=SeqID_8079; Location=1948..3548; Strand=-
  SCN-specific regions: Sequence locations=1-370,392-557,594-1304,1326 -1601
atgaagagcttacaacatttagtgctgtcccatcattctcaactgaaagatacaatcgaagaccaactgtgcctggcttccattcactacctcagagcgcatttccaacaggcaattgacatttacaagaagattttgtcaaagaacaagaactttatggcgctgaatgtctatttggcactttgctactacaaattggattattatgacctgtcgttggaaatgctgcaaagctatttggacaaatatccggacagtccaaatgccgttaatttgaaggcttgcaaccagtacagactttacaattcgaaggcggcagaaaatgaactcaaagtgctgaaggatttgtcgagcagtgaacttcgctttgcaaaggatgtaatccttcataataaggtgtgaccaatcaacaacatcaaacgcaaattgcattaattacataggttgtattccgaaatggggacggggcccttcagttgttgccaacattggttgacgttgtgccggaggcacgcctcaatttggtcatttaccatttgaagaaaaatgacaccgactcagcccatgtgctgatgaaccatctggagccacagagcacctacgagtacttgctgaaggcaatcacactttgcataaaaggaaacgaagaaaattcggtacaccgacttttaatcagatggaacaatcaattagcgttaaacacagaaagaattgcggaaaacagcggcccattgcttcaaagtggtgggcgaatcaccggccgaatgcgatacaatcattggccgccaaagcatggcttcggcttattttcttcgacaacaatatgtcgaagttttggtgtacttggattccattaaggttcaaatcattattctctcaactaattaatgttattttttttttctacacagcctttcttcacaaacgacgacacttttaattttaactatggccagaatcagttgctgtgtgaacacttcgccgaggcggaagaagcgtttcgaatggtcacagggcacagcatcatctccaacctgacccattgtctgtgcattgcccgtgcttacattgcaaacaaaaagggcaaagcggcatggagcttgtaccagaaggaaagacacattcaaaattcgcaacaattgctcaaactggtcgccatggacagttatcggtcagacaaagagcacattaattacagctattaactacactaattaacctaatttgctgttaatcattcaaatatttacacgggcttttctgttgaacaaattgatttttaaaattttttcttttcccactacaattaaattaatatatttttacacagagctgaagactatgtaacggcagcaaaggcattcgacgagttggacaaacgcggtgccatcggtagcgatgacggcaacgaagaggaaaactatgccgtggcaaagcaggccgcatgtgttggcgttgtcaaaatgttcgcagcgcgacaatgcgacacgggagagttgagagacgcgatgaaaatgctgggcaaggacagagacacaaatgcgaaaaacattgtaacgacagtgaagaaatgggcagcagagaatggcgtgtacatatga

SEQ ID NO: 66918 - DNA, 513 bp, Heterodera glycines
  Genomic contig location: Contig_ID=SeqID_37952; Location=343..855; Strand=-
  SCN-specific regions: Sequence locations=1-440,462-513
atgaccatcgccagcgcctgcgtcaagaactttgcactcaatcatttgaagcccaactcgctcgccatcgtctcggagaaaggctatacaccacaacagaaccaaagtgcactggccatcaaatacctcgactggtactcccacatcaacaatgtcaacattcaaactgcacactcccgctatggtgaatatgtctttaaacgcgagggtcaggtgtatcaagtggatggttatataaaagggactaatgggaagagggataaaattattgaggtaaatggttgtctgtggcacgggtgtgaggaatgttttgaggacttggacgacgaaacgaaaatgccgaacggaaagacgctaggacaattaagagagagggaggtaaggaagcacgagattcttagccggtacgtagacttggaggtgatctgggaacacgaaatcaatgagcagctgaagaaggacaagcaaatgagggagtttttcgacaactggaaagaccactcaccaatataa

SEQ ID NO: 66919 - DNA, 60 bp, Heterodera glycines
  Genomic contig location: Contig_ID=SeqID_37954; Location=274..333; Strand=-
  SCN-specific regions: Sequence locations=1-60
gctcggatttacactcaattggaattggacaaacttcgccagcacattcagtctcgacaa

SEQ ID NO: 66920 - DNA, 130 bp, Heterodera glycines
  Genomic contig location: Contig_ID=SeqID_37956; Location=1351..1480; Strand=+
  SCN-specific regions: Sequence locations=1-130
atggctttttacatcactctgattgccctcgtgttggcggtcattcgctttttggtcaaaagtcggtcgaacacgacgtaccgtactgtgacagtaacaccgccgatgctggaggagtgtgcacagaaga

SEQ ID NO: 66921 - DNA, 688 bp, Heterodera glycines
  Genomic contig location: Contig_ID=SeqID_37958; Location=42..729; Strand=-
  SCN-specific regions: Sequence locations=1-2,245-315,365-488,510-688
atgaggaaaagagcagaggagaaagaggaagaggaagagaagaaggaatggaagagaagtgagacggaggaagagaagaggagaaagaggaagaggaagagaagaaggaatggaagagaagtgagacggaggaagagaagaggagaaagaggaagagaagagaaaaagaagacaaaactagagaataggaagaagaaaaagaagaaaggaagagaaagaggaagatgaatggaagagaaaagaaacggaggaagagaagaaaaacaaaggaagagagaaaaggaagacaaagacaaaacgagagaagcattaggaagaagaaaaggaagaaaggaggagaaagaggaagatgaagagaagagaaacggacgaagaagagctaaaaaagaaaagaaacgacggcaaaaaagaaactgacgaggagcagtagttccgtttaaatcaagctaagacaattaatttgtttattttctggtggcattgcccattgcttttcttcccctccccctttcggcatttgtgccgtaatcctttcttgctgatgggctaatggccgtttttcatggcaatgtttctttttcgtttacgatccctagcggttcatttgcctaattgccagctgatttgttgtgcgtaccctttagactcctcgaaaatcccctcatggcatcgcttttcgacaaataaa

SEQ ID NO: 66922 - DNA, 567 bp, Heterodera glycines
  Genomic contig location: Contig_ID=SeqID_37961; Location=215..781; Strand=-
  SCN-specific regions: Sequence locations=1-374,417-449,472-567
atgccgggtgagttctctcgttgcgcggtgatctctttagagttgtcgttggtctaggtggttttgacctatttcaaagtagtttgtgcttgccccatctgtgcatggtccgaggacctataggtgaattaaccgtagcagaagcgtctcacacttcgcagtgatcctcctcgtcaaaggcttcgctcacacggaaatgagtgcggttctagtcggaccaaaatactttttgagactcggagtgtttcgttattatttttattgggcacaacttgttcttaaatattttttcagaaagggttctgaaacgcaccaaattttatttacatgttagtttaggcactctgatgctttttctatcaaaaagggagatgaataaaatttttaaaaatttttaattcctttaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaa

SEQ ID NO: 66923 - DNA, 1228 bp, Heterodera glycines
  Genomic contig location: Contig_ID=SeqID_8081; Location=1121..2348; Strand=+
  SCN-specific regions: Sequence locations=1-152,175-418,455-539,562 -1137,1162-1204,1226-1228
atgcctttgactaaacaacacgaaaaagacgaagaggaagcgaattcaccaatgaaaacagcgaagaaacgccaacgaagcgaagcaaaggacgacaacgaaaacaacgacgacggcaccaaatcaattggcacaacatcaacaaggccttcatcaccaccagcagcagatgaagtgcggggacgacggtttagcgaacggttgcaccgcaaaacagtccgaggccaagccgaacaattgcagtattggcagtgccatgttggggaagaagcgggcggcgaaggacaacggcggaatgcaaacgccagcgccaccaccaacacgacggagaggacgacgaggaaaagggtggcggcggcggaatcggcgccgacagcaaaagcagtgccaactccgtcgtccaacatcaacaaaataactccgccgctcgccaccgccgtgccgccgccgtccgaaaagcggttgcgcctgcagacttatcaacagatcgctgacgactttggactgcgtcttacggcactttggtgagcacagagcatgaggggaaatacaaaaaattttgaatcattttaagcgagtttttcaaaatttataatgaattacataaaaaatttttcaatattttctttcatgaaattttcttataaaaaactttttcggggagggtggtggaccagttgctccccaattcttacaaatcaattctcattaacacttcgaaaacctttccctgcggcgcttttcggcaccgcttgaaccccgccgttcacaattttttttttttttgaaatttggcagccttgacatagagaaaaccttgtaatacctatttgtttttttacagtgaacaatactttttctcattgctcaccaatgccagcgtttgcctcgtgctcacaattgaccctcgtcaacagatggccaaaatttcctacgaaagggccttgggatggtgggtgattttttgcaaaaaaaaacaaaaattttaaacgccatccgaacatacgttcttttttgaaactcagaaatttaaaggttttattttgaaattcatataagacacagccgataaatctctataaaacacgtgaatttacacttcaaaatcaaaaaaaaagtgcgtccggccatcgattttttttctttacccccaaaaaaaaatttttttttttgaagattatttgagtttgttaagcgctttccattttaatttcttttttgtttgcca

SEQ ID NO: 66924 - DNA, 1321 bp, Heterodera glycines
  Genomic contig location: Contig_ID=SeqID_8081; Location=2616..3936; Strand=+
  SCN-specific regions: Sequence locations=1-154,178-766,796-1018,1040 -1321
atggcaaacgaaacatcgtccattccgatcgttgaagaaccgccggaagaagacgaaaatgaccacgaacaacaacaaaataaacacaccgagggagaggaagaaaaagccaacggcactttttcagtcaccgtctctcacccgtaagtttttgggaacaatttttcattcttttttgaatgtctcaaacaatgactccgttggtctcacacacctctcattgttatttttttgttaaagtttgatagctagtcaaaatcaaaaatggtatgccatttttggcattttgcaagttcattgatctttgggtcattcgaaagtgatcccttagttcaccggtttttttaacccaatttcacaatttttattttattttaggatttttaacatctaataggttgcccctttacagggatttgcgattggaaaggattgctggcgatttgctgctgcgtttggccatcgttcccgggtgtgtgatgcttttggcatttgcgtaaaaaaaattcatttattctttaacggcattatttcatttttattttttctgacttatttatttttaccacaattttggcactttcacagaaagcgtattcaactttcaccgcttgagcaacaatacaccaaaaagaatcggacgaagcaaaagggcgacgaatgtttgacttttgaggacttcaatgtggcgaatgacgacaggggatggatccgagtgattgaggggggcggagtcaggaagaatggacaacgcaaggtggaaaacaattattaataattaactaattatataaacacaccaaatttggaacatctaatcccattatattcgggtcattttgagcggaaaaaagcatttgcaggcacgcggactcgaaccggcagcactgggtagtgtggtggtatcgtgctctcggactatgtgggtccccaccggttcgaatccgcgcgcctacaaacaatttttttttgtcaacacaaaaacctaatcatgagtgaaaacgtctcttttactaagaaaaatattttgttaatttttattcatttttttccaaaattttggttgaatatgccaatttcaggcaacccggacagagcattggttgaagatttctcgggaattgttcacatatgccatcattggtgagcaatttgtaaattacctaattaatattaactgataaatgattttttgcaggaaaaagtgcagcagtttttcaagaaatttttccacgtgcaacaaacggcggttgacgacaaaacatcagcagacagatcaaatgaagaagataggaagagaagaatggaattaaagaaataa

SEQ ID NO: 66925 - DNA, 1151 bp, Heterodera glycines
  Genomic contig location: Contig_ID=SeqID_8081; Location=4766..5916; Strand=+
  SCN-specific regions: Sequence locations=1-687,730-774,796-845,874 -983,1006-1151
atgatctgttgcgactactgtcttatttggtaccacgtcgaagggtacgggttgtgttgttttacagtgtcttatttttattgcaataaatcatcatttttgtgtcctttttacagtgtcaaagtgactgaaactcaagcaaaaatcttcaaaaaatttgcgtgccattttttgcaccgccaaaagacccaaagctgtgtaacgctgcacaagaaatgggccaaggggtgttgtgatgagcaaacatcgggggcacaaaaagcggcggaagcgccaaaaacaaaggttttttttgttgttggcattattgcaatttgctggaccaaaaaaatacttttacatctaataccataaattcttgatatcatttgatagccctgaatgttctctattagtctacgaaggttgaaaaaaattcacccaagattcaaaaacatatgacaaaaaagtgtaattttttaatttttggtcataacttttttgaaacataacgaacttctttgaagttttacaggctaatagagagagattaaagctatcgtatgttaccaagaaggtttaatttggatgcttctagaaaaaattatgatactttaaatttgttaaatttctattcgtgtgaactacgacagagccggttttttatcaaattttggtcataattaaacaaaaaacaattcattggggttttaaataataaaatttggctaattaattaaattaattaatccaactcccattttagagcaaaattctggcaaggaaaagaagggcgaaagggagacgaaaagtggtgggacagaaaaacgacgaagggaacgggaacgaagcggcgaatcgtcgtccaaaacagcagcaacaacaacaacaagcggtggtggtggtgccaggaaaagcaacaggaccaagacggacggcgaggaaagcgaagagacgaggaggaggagggcaacgcccgaggcaaatgccgtgccgccggcggtgccgccaccgcagctgccgccgttgacggcacagcagaagcaccagctggaactgcaggaggccaaccagaatttgcggtgcaaaaattgcatcggtaagcggtagggttgggtcaatatgattgcggcaaaagtgagttcccccaaaaagtttccatgcttcttgaa

SEQ ID NO: 66926 - DNA, 617 bp, Heterodera glycines
  Genomic contig location: Contig_ID=SeqID_8082; Location=115..731; Strand=+
  SCN-specific regions: Sequence locations=1-617
atggcggacatcaacatcagactggacgagctggaccagtggaagaacaatgtgcaccaattcatggtggtgttgaagagcaacaccttcgacaacggcaccaccatcgccatggacaacgacggcaccatcgctatgggacagcagcaacaacagtcaacgacgacgacaaaacgatcgccaaatggtggtgccgatgccaatggggacgacagggatggcggaaatgattgccatgctgcagaaaatggaagtgaggagaaaaagccaacaatgacgacggcggcagtgaagaatgaggacgagaatatggtaagtttttggagtactgcgcgagattctcggccttttgggtggtcgagaaaagcatccgaatacagacagacgccatcgggaattttttttggacgcttagcttttcaactgattgtgaacagtgttgcattctgttaaatgctaaccgaatttggtttaaattagttctcatttggttcatgtttcagctggtcggatgtccggtgtgccatggcgaattccaaatgcgcgaaatttgcaaacacgtgcacacatgctttgtgcgctcggagcgtcaaacaacgtacggcacggattaccaa

SEQ ID NO: 66927 - DNA, 92 bp, Heterodera glycines
  Genomic contig location: Contig_ID=SeqID_37962; Location=406..497; Strand=+
  SCN-specific regions: Sequence locations=1-92
gttgtctatctgaccgcatcatttccctatttgatgctgttctttttgcttttgcgcggcctttcgttgcctggcgccagcctcggcctcga

SEQ ID NO: 66928 - DNA, 396 bp, Heterodera glycines
  Genomic contig location: Contig_ID=SeqID_37965; Location=8..403; Strand=-
  SCN-specific regions: Sequence locations=1-294,317-396
atggactcggcacaaattcgaaatgctcttcttgagttggctcaaccgaacagacaaaatgaaggacaagagaacggagcggaaaacaatggaaacgaagaacaacgcggaggtttgcgaatgagattccgaaatgtgggaacaaacgacggaagagaaaattggttggttggagacgaaaatagaaatgatggtcatcgcaatctcaaccaaaacttgttgcctcgaacatccacgcctataagtggcccaataattccggaattactcattcaaaacgtgcatcagtctgtacaccaaaatttgccaaacagacaaaatatgggtgacaaaaaccaacagcatggtattcctaaaaccgcaatgccgcaaccacaagtcgttcagcaacaatag

SEQ ID NO: 66929 - DNA, 573 bp, Heterodera glycines
  Genomic contig location: Contig_ID=SeqID_37966; Location=187..759; Strand=+
  SCN-specific regions: Sequence locations=1-249,271-339,392-403,441-573
atggtatgtaacacatatgcattttccgagttacagttcgggtggttcccttgttagttaaacaccacttaagacatcgaagctcaaattcagccggaaacgcgtgaaccaccaaagcgagccagcagaagaccacgatcgagatcaagctcacacagtcgtgagcgattgagtaagccgtttttggtattttgcgccagaaattccatgttttttttttgtaaaaatataataatgatctatttgcccaatgaaaatgtttactttttgatcataccctggaaaagtgatcaaaatgttaacttcattcttcccggcgttcctatctgttcttcgggcaattaattaattttgataaaaaaaatattaatttatcaaaaaaaaaaaatttcagtgatgtacgaaaaaatttttactaaaatttttttaaaattttttttccattttcaggagctaaccttaatcactcatcaagccgaggtgaccctgatcggaattcagtgcaatggcaattagatgtagaccattattcaagaaatgctgcccaagaaacttttgagccaccaagtaaaa

SEQ ID NO: 66930 - DNA, 263 bp, Heterodera glycines
  Genomic contig location: Contig_ID=SeqID_37967; Location=618..880; Strand=-
  SCN-specific regions: Sequence locations=1-206,228-263
gtgatcaatttttgactgatccaaacgaagttgaaattgtgcgggaaatgatcgaaaaaagtgccgaaaaaggaaaagacaaaaaaacatcggaaagagtagaaaaaattgatttggagaaatttgtcggacgaatttaccaaacaattgaaaaatttgtcgataatagcaacaaaatgtgggcgaaaatcaaaggacaaattgcagctgcacaaatgggcgaattaacggagaaacgaaaagcattggaaacggagggatat

SEQ ID NO: 66931 - DNA, 2812 bp, Heterodera glycines
  Genomic contig location: Contig_ID=SeqID_8083; Location=534..3345; Strand=-
  SCN-specific regions: Sequence locations=1-101,123-608,630-859,881 -1187,1209-1293,1315-1406,1429-1537,1559-1767,1789-2081,2104 -2286,2308-2387,2409-2460,2484-2618,2640-2812
gaattggcacgttatctccacctgcgagatgaacagcaaaatcgtccaactaaagttgagattacaaaagggttaaaagcactgatcaaaagaggagatcaaagtgatgaagaagaacaattttttgatttggggtcagatggagcccaacgccccgcttcacaaagtcgcagacgccttcgacgccatcgccattacaatgatgatgaggaaatgccattaatgccgccttctccaccgcttcaagttgaaaatagggggcaaaaacggaaagcaaatgaattttattcctcatgggaggagggcgcaaagagacaattgcgccacgaagatgcaccggttccttcttcatctaaaattgctaatagacaaagaagaagaaaactgcctccagtttcatggagaagagaagaagaacaaattcccgctgacattcagcaggaagaaccatttcagccagccccacaaccgtctattcctatacatccacaacttaacagaaaacggaaggcacagcatgctttgaatgatgttcgagaatcaaaaaagagtcttattggcttggaagagctaagacctccttcgcttcaacaagaggcatccctacgtttcaaacagaaaaggacaagcaaatcccgagtaaccctaccacagcattcgaattcattggccttggcaaaactgcgtaatcctccgagggacttactggccgaggcagcctctgccccattaccggacgatgatggccatgattttgaactcttacaaagccccggggtcgctgctcaggtcgagcctctcccacctgggcctccgttgcctagtaaagccaaaaagcggaaaagcaataaagttgatgaagataccgaaagaaaaagaagcagaattgactctcgaaagagggacttactggaagaggcagcctctgcccctttgccggacgactttgaactctcacaacaacccgggacctcggctcaagtcgagcctctcccacctggacccccgttgcttagcagaaccaaaaagcggaaaaccaacaaagctgaagaagaatataccgaaagaaaaagaagcagaattggttctcgaaagagattatcttcaccaagtgttaccaaaaatctgccaaaaaggcaaaagaactcgggtagcgatgcactctccgaagagcagcgtcgtcagtttgcagaggatcaacatcttttcagcattccaaattcgcaacttaccaatgagcaaaagagaagacggcttcagttcgtatttaatagaaaccccgccaagtacggtgttcagggtgacaccattttgaacagcgcaggaaacccaataaccgacagcagtgtcgcccaagcattagactatattatcgaacgcagagagggacgaattcctcaattcagacagccaccaggaacaaaattcattcgagatcgaatcaaccgagaccttattttgcgaacatggacggctccaccagtaccaccaagaggacccaaacggaaattgatacaaacagaccaagcgccagaattaaagcaaaaatcacaaaaactcagaggaatgagacaggcgagattcagggagcaagaaggattgatgcttcctttcccaacgaggggagtcaagcggaagtcgacggtcctgccaacagtagaaacggaaaccccaaccaaaagccaacgtctcaggccacaaaaatggaaaaatcaatagaaaatgtgttagaaggtctctacaatgacccaaaatcccctgctgcgttcgccggtgttgacagactgtggctggaagccaaaaaagaattaggaaataaaattcgtaaaaatgatgtaaaacattacttggagggacatcgcacctacactttgatgcgcccaaggcgcgtaaattttctgcgcgctcgaacgactgcagccggttttatgaccgactgtcaggttgatttggctgattttcaagcactttcccgacacaacagcggcaatcgttatttaatggtggtaatcgatgtcctttctaaacggattttcgtaacacctcttcgtaccaagaaatccgatgatatggtagaaggctttaaacgagtgttttcaactatgccaatgaaaccacacagaattttctccgacaagggtacagaattcagaaatcagcagctgaaaaaactttttgatgaagaggaagttgagaaatatgagagcacatattctgagaagaaagcagcattagccgagcgcgcaatacgacaaatcaaaaatcgtgtatatcgctactttgcccaaacaaaaaccctcaattgggtggacgtaattgatcaaattgttgatggcattaataaatcaccgagccgagtgcatgggatgcgaccgattgatgtgaactttaaaaattcacaacaaatatgggaaaagatgttcggagaagatcagcatagggccctttttggaaagcacagaaaaagggccaaatttttgccaggacaaacggtgagaatgagcatagcaaaaggacaattcgagaaaggatatataccaaactatggcgatgaaattcttgaaattgatgaagtcaaacgccacaagaaaccaatgcaatacaagttacgcgatgcaaaaggagagaagttcaaaggatttttctatccggaagaattggctcccgtacgtagagatgctgaaacaacttacagaattgaacgcgtttttcggaaacggaaaatgcccgacggaacaatggaagtgctcgtgaaatttgtaggatacctgagagagaatggattcatgagactcaacttgtataaatactt

SEQ ID NO: 66932 - DNA, 1806 bp, Heterodera glycines
  Genomic contig location: Contig_ID=SeqID_8084; Location=155..1960; Strand=-
  SCN-specific regions: Sequence locations=1-430,454-1211,1233 -1294,1316-1806
atgagtatcaacctccacgacaaaaagtcgctcatggacaacattttgccggtggttgagataaatcaaaccaacaacggcattacggttagcagtgaacgaattgcgataccacgaacggttcaattcgatattcttggcaaatgtcgagaatgtaaggcaaccgaatgtgagacggaatggtgcgtttccaaggaaggcgttaccatttggtgcacacgcttcaaaattagcccccgttttgtgccatttgatgtgatctacgatttgcctggttacacatttttcaaggtttgtttctgtgtgtgtgtttttttttgcatcaaaaattatttactcaacagattcgaaacaaaggacgggttttcaacgttgaccacggtttccgttccaatgcgtgcacccagaccccgactcccgtgtaccatttgcctccacctcctccaccgcctcagctcccgaaaagaaagcaggaaagtcaccaagacgcggaacaacgtgttgccaatcaattcttcgactctgtgtcggcagcaacgacgggattagacattgcgcggcaccaaacgcgacaaggcgatggcaaagaattttttggtgcagtttcagcggcgaccatgggaatggacattgaacaaaaaaacgagaagcctaaactgagaaaacaacagaggacagacgcctcagatttcttttcacccatttcggccgcaactatggggatgacccccgaacatctaaaacccaagcctaagtcgagacaacagccagttgatgcctccaatttcttttcttccatctcggcagcaaccatggggatggatgtaggacaggacaaaccaccaaagccaagccaaaaagaacaattaaattccgatgccgcagaattcgcagtttctctttctgcggctacgaaggggtttgattttgctgaagcgacagttaaaaagccaaaagaaccgaaccaggcggatgcttccgagctattttctgctgtttccgccgcaacgatggggatgagtagcgaacaacaacaaactagaaccaaaaaggaaaaggagcagacggaccaagaaattctcgatgaatttctcgagagcgtgtctgctgcaacgactaacatggatgttcccgagaaaagaaagccaaagaagaaagtaaagaaggagatggaagatgaggaaatgacagcaattgcgtcgatcacccgtaaataataaagtatttaaaagcatgtgtttgttcgatttagtctaaacattcatcatgattggaaaccaattttacacagataaagaattaaaactaaaaatgcccttcggtatgcttatttctggtccatcggggagtggaaaaagcagccttctcgtcaagtttattgctgagtcctcagaacttattggccctaagcccgcttccattctttacgcattcggtgaaatgtccagcattgtgcctaccctccaaaaatgtggtattagtgtgtattcgggagtccctccggaagagttaattaaacgcttacctaaaccactgcttctaatccttgacgaccttttgctatcgattgatgaggcctatctgagtgctttattcaccaaaaaatcgcaccatcagaactttgccgttgtttttgtcacacaaaatttgtttgaaagacggattaaagttgcaagacaaaacgctcaatatttggtactaatgcgggcccccaactcagcacttgctgttcggaatattggagttcaactctttcccgggaaactggattattttctctcggcataccgtattgcgaccaataaa

SEQ ID NO: 66933 - DNA, 384 bp, Heterodera glycines
  Genomic contig location: Contig_ID=SeqID_8084; Location=2212..2595; Strand=+
  SCN-specific regions: Sequence locations=1-84,106-221,243-337,360-384
atggctcgccaatcgacaattttaccaatctacaaacgacaatcgcgaagacagcagcaacattaccatttcgaaaatgtaaaacaatttttaaaattcaaaaaacagtttatttatttcaggttttggtatttgaaggagcacgccatcgacagttccaacttagctggttctgcatcgcactgatcgtcatactttttgttgcctggttcctttggtaagtgaataatttttaatttacaaaatttctatagttaaattttaagaaagggccgacggagacaatccaaatggtgcatgaaatggatgatgagattgatcaaaaatgatcccaatttggttttttctatttaataatattttaatccatttctctcagggcaa

SEQ ID NO: 66934 - DNA, 635 bp, Heterodera glycines
  Genomic contig location: Contig_ID=SeqID_37973; Location=225..859; Strand=+
  SCN-specific regions: Sequence locations=1-83,443-635
  Gene Ontology: Mol. function=DNA binding; Cellular component=nucleus; Biological process=regulation of transcription, DNA-dependent
atgcggaagagaaagtggaagaggatcagaaagtggaagagaaacataaagtggaagagaaagtggaagaggaacagaaagtggaagagaagaagaggaacagaaagcggaagagaaagtggaagaggaacagaaagtggaagagaaagtgtaagaggaacagaaagtggaagagaaagtggaagaggaacagaaagcggaagaggaacagaaagtggaagagaaagtggaagaggaacagaaaaagaaagcggaagaggaacagaaagtggaagagaaagtggaagaggaacagaaagtggaagagaaagtggaagaggaacagaaagtggaagaggaacagaaagtggaagaggaacagaaaaagaaagcggaaaaggaacagaaagcggaagagaaagtggaagaggaatagaaagtggaagaggaagtggaagaggaacagaaagtggaacgcaattttcatgtataacttctttagaaattgtctaatcataaagcaatagcttagacaaagcttttaaacatgttaagatttcaactaataccaacaatgtaacattgttggctttggattaccacgaattaacagtataaaaattgacaaaaaaatgtttctgatccaatttaacaga

SEQ ID NO: 66935 - DNA, 890 bp, Heterodera glycines
  Genomic contig location: Contig_ID=SeqID_37974; Location=87..976; Strand=-
  SCN-specific regions: Sequence locations=1-157,180-625,675-890
atgattttggacaaatttttcggtcaaattgatcagtcaattgtgccaattttgtcagaggattttccaaatgaacaaaaggtgatggtagagaaggcaatgcaaagtctgaacaaaattaaaatgggccaaattacgtccgaagatgaagtgattgaagtgaaaagtcaatttgatgaattgttgtccaaaaaagccgacaatttggattggcaaaatgtgccaatttatgacatagtgcaaatttcaaattggcagttagcaatacgcagttttggcgcattgtctgaactgttcaaaaatggcaccggggggcacaatgccaaaagtgaagcaaacagaaaaaaggaggagaaaaaagcgaaacaccaacaaagaaatgggaagaaaaacgaaaataatgggcaaggagaagaacacgggagaagcatttttgagcaatggttgaatgacaatgcgcaactcgtcaaaagcgtgtacgatcgattgtttccggaagacggtagaaaagggcttactgtaatcacagaaaaataaaggcggggagggaacgcacagccggtgaattttgacacttgtacggggaaacggggacaaaatttctaattttcattcttaagtttactaaaaataaaaatagtaattttactttttatataattatgtatttttatccatccgaacaccgtatactacgtatttacagtgcttaaacaactgcaaaaaaagcgacggcgacgtcgcaagattgattgtgaagcatggctgcagtgcatcagcttaattctgctgttcattatcatcatttgggtgatcattgccttttttctactcgcgggcagcaaatcaggcggcggtcgtagcagataccgtagcagaagctccagcag

SEQ ID NO: 66936 - DNA, 911 bp, Heterodera glycines
  Genomic contig location: Contig_ID=SeqID_37976; Location=61..971; Strand=-
  SCN-specific regions: Sequence locations=1-35,58-376,447-625,677 -761,815-827,851-911
gtggatcttggcccagaagcagagtttgctgtttatgttcaattaaatattttatggaccagcattgaacttggaaggaaactgaaaacagtttcgcgtgtagtcaaactgaaaatttttaagccagattatggcaaaatttatcaattaaatttgggccaagccggatattccaagattagcttctcagggcagttgagtttcgatcaaccaattcgggagaatgaagccattgtggcatttgttgatgtgccattgatgagcgagagtgccaatgaaacatcgcaaaaaatcgacaaattttcttcatggttctcattgggctctgaaactttcataaaaaatggttcaaaattgaataaaaaccgtaatggggtataattttattgttaataaaaaaattaatttattttaaataaaaatttacattttaattcataaaaataggttttctatttttccttagtgatttatgacaaaaaaagtgaaaatatgtaaattgaaaattttctgaaattttcatctttttgaaatattctatttttatttttggtgatcgtatttttagtttttgaaaataatttattctaattaagaaagacgcttacaaattaaagctaccaagttaaatagaatattaatttaataataaatcacatttttaatttgatatttaggacgttaatttatcttacaatatcccggttgatttgagcaaattttatggaaagcaaatgtttggtttaaccgttaacatttacaaattaaaagtaaaaaatctttttcttaaaaacaataataaaaataaattttagacttacattgaaaatgaaaaaacaaaacttggaaactgtccaatttgtttaaattctttttgttccaaagaaaagatttcaaaattccaattaaca

SEQ ID NO: 66937 - DNA, 661 bp, Heterodera glycines
  Genomic contig location: Contig_ID=SeqID_37977; Location=149..809; Strand=+
  SCN-specific regions: Sequence locations=1-661
aaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcgccataaatctgggcgcatcggttcggggggactgccccgaaaac

SEQ ID NO: 66938 - DNA, 647 bp, Heterodera glycines
  Genomic contig location: Contig_ID=SeqID_37978; Location=1901..2547; Strand=-
  SCN-specific regions: Sequence locations=1-488,527-647
aaacaaaaaaatcgattttttcaagtgtccgtttggggtactcaaacaattatggggagcaaaaatccaacgcagaattaaagtacaggctatagggaagctattgccgaaagattcggtctccccataaatctgggcgcatcggttcgggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcataggttcggggggactgccccgaaaacaaaaaatcgattttttcaagtgtccgtttggggtactcaaacaattatggggagcaaaaatccaacgcagaattaaagtacaggctatagggaagctattcccgaaaaattcggtctccccataaatctgggcgcatcggttcagggggactgccccgaaaacccaaacaaaaattttttggataaaaattatttaaatgaactgactagataatatttaaaataggttatttctcttcctttcagtatccctgcaaagtttggtgcgcttctgctcagtttctgaaaaaaaagttaagcctaaactttttggcat

SEQ ID NO: 66939 - DNA, 364 bp, Heterodera glycines
  Genomic contig location: Contig_ID=SeqID_37979; Location=231..594; Strand=+
  SCN-specific regions: Sequence locations=1-364
  Gene Ontology: Mol. function=GTP binding; Cellular component =nucleolus; Biological process=rRNA processing
tctcccgggtgtcggtgatttccgtgtccgtcgcattaccattctgtccgacccgtgccctttgccagccaatcggacggcgaaacggactttgaacgaacgtgaacagattgtttacgcaccgatgtccggactcgggggactcgtctacgacaaagacgccgtttacattgacattggcggaagcaaatccttctccagagcggtgggaagcaaattacgaatttttgcattttgatccaatggaattcagcggaacagagacgaattcatcgaagcactcgaaggaatcaaagagccgttggattcgaaaatgggaaaagcgactcttaagcttctgaaggaaaatcccgacttggaattg

SEQ ID NO: 66940 - DNA, 1121 bp, Heterodera glycines
  misc_feature (429)..(429): n is a, c, g, or t
  Genomic contig location: Contig_ID=SeqID_37980; Location=145..1265; Strand=-
  SCN-specific regions: Sequence locations=1-809,832-1121
atggcaggacattttaaaaattcgaccaaacgaattgaggagctgaaaggattttgtgaggaattggaggtgcggaactaagaaatgaaaaattctaagctgttaatttaggttgaatttgaacgcttgaatcgtcatgggccaacaaggtggacatcgatgcacagcgtgttgggcaaaattattcggatggaatctgtcttaatcgcctacttttcaaaacctgacaaatgtccggcacttctttacgacttttttttcgtttttttctgaacaatcgtttgtggtcattcattttttataccacgtgctaggcctctttaacaagacaattgactttttcaggttgttatagtaattatgaatgaaaattctgttcataaattcagaaaagaaaagccattttgcccgaactcttgctggaaatgnacaaatttagagcgaaattgaacaacgaaaacatgaacggttttatggtgccgatttgaaaaagttgatgagagcacacgcgaagcgttggaggaacaatttcaagtaaaaattaatcggttgcttattaaatttccaaattttccagtctttacacctcagttttggcatatttggacaaatggcatcgcattgaccgatttccggaaaagttgcaatgggttgctttggcatcccgcaaaattccccacgacgatgcgttgtctctggcacgacaaattgcgcccgagttaacaaatgatttgtttgacgatgttagcgaagcaaaccaaataactgaattcttttccaaatgatgaatttcaaaaattaacccccgaacagaagtggaagaagctgtttgaagcaaatttgccgcatctgctcaagctggtcagcattgttctttccgttcctgtctcgaatgcatttgttgagagggtattctctttgtgcggatcacaatggactgacacgcggaatttgttgaaagttgaaacagtcaaggcgttgatccaaaccaaagccaattttgatctttcttgctcacaaatgtaccaaatgctcatttccaatcacaaattgttggagaaaatcggcggatgggaaaaatacttttgataatctatttcaattgtttttgcgctaataaa

SEQ ID NO: 66941 - DNA, 926 bp, Heterodera glycines
  Genomic contig location: Contig_ID=SeqID_8085; Location=248..1173; Strand=-
  SCN-specific regions: Sequence locations=1-72,97-265,287-758,780-926
agttacattttggaccaaatgttgcacaacaagcgcaaaagttacaccaattttgacactttgttggccgacgaagaggaggaggagcaggaacagaaacgccagcaacacctcaacaccaagcaggacaaggagcagaaccagtcggtgcgcagttacgtgccggaggacccggaaacgggtgcaaccactacgatttgtggtggcacatgtggcgatgatgttggcattatcgatgccaataatgtgcaacaacaacaccaagcagtaccagcaggagttggcaaccaacagccgcaaattgttgccgtgccgtccacctcgtcgttgaacagctcgtccaccgagttcaagtttggtgcaaccactagttcagcagcaacgcgtgaggacgatgagctcagcgagttggaggacaccgggacggcgctcgttgagggcgaagtgttgtgagtgtttttttcctaaatttttgcgaaattctatttgttatgcctaacatgagttttggatttttggtatttggagcgggcaactcgctgggaaaaaacgattttttaaaggaaattgcactcaacaattagaaatttttcaaaaaaaaaatccttttggatgcggctgcaggattaaatcccaaaagttattggttgatcggattcggaccggatttgagggattagtcccacattttcaaaaaaaggagactgcgaattgtgttcccgcaatttctttttaccattttgatctcgttattaaggctggaagggcatgaaaaaattgcgctgggcctgcaagtgtgcgtggacgacgtggagacggtgcagcgcatgttccaagtgtttgttggccacgccacgggccatccgatggtgcgctatttgctgttgaccaacaagttcctgtacctgctcgctgttgatggaaag

SEQ ID NO: 66942 - DNA, 1943 bp, Heterodera glycines
  Genomic contig location: Contig_ID=SeqID_8086; Location=63..2005; Strand=-
  SCN-specific regions: Sequence locations=1-372,395-400,422-551,577 -863,907-1079,1101-1163,1186-1453,1476-1551,1573-1580,1602-1792,1814 -1943
atgtttcatcacttcgctcccattggccttccacaaaatgctgccgcatttaaacccacaaagggccaacatgagcaaattgagcggagcattaacggggcggtggacgaaattctcaacaccaacggcggcggcggcggaacgttgggcacacaaacggcggcggccgacaaaaagtgtcgattaactaattaatgggttaattagtgcaccactaattgctgtccttcccgcagagtgcacacgaaaccgtcgatcacgtacaatttggcacatccggacactgtcattctgctcaagagtcttgacgcgttcttcgcccatgggtttttttttgttttgtttattacaatttaaatttcgtcagtgttaccaaattttggatactttttgattgtgctcattcatacaccctcaaaatttacaataaaaaaggcacacaaaaatgtgtgtgtgtgcagagttaaagtgcatttcttggcgacataaacgctacaatttgaaaacgaaaaaattttgagttattttattggtccgttaattaaaagttgacattttcattattataatattggagaccggaatgacttttggtaatagtcgatcaaaagttgagaattgcatccgaattgactgattgtgagtgcggcgggaggtgactgactttctgtgaaattctcgactgtatgccttttctaattatggtttcattacatgccatttaaaagttcaaaaaaaaattaataaatttgcacccgattttggtcatgtacaaatgctctaggcgcaaatatatctatgcactcctaaaaatcaccgaaaatttatttgtttcggtattttaaaattggattttcaacttgaaaaaaaattaaaatgtattcattttttaatttttcattttttgcagattgctgaagacagacaaatgctactgggcttttgcgcgcgagttcatcccaagcgcggagcgtgccgaaatgcgcgtccgttgggtgtgccgaaaccgccgcgcgctgtcattggcatggctcaaagactcgttgaacaggttgacccccggcttttatctgcttgtgcaaataaattcattgaaatttttgggtaaaaagaaggtcaaattgggagcatttcattctcccacgtcgttcccccacccctccaataaaaaaaaaaattttttttggtgaatgaccgaaaacttttttcgaaaaaatcggatggaattgccgaaaaatcgaacattataatccattacatgctttttagggccaatttgcacttccaactgttgtcattcatcgcttgtgctgacgcgctgaagcgggcccattacgagcgcaacgcgtgcatgcgcaacacggcactgctcaagcgcatttgtgtacgcgttgaccagctcaccgaactccagttcaacatcgaggcgagcaaaacgaatttttgggccatttttattggtgtttttgaggcacatagtaaatttttagcttttgccaatgctaggaaaaaacaaaattttttcgatgatgggttggttggatttttttcttatttttcactgaaaatttcttttgaaaaacgctgaaagcatgtcccagcaaaccgaataagttcttatttttttaccatggaaaataaccccgttttttagcccccatatgttttccatccggaggacacgccaatcgcattgccaagaacaatgacagcaacaacagcagtgctaatgagcacggcacagttctttgacggcacaatgtctccaattggtgggtcaagcagttgcaactcgtcactgatcaatggcaccgctggtggacaacaacagcaccagcggaagcaacaagttcgagttgtacaacagcaaacgccaaatgtgccgatgaacatccggcgacgcatgacaccggcacaaaatgcggcactaccaaagtcatttg

SEQ ID NO: 66943 - DNA, 778 bp, Heterodera glycines
  Genomic contig location: Contig_ID=SeqID_37985; Location=198..975; Strand=-
  SCN-specific regions: Sequence locations=1-152,176-318,340-778
cggggtaagcagtgctggttcgtttcatcacggcaccgaaccctttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaa

SEQ ID NO: 66944 - DNA, 438 bp, Heterodera glycines
  Genomic contig location: Contig_ID=SeqID_37987; Location=442..879; Strand=-
  SCN-specific regions: Sequence locations=1-438
aaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagaaaaaatggtctaagtaaaaatcgtaattacgctaaaaaagcttctcaaacaattttagcgcttccaattccttctacaattgcctttatacatcccattatgagcgctaaaattatcagagtgccgaaaatcgc

SEQ ID NO: 66945 - DNA, 65 bp, Heterodera glycines; identical to SEQ ID NO: 54797
  Genomic contig location: Contig_ID=SeqID_37990; Location=821..885; Strand=+
  SCN-specific regions: Sequence locations=1-65

SEQ ID NO: 66946 - DNA, 287 bp, Heterodera glycines
  Genomic contig location: Contig_ID=SeqID_8088; Location=80..366; Strand=+
  SCN-specific regions: Sequence locations=1-53,75-249,283-287
gaaattattgaaaggaattgactcggtgctgcacgctaaggctgatcaacatgtacagaaaaatgaaaaagttttgtcatttgtggagcaggcacggaatgccatgttggacagggccaaactgatgaccaaccaagttggcaagcaggtcaaggacggactgatgctggcatttggccgtgttgtgttcacattcgtctgatgagttgccgccaaattttgatgacgagacagatggccaaggacggcaaaaaaaatttttttaatagaattaaatattttgtaaa

SEQ ID NO: 66947 - DNA, 325 bp, Heterodera glycines
  Genomic contig location: Contig_ID=SeqID_8090; Location=47..371; Strand=-
  SCN-specific regions: Sequence locations=1-325
atggaatgctcaacaacgacggagcaacggccgggcaccagcgaacacattgacaacgacgaccactgctcatcgccgcccgttaaaccggtgggtgagtctgtttgacattaattcgctttatttaatcagcctaactaaatttgaacgtttagtaaatgaataatcatgactaatttcctttcagttgacttatgcgcaagcagcggccaatagaccgagaagaatactgcgagcaatttggatacaaaatccttcccttattcaaccgtcaatgattgaatttccctataaatttctgattttttccatcactgattgctga

SEQ ID NO: 66948 - DNA, 468 bp, Heterodera glycines
  Genomic contig location: Contig_ID=SeqID_8090; Location=1443..1910; Strand=-
  SCN-specific regions: Sequence locations=1-468
cttgtcctaatggcggaagacaggcgacaagttgagaaacttgaagcaacgactaaaattcgtgaaatgttcgacctcattctaaaatgcaacgttgacgaacagctgatcaacaaatccattccaaggaacgtttttggttttctcgttgattgtttgtccgaggacaatgcgtcacatccccaactcgtggccaatgccacggcggcactcgcaaacattgcgccacaaaaagcaacggacatttacgatacaaaacatagtaaggtcttgatttatttggagaattggataaagagttcgacggacgaagaactgctgaaaaatgcaatatccattctgaagcctatcatagcgaaggatattgttcgggaaatggactatagaaaattttcaaccttattcaattcgagaaataaggaaatttttgaagaggccttgtgtgccgcttaccacttgatcagttaa

SEQ ID NO: 66949 - DNA, 193 bp, Heterodera glycines
  Genomic contig location: Contig_ID=SeqID_37992; Location=357..549; Strand=-
  SCN-specific regions: Sequence locations=1-41,63-193
atgccatgcacaaattgtatggcggaatatacacgacgcagaaaagaagtgggagaacttgattatggatcaaaatgggaaaaaatgccatccaaatcagatcggttgtgccgtatgtcgtttcggcttttgcgagcgatgcgttggccaaaagtgcgctgtgccatcggtgtccccgagcaaaccggtgccg

SEQ ID NO: 66950 - DNA, 76 bp, Heterodera glycines; identical to SEQ ID NO: 64756
  Genomic contig location: Contig_ID=SeqID_37994; Location=280..355; Strand=+
  SCN-specific regions: Sequence locations=1-76

SEQ ID NO: 66951 - DNA, 536 bp, Heterodera glycines
  Genomic contig location: Contig_ID=SeqID_37994; Location=688..1223; Strand=+
  SCN-specific regions: Sequence locations=1-56,83-165,187-209,235 -390,417-536
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaata

SEQ ID NO: 66952 - DNA, 194 bp, Heterodera glycines
  Genomic contig location: Contig_ID=SeqID_37996; Location=549..742; Strand=+
  SCN-specific regions: Sequence locations=1-46,69-194
atggaagccctaatgatgacacttagtctaatataccatgaaaggattggaagaaacacagaaggtggcagggctgtgcaaattttttctgcttatttttcgaatttggctcagccctggagaaagtttaagaacatcacgattggtttgaggatttacatgaaaggacaaaaactaatgcacagaatctgctg

SEQ ID NO: 66953 - DNA, 384 bp, Heterodera glycines
  Genomic contig location: Contig_ID=SeqID_37998; Location=73..456; Strand=-
  SCN-specific regions: Sequence locations=1-384
atggggttccccggctacttcctgatcgtgatggagtttatccagtggtcgaaggacaacaacgtgccggtggggccggggcgcggctccggtgccggttcgctggtggcctatgcgttgaaaatcaccgacctcgatccgttggaattcgacctgctgttcgaacgcttcctgaacccggaacgtgtctcgatgcccgacttcgacgtcgacttctgcatggagaagcgcgaccaggtaattgagcacgtggcggagatgtacggccgcgaagcggtatcgcagatcatcaccttcggtaccatggcggcgaaagcggttatccgcgacgtgggccgcgtgctggggcatccgtacggcttcgttgatcgcatctccaagctg

SEQ ID NO: 66954 - DNA, 49 bp, Heterodera glycines; identical to SEQ ID NO: 51181
  Genomic contig location: Contig_ID=SeqID_38000; Location=568..616; Strand=-
  SCN-specific regions: Sequence locations=1-49

SEQ ID NO: 66955 - DNA, 660 bp, Heterodera glycines
  Genomic contig location: Contig_ID=SeqID_38000; Location=216..875; Strand=+
  SCN-specific regions: Sequence locations=1-432,454-660
gttttcggggcagtccccccgaaccgatgcgcccagatttatggggagaccgaatccttccggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaatggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgtt

SEQ ID NO: 66956 - DNA, 3120 bp, Heterodera glycines
  Genomic contig location: Contig_ID=SeqID_8092; Location=207..3326; Strand=-
  SCN-specific regions: Sequence locations=1-61,83-219,241-288,312 -626,649-1019,1041-1090,1113-3120
atggcagcggtaataaaggctggaaaaggccccggaccgtttttgccagagatgtgctgggcgacatggtgggaacgtttcgaatttttcatccagcttaaaggcgtgaccgatgtcgcaacaaagcgtctgctcctgttcacagaaatgggtcaggtgtacgaagagcttcggcgaatggcacagcctgaggatgtccgaaccatggaccttgccgaaattgaacaactgatggtggaacgatttggcgaagcaaaatcgattgccgcgtgcaggcatgaattgttttcagccaagcagcagacagggcaatcgataagggactattcggtgcgattgcgaagtttgatagcaaaggcagaatggagccgcgacagcattgacatgtgtctttgcgcattgtttatcaatggcatctctaatgatgcaatccgggttgaattgatcaaaaagggcgacaaggacctaaaattcaaggacgcagtcgaatcagccgttttgttggagcagtccaatttggatgcccaagcaattggctcaaatgcaatgccggaggtcgcgaaagttggcaatcagcaaagaggaccaagaacgccgacgaaaagcactagaagttgctttcggtgtggaaaaccgggacattttgcaaatgtgtgcccgaatcagaattcgacatgcagaaaatgcggagaaattgggcattgggccgttggttgcaaaagcaaaaacagagacggtaatgccaactttggtcaacaatttggtcaaaagccaaagaccaacggacgacaaatcaagaacattgaatgttcaagtgtcagcgtcattcatgaaattaagggaatttctgccgatcctggtttcattcaactcaacattcataatggaaggttggagtttgagctggacagcggtgcggacgtcacagtgattgacgagattgattggaaacgcatcggcaggccaaaattggaaccatctcaaggattggtagcctatggcggaaaatccatcggtggcattttgggaaaggcaaaggtgaaagtgacgcacgaaggcagaacaattgagtccaatattcatgtcataagtggtaagcacaaaaatttgtgcggccgcgatttgatcatgggactgaaaattgatttgaaccgagccttcggaatttcgacaattcgtgccgtggagatcaaacaggaattggacgcatgtttgggtcaatatccggaagtgttccaggacggtgtcggacgatgcaaaaagatggcgtcactgaagtttaaagagggatgccaaccgaagcgatgcaagccgagaccggtgccattttcacttcgcaatgaagttgaaaaagttttggaccaatggcaggcggagaaaatcatcgagccagtggcaaccagtgaatgggccactccgctagtcattgtgccaaagacaaatggcaagctgcggctgtgctttgactacaaagtcacggtaaatccttggttggatgtacatcaataccctcttccacgccccgaggagctgttcagcatcttgaatggaggcgaaaaattcacgaaaatcgatttgaaggacgcatatttacaacttttgcttgacgaaaaggccaaaagttgtctcacaatttgcacgcacaaaggacttttccacttcgctcgattgccattcggagttgcttcggcacccgcaatttttcagcaagtaatggaagaagttctgcagggcattgatggcgtggcggtttatctggatgatattctgatcacaacagccactgatcagcatcacatcaaaagaatcgatcagcttcttaaacggttgtctgagaatggccttcgagtaaagcgtgaaaaatgtgagttcctcaaaccggaaatcgaatatttgggacacattgtggacaaaaaaggtttacatgcgtcacctggcaaaattgaggcaattttgaaaatgccggagccgaaaaatctgaaagaattgcagtcatttctgggaatggtgaactactatggaaaatttgtgccatccctggcaacgctttcagaaccgctcaatgaattgaggcgaaatgatgccaaatggacatggacaaagagccaacaaaaggcattcgatgtgatcaaaaaggttttgacatcaaccgaagttttggtccattatgacccgcaaaaaccactttttctggccgcggacgcatccgactatggagttggggcggtcatttttcataaagatgaaaaaggaagagttggtgtgattgcgtatgcctcccgaacgctaaattcatcggagcgcaattactcgcagattgaaaaagaagcgagggcgatcattttcggtgtcgacaaattcaagcagtacttgtacggtcgaaagttcgtacttcaaaccgaccacgagccactaaaaaagatttttgggccaaaaggagagctcccgattgtggcggcaaaacgacttcatcgatggtcactgacattgatgaacttcgattttgaagtggtgtactgttcgacaaaagaatttggcaatgcagacggtctgtcgcgattgccgtgtccggaagagacaaccatcgactgtgttggactggaagttcagcaagttcaggccgaaaatatttcatgcctgccggtcacagtcagtgccatcgcaaaagaagtcaaaaaggatgaaattcttcgaaaagtgaaagaattcatcgaaaaaggatggccacaaaaagtcgaaggactaaaaagttttcatgtcatccgaaatgagctcgccttaatggaagggtgcatcatgtttggaaatcggacaattattccgtcaaaatttcgcacaaaaatgttggaaattttgcacgcgacccacccggggatggtccgaatgaaggccctggcacgtcagaagatgtggtggccaggaatcgacaaagaaatcgaaataatccgaaaaagatgcaaaatttgccaagaagaggcgccggatgagcggaaagtgccattgcatccgtgggaatcaccggaaagaccgtggcaacgaatacacatcgatttctgcggaccattttggggatcaatgtggctgatcatcatggatgccaaaagcaaatggcctgaagtg

SEQ ID NO: 66957 - DNA, 212 bp, Heterodera glycines
  Genomic contig location: Contig_ID=SeqID_38004; Location=315..526; Strand=-
  SCN-specific regions: Sequence locations=1-212
atggcaaaggcaatttcagaaagcaatcgaagtgctgcaagaaaatcagcaaatggtcactctgagcacgcaaaacgcgaaaaaggcggcgaacgaattgaaatccatggcggacattctgtcgagtgcaacggaacagaaaactttggcagacgaattgctcgacaaagccgaaagcctttccgtgtgaccgaagccaaatccgccgacaa

SEQ ID NO: 66958 - DNA, 136 bp, Heterodera glycines
  Genomic contig location: Contig_ID=SeqID_38008; Location=341..476; Strand=-
  SCN-specific regions: Sequence locations=1-136
atgaatgaggacgatgattattgtacaaagtgcaaaattcctacggtcgatgaaattattaatggaaaagaatcaaaacttaaggaccgggtcgaagatggactccaaaaaattaccagtaaagccaagaaaatag

SEQ ID NO: 66959 - DNA, 1141 bp, Heterodera glycines
  Genomic contig location: Contig_ID=SeqID_38018; Location=22..1162; Strand=-
  SCN-specific regions: Sequence locations=1-543,567-569,591-669,693 -714,873-928,950-1051,1079-1141
  Gene Ontology: Biological process=N-linked glycosylation
atgcaaatggaacttcttatgcttttttgcctcctcaaaatgttttttctctgtccgacatttttggcatttgacaacgaaataaaagcgtatgaaaagggcgaaatgaacgaattacaacgatggtcgacggaggaagaagaagaaatgtggcaaagtggggaagagaagggcgaaatgccaaaaacgaaaagccgatcagtggcaccgattcagtccctttgggaggacggaccgatcagtccgattgaccagcggacgatcaatgaattgccaagggacgacggccgcgggacaatggtcgacgtggacattgtgaaggggcggaagggtctttggatgagaccgaacgttgtgaatttggtggacgaaatcagagacgacggcgaagggatggcgtcccctttggcaatgctttcgcccgccctttcgctggtgccgaagcgacggcgacgaattggcacaacggacggaaggcaaacgaagaaaaatgtgatcagaaaagaagaaagtgagtggaaacgaacacactgatcactgtgataagtgatccaaatttctgaactgaccatttcaaaatgcttttatttcagaaatggccaaacaatcagagccaaaggaaatgccaaaaaatgatggcattggcctaaatgtgcaatcggattttgtggaaaaaagtgggggcgaagaagcaaagatgacgaacacagaaacagaaggagaaggagagaggacgacggagaaaaaggaaaagaagaaagaggaggaaaaggaaaaagaggaaaaagaaaaagagaaaaacgaaacaggaggaaagagtaaagaggaaagggaaagagaaaaggagggaaagaagaaggaaaaagaggagggaaaagattggacgatgaagcagagcaatagcaaaagccaaagccaaaacagcactcaaacagaaacagtgaaaagagacttttgggccaatgcgctgagaacgctgctgatcgaattcagaaagatgcacccggaactgatcaggggaggaaaagctaagagaaggacgacggaacagagcagcaacagaacaaaaagcaaaacaaacgaagaaatggcgagaaaaaggcccgggggtagaggggagccgagccccatcagtgattga

SEQ ID NO: 66960 - DNA, 504 bp, Heterodera glycines
  Genomic contig location: Contig_ID=SeqID_38019; Location=399..902; Strand=-
  SCN-specific regions: Sequence locations=1-144,174-483
aaaaatttaaaaatgagaattcatgcgagattttctgaagcttaatagggcctagttaagctgtaaaaaaaatttgggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaagcaattaaaaaattttttaaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaatttaaaa

SEQ ID NO: 66961 - DNA, 837 bp, Heterodera glycines
  Genomic contig location: Contig_ID=SeqID_38021; Location=189..1025; Strand=+
  SCN-specific regions: Sequence locations=1-323,353-408,430-837
atggacacaacgacgataaatcggattctagcgggaaacacaaagaccagagaactctacttgggatgcttcccttgcgacaaactcccaaacataatcaacaagtacccttcaactttggtggcgaataatgacccatcgaataaggaaggaacgcattggatagcaatgttcatcgttgacgataggaccgtctactatttgatagttttggtaggaaaccgaacagatgtatcagccagtttttacggaattatgaaaaagtgatttcgaataagccagctattcagtcagtctttagtgagaattgcggttattattgcatttattttatttattgtatgtgctcattaggaggaagaaattatgagagtaattttgaaaaagtgacaaaaaagttgataggagaagataatccagatttgtttgtcgtgaattttgttaaaaaaatgataaaaagtatttaaggaatttatcattaactcatttataaaaatggaccgattagacacaataattgcttctcttctgaactgtcccgcacgtaacttgtgcgactgcttaaatcacccggatgagatacaaaaagtagaaaaatacctcaaagggaaaactctacagacaacatacaaaaatcaactagatgaatagaaagattttgagtacggtggaattacaagagaaagtgcccgtaagcaaatggcttacaatggattcaagaatgtgaccgtcgaccagaacttttatgtacgtcaccgcatttgtcgtcgctacgccaataatccttgcgtaattgagaagcacaaaaacggacacgaacgattctaccccacttga

SEQ ID NO: 66962 - DNA, 799 bp, Heterodera glycines
  Genomic contig location: Contig_ID=SeqID_1052; Location=1433..2231; Strand=+
  SCN-specific regions: Sequence locations=1-385,426-748,770-799
atgccaaaaatcaagccgtaccgcattattgcatatgattttgaggcaacacaagacaaaaaaatggagaacaaatttgagcacgtggtcaactttgctgcggcaaccgttatttgtaccgattgcatcaacaacggctactggaacaactctcttcttgggaaaaagtgcaacatttgtggaccccaccggaccatcaccttttcgccattcgactacacgaaaacaacagttgatcaaaaaatcatcacccaaaatcctttgcacaaatttgtccaatggttgtttttcgaacgtaacaaaaagtatccgacggtagcatttgcacactttggtggtcgatacgatatgacaatgatcatcaaggaggtcatagagcaaagtgaaattaattttgtaagatttattttatatatattaataaaggtattcacaatccggagatcatcaaacaaggaaaccgactttacgaactgaagataaatgcaaatgatcatcgcccactcacaattcttcacgatagctacaaccttatgcctatcaaattatctggcctcatcaaatcctttggactccaaattgaggacaaacaattttttccacatatgttcaacaaggccacaaactatgacaacgtcctcactcatctgccctctcgcgtagactactgcccaaaccaaatgaaaaaggcagaccttcaaaaatttaacgattggtacagcaacaacttgaaaattttgcaattacgatttataatttaaaaaatcctaaacagctaaatattaaaagaaaatttaaa

SEQ ID NO: 66963 - DNA, 195 bp, Heterodera glycines
  Genomic contig location: Contig_ID=SeqID_1052; Location=4364..4558; Strand=+
  SCN-specific regions: Sequence locations=1-31,53-117,193-195
atgttgtatttggatgtcaaagaaaaaagctatcgtggaaaaagagctggcgccgaaacgcgagcgccgaaacgcgagcgccgaaacgcgtgggtccgtttgtacatttagtctttctaaaatattttatgaattttaaaaaaatactattttttcagaaaattttttatgttttaaaagtttttaaaataacaa

SEQ ID NO: 66964 - DNA, 321 bp, Heterodera glycines
  Genomic contig location: Contig_ID=SeqID_1054; Location=924..1244; Strand=+
  SCN-specific regions: Sequence locations=1-60,83-174,214-257,279-321
atgaagcggactctaatttttgtggaaaagtttgtagcacaaaaaaggatcaacgaaagcaaggggccagccatcacatggtccataagtaaaaaaaaaccaaaaaagggtgagaacaagaaaaggccgtaagttataacataactaacgaaaacatgtaatcagaatttttgctttaaaaaacaaacttaatttttagaattacagagaaaaatagacaaaacacaattggattatacttattgaaagctgcctataaaattcatttattataatcattaactcaccaagattttttcgacttttagaccatgaaaaata

SEQ ID NO: 66965 - DNA, 115 bp, Heterodera glycines
  Genomic contig location: Contig_ID=SeqID_1054; Location=1755..1869; Strand=+
  SCN-specific regions: Sequence locations=1-115
accgattagaacccgataagaggacaacgaaaagcaaaacgatgactgtttttgaaggctatgaaatgcgtactgatagaataatagcagcaggccaaacccaggctatttttca

SEQ ID NO: 66966 - DNA, 167 bp, Heterodera glycines
  Genomic contig location: Contig_ID=SeqID_1056; Location=3860..4026; Strand=-
  SCN-specific regions: Sequence locations=1-35,57-68,122-143
atgtatttttcgttttttgaaatcccgaattatggggtgattttacaaaatttttcgccgattttcgcaaaaaaaattaagttaaaaaataaatgaaaaaaatcaaaaagttaaatttttagtcagatttgaagaaagaaatgattaaataaatattttttaataaa

SEQ ID NO: 66967 - DNA, 1030 bp, Heterodera glycines
  Genomic contig location: Contig_ID=SeqID_8097; Location=389..1418; Strand=+
  SCN-specific regions: Sequence locations=1-152,174-204,226-542,601 -738,760-761,798-1030
atggccaccctttcctcgtccaccgtaatgctcctctttttgctgctgtttgtcttggccctcatttacgtggcgtttttcttcacccggtggcaacttcgatgccaacatcatccttctgaatgaaattggaaaaatgagaataagtgggcaaaacttaaaaccaaaatttagtaaaaagtgcgatttattttactgctttactttaaaaatctgattttatttccatttttttttgcaattttgttaatttatccgctcgcttttccttttttcggcatttttgtcctcttttacattttctctgattgcatttcacattttgagatggcattgccatttgaccaccattcaaatccaattgtgccaaaaaaacccctagggacacacagcgctaaaaggggcgaaaatgtcaatgatttgccttttaaggaggcgagggcgggcaaatggccatggaacaaaaggaaaatgccgaaaatttaagggggagaaaagttccgttttttgttccatttgtcaatcaaaacatttttgggaagtaaaaaatttaacaaaatattacataaatcattgaaaattaattcaaatttaattaaagggtatccttttattattaatgatttttggcttaattttgtcgcattttttcgtccttttcaccgtaaaaatccttttaattagcaatgaacatcatttggcttgtgtaaacgggctcaacgagtttaatattggcatgttttttgtgttttattaattggataataaataaataaaataattttcataattattttgcttaggcattttgcacttgcgaggaacgcatcaatggcaaaatatgaggtgcagtaaaagccgaatgctaatacattcttgctgcattcaatcttaaaattaaactcccaaggcatgccattgaccaatggaatgggcggcactcgcccgtttttggcttttaccttagcctcattagcccaaccgatgcgtcggccaggtttttggttttaattttcgtattttataacca

SEQ ID NO: 66968 - DNA, 1057 bp, Heterodera glycines
  misc_feature (10)..(10): n is a, c, g, or t
  Genomic contig location: Contig_ID=SeqID_8098; Location=33..1089; Strand=+
  SCN-specific regions: Sequence locations=1-62,84-87,109-847,891 -895,918-1057
atgccttcgnccgtcgaacgctacggaccttttctgaagcacattcgagaacgccttagacacacaaatattgtgaaataataagccaaaataaattcaaaaattagcacaaattgtttagcttctgtacaccgatgaccttggcattgtccattctctgcttgtccacgcctccaaaatgaacatgtcgcaaacgcgatactcatatttggtgtccaatatggtgaattaataatcaaataaaatttctaattttgcaatttaaggatttgcatttgttggaggattttctcggccccgaattccattgcaatatcaccgggtttcagttggtccgtcaacagccgcaaataaaagtgaaaagtggactcatttaaaatgaatgtcatttctcccccgttaatttccctttagcgactaattcaattaaagtcactatttgaaaataatttattagaatttcctactttttcggagtgccattaatatttgttcaaatgtgaagtgacttggccggtcacggaatttctgttgcaattgcaaatttataaacaattccatttgtgttcatattttgattcttctaatttatccgaaatctttcgccctttggtcaatcggagacagaaaaaaaaagaattttagggagtttatctttcttaatcactcttttgttcagactgatttggccctggcaatggatgccacggcattggtcggtgccgctgtccacgcgttacgccagcgcaatttggagcccaaaccgcaccaattgttgtgcgatgcgggcgaccaatggacagacggaatgttaatgcaggagcaaattcggagagtaagccatggcatttattttgaattttaattaataaattgtttattatttatttcatgtaaaattccattttcatgtttaatttttcaggtcgatttgactgatgcggccaccggcggacattcggcgacgtcggcaattcgtttcaacgaaaccaccggcgaacgaatggacacttcccttttggcaatcacgcgaatgcccaacggcaccttcacagac

SEQ ID NO: 66969 - DNA, 837 bp, Heterodera glycines
  Genomic contig location: Contig_ID=SeqID_8099; Location=526..1362; Strand=+
  SCN-specific regions: Sequence locations=1-51,73-334,357-436,458 -547,613-837
  Gene Ontology: Mol. function=kainate selective glutamate receptor activity; Cellular component=integral to plasma membrane; Biological process=synaptic transmission
ttgaacagtctatggttcgccgttggctcacttatgcaacaaggaagtgacgtaataccaaggtgaaaaggcgaattagcaaagaaaaaggcatttatgactttttagagcggctgctacacgtaccgtagccgtcatatggtaacataccgtaaaaaacattaaaataaatcttcgtttttcaggtggttattcacgttaattctgatcagttcgtacaccgctcaattggccgcatttctcacagtcgaacggatgagcacagcggtggaaagcagcgccgatttggccgcgcaacaacgcataaaattcggtgatttccgttttcattaaaattttaaagcatattaaaaaggtgaagataaaagttggtggactaaataattgctaagaagtatcctcaaaaattctgtaattactttttttaatttttctctccacaggaactttgtccaatggcagcacaatggaatttttccgtgagtcgcgcattcccatttatgaaagaatgtggtcaattatgcagtccaccacgcccaccggtggttttttattttgaatttatttttattattttttaattttaattttcgtttactttttccattttcagtgtttgttaattcaagcagagaaggcattgcgcgagtgaaaggcggcaattatgcttatatgatggagagcacaatgttggaatattggtgagaaaaagggaaaaaacgaattgaaacaaaaattaattaattagttattcaccagtttaaaatcctattttttaaatttaggattggcgaagactgtcagctccaaaccattggcggactgctcgattcgaag

SEQ ID NO: 66970 - DNA, 678 bp, Heterodera glycines
  Genomic contig location: Contig_ID=SeqID_38027; Location=1..678; Strand=+
  SCN-specific regions: Sequence locations=1-389,411-553,575-678
gggggactgccccgaaaacaaaaaaatcgatttttcaagtgagtgtccgtttggggtactcaaacaattatggggagcaaaaatccaacgcagaattaaagtacagactatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaac

SEQ ID NO: 66971 - DNA, 1456 bp, Heterodera glycines
  Genomic contig location: Contig_ID=SeqID_8100; Location=231..1686; Strand=+
  SCN-specific regions: Sequence locations=1-140,164-488,510-537,559 -569,612-629,651-770,820-846,868-1456
ggcgaacaatgccaaaatcaaacgatttatggagaaaaacaatttgcacaacataacggaattggaaaattattacatccaacggttgcaagtgattgtcaaggaactttttgaagaacgacaggaaatggcggaaggacagaaaaaagcgaaacaaaagaaaatgattttttggcaggaagtgttcgacaataacaaaccggtaaatgccgaagatcgacgggcggtccgtccatctgatgggaatgccccgcggagtttccgtccgtttcgtaaatttcgctatttaagcgccttttcgagaaatagtttttctcgaattttgctatataagtcaatggctcgatgttctatatattattcagaattaaaaaagagagaaatgaattttttgctttttttgttacagctttttgaaacctatcgaaattttttgaattttttgtttcgaccagcggcatttttataaagagaaaatgttaaatcttgagttaacagtggatttaaaaaagcagtgtcaaagaaaaataatctaattaaatatgattatcagttagccataatccctcttaaattaattatatatattattttattgaatttatatttttgttggcattcttaggacccttcaaacacagttgtgcacaattggtattcaagaacaacgcaggagagatttttggacacaaaacgtgcggttgagaagggtttccaagtgttggtctcctcgtgctggtcagtttttatttttccggagaaatgaattgtatatttgttatttaaataatttttatagtaaaataaataaatttaattggtaaaaaattatgctcctaaattaggtaccttaattacatcaattatggccccgattggcgtgatggcactggcacaacccgacaaatttactattgcgaccctcgcggtttcgagggcacttatgagcagaagcaattagtgattggcggcattgcaacgatgtggggcgaataccttgacgggaccaatttggagccaaatttatggtagataaatatttgtaatacttattttgaatgtccatactcatattgtaaattattttgattttttgattgtttttttgcctttcttttgtccgtgtgtccgttgtttttgttggctctttgtccgtgggccctttgtccgtgtgggtcctttgtcattgtacgcttattttgccgatggattggccggggctgattcggccaacccttccttggtcacaattaaattgtttaaatttaccaggccaagggcttctgcggtcgctgaacgcctttggagtccgcccgagttgacccgtttggccgacgcggcttggccacgtctgcaggaacaccggtgccgaatggtggccaggggctaccgcgcggagccggtcaatgggccggacttttgccagacggaattggacgagcaaatgcttaaataa

SEQ ID NO: 66972 - DNA, 240 bp, Heterodera glycines
  Genomic contig location: Contig_ID=SeqID_8100; Location=5268..5507; Strand=+
  SCN-specific regions: Sequence locations=1-104,126-200,222-240
atgctggcagaaattgccagcgttgaattgccgggtcagttttttggtaccaaaatccgaatttcaggtgccaaaaatgccaaactcggttctggcttcaagaatttggccaaaactttttattttatggaatccataatttttgtgacttgtagaaaacaagtcttttatgtcaacggattaccccagacagttgttggatcagaaattttcattaaaaacccgaaaatgataacataa

SEQ ID NO: 66973 - DNA, 181 bp, Heterodera glycines; identical to SEQ ID NO: 52969
  Genomic contig location: Contig_ID=SeqID_38032; Location=334..514; Strand=-
  SCN-specific regions: Sequence locations=1-3,27-181

SEQ ID NO: 66974 - DNA, 65 bp, Heterodera glycines; identical to SEQ ID NO: 56492
  Genomic contig location: Contig_ID=SeqID_38034; Location=413..477; Strand=+
  SCN-specific regions: Sequence locations=1-65

SEQ ID NO: 66975 - DNA, 59 bp, Heterodera glycines; identical to SEQ ID NO: 52422
  Genomic contig location: Contig_ID=SeqID_38034; Location=201..259; Strand=+
  SCN-specific regions: Sequence locations=1-59

SEQ ID NO: 66976 - DNA, 59 bp, Heterodera glycines; identical to SEQ ID NO: 52422
  Genomic contig location: Contig_ID=SeqID_38034; Location=591..649; Strand=+
  SCN-specific regions: Sequence locations=1-59

SEQ ID NO: 66977 - DNA, 59 bp, Heterodera glycines; identical to SEQ ID NO: 52421
  Genomic contig location: Contig_ID=SeqID_38034; Location=721..779; Strand=+
  SCN-specific regions: Sequence locations=1-59

SEQ ID NO: 66978 - DNA, 59 bp, Heterodera glycines; identical to SEQ ID NO: 52421
  Genomic contig location: Contig_ID=SeqID_38034; Location=851..909; Strand=+
  SCN-specific regions: Sequence locations=1-59

SEQ ID NO: 66979 - DNA, 681 bp, Heterodera glycines
  Genomic contig location: Contig_ID=SeqID_38036; Location=215..895; Strand=+
  SCN-specific regions: Sequence locations=1-239,261-681
atgcacataaatatttttgttccatttttatttctatttgttatttttaatggttgtcaggcaaaagaactgaaaatttgtgtcaaatatgagaaaacagtggcaatgcgcgaaacgcaaattaatttaactgcaattagagtgaacagcaaaaatgaataccgaaatattaaagaaaatataaaaattggtgaatgttttggcatttccatccctcagcaggaaaataataaaacgcaaaaaatcacttttgaatttacaatttatgtcaaaccattggaaaatgagtaccaaccgccggcggatgaccacgacgaaaacccatccgatgaggggccgtatgaaaaccgaattttagacatcaaaatggacgacattcggacaatggtccgacgcaacaactttgtgatccatgagcctaatccgtcaatggtgtacacgttcaatttgggcacaatcgatccgccagggtttttgtggaaacgcaaaatttttgttttgccggagaacgatttgggcaattaccatgcttttttgtatgccgttgcctacaaaaatcaacggactcaggacaatttgaatagtaaaagttgcatgaaactgttgagatatgcgccatttgtgaaaattgacaaagaaattgcgcccaccttgaaacggatgacaaaagggtggaaataa

SEQ ID NO: 66980 - DNA, 270 bp, Heterodera glycines
  Genomic contig location: Contig_ID=SeqID_38037; Location=695..964; Strand=+
  SCN-specific regions: Sequence locations=1-270
atgtgtgagaatttgcgctttgcacaaacattcagcttgctgggcggcattccgctgctcacctcactgttcggttgctttccggtcgagccgttcaccgcgtccgaatcggaaatggcggcgctcggcgacgcgtcaaatgccgataaagatgacgccggcgacaacaacaatttaaacaatttatgcgcgtctcatcagcgaaaggcatcgaccgaacgcggcacacaaacagacgccgggcatctggcaattttgcacgatcaatta

SEQ ID NO: 66981 - DNA, 607 bp, Heterodera glycines
  Genomic contig location: Contig_ID=SeqID_38038; Location=1..607; Strand=-
  SCN-specific regions: Sequence locations=1-58,80-104,133-374,396 -420,449-607
ctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagatttttattcat

SEQ ID NO: 66982 - DNA, 652 bp, Heterodera glycines
  misc_feature (535)..(535): n is a, c, g, or t
  misc_feature (555)..(555): n is a, c, g, or t
  misc_feature (563)..(563): n is a, c, g, or t
  misc_feature (589)..(589): n is a, c, g, or t
  Genomic contig location: Contig_ID=SeqID_38038; Location=706..1357; Strand=+
  SCN-specific regions: Sequence locations=1-652
gttttcgggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgatttttttgttttcggggcagtccccccgaaccgatgcgcccagatttatgnggagaccgaatccttccggnatagcttncctatagcctgtactttaattctgcngtggatttttgctccccataattgtttgagtaccccaacggacacttgaaaaatcgatttttt

SEQ ID NO: 66983 - DNA, 678 bp, Heterodera glycines
  Genomic contig location: Contig_ID=SeqID_38043; Location=165..842; Strand=-
  SCN-specific regions: Sequence locations=1-28,51-106,129-430,457-678
atggaacgtcaaatatcccggtgagtacaaaatatttatttttaatgattatcagatgcgcccaatcaccaaatccgatatcaccgattaccaattccccattcttctctaccacaacaacaaccactttgacggcatcaaaactctttcaaaatttttcaacaaacgttactattgcatctcctgtgaatctgcctacagccacaaatttgaacactcttcaaaatgctcttcactatgtcacgggtgccgtgaggtgggcgtcgactatccctgcgaagcccaacaaggctacttcaaaaaatgtttgcactgcaacaactatttctataacaacgactgctatggtaaataaaagatccagtttgaaaatgggcattaaaatcaaaataaaagcagaatgcaggtatttctatttttcgacttaatgttttcagtaaaaattaaataatatcaaatcgatgaaaagaaatgcacaaattttgtgtccattaacgaattctatgcctttttgaattaattccgtccgttcatttttcttcgcgtgtttcgattgattttatgtaatttaatggaaagaacgtaaagaagatgatgaaaattgtgcaagcgaaaaattggaaaaagagagaaatggtgaattaaagaaaagggaaaatgaaaatggcaaagaataaa

SEQ ID NO: 66984 - DNA, 575 bp, Heterodera glycines
  Genomic contig location: Contig_ID=SeqID_38044; Location=114..688; Strand=-
  SCN-specific regions: Sequence locations=1-112,134-241,290-575
  Gene Ontology: Cellular component=extracellular space
ttatttacgcgaccaaagctcgccgtgcgttggcggcggaagcggccacggcgttggacgacggcacgaaggagcccatcgatgccaccgaaatcttcgaacacatccgcgacattaacgaccccgagcatccgtacacgttggaacagctgaacgtcgtccaagtggggaaggggcacagttagaaattccgtgttttttttttttgacttaattttaggatttttgggaaaatttttggaaaattagtaaattattataaaattcgaaaaaaatattaaaatttattcggggcgaacgacacgatattggagagggggaacgaactgctcccgttttttcggcttggtattaacacggccgtttagtccccgcattttttgaaatttatatccatttccattgaaaccaattgcccccccccccctttacttttcctctgttctccaggaggaactgatccaagtcagcgccgacccgaccgaccctttcgtcgacgtgcgctttactccgaccattccgcactgttccatggcggcactgattgggctggccatctacgcaaagttgagacg

SEQ ID NO: 66985 - DNA, 812 bp, Heterodera glycines
  Genomic contig location: Contig_ID=SeqID_38046; Location=116..927; Strand=-
  SCN-specific regions: Sequence locations=1-579,601-697,739-758,784-812
atgaccgacgtcaagctcatttgggatgtttttacccgcgaaatttggcctatttttgcgacaaacattcaccgtttgggctttgacgatggcgatcatttggacaatttgcgtcgtcgcacttcgccaacgattctcactgatcttgatgaattgcattcgatcaattccggtcatctgtgcccagaaggaattgctgacatggacccaatgcaactgctggccaagctttggccaaatggttacacactccgacaaaaaatggacaaccaaagcaattacgtttccgtgcttatgtgagtccaccaaatttcgaatgggtcaacagcttcaaagaggtcgtctcgccagaattttcgtcaaattgtttttattttaccaatttttgtgtttagacatttcgccatgccaccacttctgtcagttacaaaattcaactttatttttgggtggaaccgacgtcaattgaaccatttgaattggataacgaagtgacgaaagaaaagctgacactgaaacaggagatcgacgaattcgacttaaatgtgtataattggctgttgcaacggtgcccaattggggagacggcgacggcgccagttaagtgggaaaaccgcgaaaatccgagtgccaatttgaacaatgtcagatttgatctgtggagtttcgataaatccattgggtgagcagcaacagcatttaaattttatcgaaaaataaaatatttaattaattttaggccattggcgccaccagcggaagaaaaagaaggagaagaagaagcggatcaaagcaacaaaaatgtcgtctga

SEQ ID NO: 66986 - DNA, 186 bp, Heterodera glycines
  Genomic contig location: Contig_ID=SeqID_8103; Location=403..588; Strand=+
  SCN-specific regions: Sequence locations=1-39,66-119,147-186
  Gene Ontology: Mol. function=GTPase activity; Cellular component =rhabdomere; Biological process=rhabdomere development
atgcaggcgatcaaatgcgttgtcgttggcgatggcgcagtgggaaaaacttgtcttctcatcaggtaactaactaattgattatgtttcaaaagggaatgtcatgcaatttcttcctccagttacacaaccaatgcctttccgggtgaatacattccgacagtgttcgacaattattctgcaaat

SEQ ID NO: 66987 - DNA, 1056 bp, Heterodera glycines
  Genomic contig location: Contig_ID=SeqID_8104; Location=1..1056; Strand=+
  SCN-specific regions: Sequence locations=1-102,135-208,230-462,523 -542,566-770,792-1056
  Gene Ontology: Mol. function=GTPase activity; Cellular component =rhabdomere; Biological process=rhabdomere development
cgattttattattgtttttaggttatggtcgatggcaggcccataaatcttgggttggttgtactcaatacgatgtgataaactggttttttgtttagactttgggacactgctggacaggaggactacgaccggcttaggccgctcagttacccccagacggactgtttccttctgtgcttcaggtcggtttctccgatgtccattccttgacatttgttgcccatttgataaaataattactaatgtaagtaatatttatcatttcagcatcgttaacccggcctcttttgaaaatatccgtgccaaatggtacccagaagttagccatcactgcccccagacgcccatcattctcgttggttcgtatcactgagtcactcatttttttttattagaattaagcatttctaaaacttttatcggtacaccccaaaacacagccgcagaaacacagccgggaataaattcttaaaaaatttgtaaacaaatttttcaagaaaaaaatatttaaaaaattttcttagaaaaattcgaaggagaaaaaaattatataaaaaattttccagcgatttttttgaattttttttgaaaaccagtaattcaccattaaattttgaaaaaaaaattttcttagaattttctaacaataagacttttttgaaaaatttctaagtttgaaaattttttaatttatttccggctgtgttttgtcctgttccggacttttatacccctaatattttgtcattgccaaggtacgaagctcgacttgcgggaagactcaaaaacgttggacaaattgagagagcgccgtttggcgcccatttctgtggcgcagggccatcaaatggcaagggaaatcaaagcgaccaaatatttggagtgttccgcactcacacagatcggccttaagcagggtaataggtttcatacttcgaaaacccttttgtctttctaattcccttccccccccccccttaagttttcgacgaagcaatccgtgccgttttgtgcccagtccaagtcaagccaaagaagtcttgcgccattctc

SEQ ID NO: 66988 - DNA, 658 bp, Heterodera glycines
  Genomic contig location: Contig_ID=SeqID_8105; Location=605..1262; Strand=-
  SCN-specific regions: Sequence locations=256-625
atggaaagctgtcagtgcacttggaccaatttgtacgcttcttttattctctacgggtcgtactttttgctgttctgcaacttcttctaccaaacgtaccttcgacggggaaatcgctacgcaaacaaatcgaaggcgaaaggcggaaaggcagcggctgaaagtgtcgtccacgcgaatggcacggccaactgctcaattaacgacgaaagtgccaaaaccaacggaagtgttgtccaccaccaacagcagaagtgaggaagaaggacacacttgtccatccttttgggcaattttttgcttattttccttccttttttggtcgaaaatttctagttaaaatggttagcccatttggggactttttcgcccatccaacgaatttttttggtcattcgatttcacctgcatttttggttttacaacgaacatttttctatttctttcggcgttcctttgattctctcgtcctttttaattacgcccgttttaatttatttatggcgccacatttttttgcgccaaaaataaacttcccatggtccgttcacattcactaattgagcaactttatttggaggaaataatttagcttttcataaaaaaaagcaatttcattttaggtttttcagtccaaccgccgttgacgaaccgatga

SEQ ID NO: 66989 - DNA, 637 bp, Heterodera glycines
  Genomic contig location: Contig_ID=SeqID_38057; Location=60..696; Strand=-
  SCN-specific regions: Sequence locations=1-348,370-637
caagtgtccgtttggggtactcaaacaattatgtggagcaaaaatccaacgcagaattaaagtacaggctatagggaagctattccggaaggattcggtctccccataaatctgggcgcatcggttcggggggactgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccctaaaacaaaaaaatcgaattttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcggttttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaac

SEQ ID NO: 66990 - DNA, 498 bp, Heterodera glycines
  Genomic contig location: Contig_ID=SeqID_38060; Location=989..1486; Strand=+
  SCN-specific regions: Sequence locations=1-107,134-217,239-263,292-498
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaa

SEQ ID NO: 66991 - DNA, 315 bp, Heterodera glycines
  Genomic contig location: Contig_ID=SeqID_8107; Location=73..387; Strand=-
  SCN-specific regions: Sequence locations=1-315
atgtcacgagaaattttgcctatttttgtgacaaacattcgccatttggacattccggatggtggtcatttggatcatttgcgtcgtctcatttcaccgacaattctcttcgatctgatcaacctgaattcaatgtgctctgctgatctgttccccgatgtgatcgctgatgatgggccaaatgcaactgctggccaagcgttgtccaaatggttgcacaccccgagaaaagatgggcaaccgaagcgattgtgttgcaagttgcatcatgtgcctgtcaatgaagcaaaagaatgggtcaacaatttcaagaag

SEQ ID NO: 66992 - DNA, 683 bp, Heterodera glycines
  Genomic contig location: Contig_ID=SeqID_8108; Location=1351..2033; Strand=+
  SCN-specific regions: Sequence locations=1-51,73-168,190-491,513 -604,627-683
atggaacagaaatcgttgggtccaattgtgataccatttggagaacagcagaaggagaaaaatgaacaatcgaacattgaggaaaatgtgagccaaatttggcaattccatggcattaagcaatcgaatgtcttggttctacatttcagttggatttgtactgatgttttgatggacattttccctctttttgaccatgcccaactcggcctcaaattggcactgatttcgccccgtttcgaggttttatcgaaaatttgagtgaaaaggggggctcctgaccttttaaaacgccaaactcggacaaaatcgacacttcagtaccaaaaaatgacgtaagaaaaaaaattaaaagcaaaaaaaaacgcaaaaaagagatgcagagacgtaacaaataggcctaagcttaagcataagccgaagcctaagctgaagactaagccctgacctaagctgaagcctaagcctgggtgagcagcgaggcagctttttgtttgacttattaaattattcatcgaatattcaaattttaggccatttgtctccgcccacaggtcaaaacaacgaaaaagacatcaattcatgaacctatggccattgggaagtgcatttattatttaagaaatggctcgcgccaggatcagtcagctggggacaaatcagctgacagacaacttagctga

SEQ ID NO: 66993 - DNA, 1405 bp, Heterodera glycines
  misc_feature (29)..(29): n is a, c, g, or t
  Genomic contig location: Contig_ID=SeqID_38070; Location=64..1468; Strand=-
  SCN-specific regions: Sequence locations=1-382,407-418,498-522,785 -908,931-982,1004-1052,1081-1084,1106-1135,1267-1405
atgattagaagaggtgcaacagtgattgnaagaggtgcaacagtgattagaagagttacaacagtgatcagaagaggtacaaagtgattagaagaggtacaacaatgattagaagaggtacagcagtgattagaagaggtacaacaatgattagaagaggtacagcagtgattagaagaggtacaccagtgattagaagaggtacaagtgattagaagaggtacaccagtgattagaagaggtacaaaagcgattagaagaggttcaacagtgatcagaagaggtacaacagtgattagaagaggtacaaaagttagtaaaataggtacaacagtgattaaaatttgaacaaaagtgattagaagaggtacaatcatggattaaaatgaaataaataagaaaattgtattattggatgtattataaatttatcaaattaaaaaatccttttacttattaaaaataaagttagaaatttataatatagaatatttattgaaattgaaaggaactaatttctcgaattttataaaaatttaattcaaataaaaaaatgtaatttattattaataaaataaaaaatattttaaatgaataaaacaatgaaaacacgaaaaaaatggtagttattaattaaaaacaacgttggaaattattaattgaatatttatttaatttgaaattaaattattttttttacaaattcaaaaaaaataatgaaattctttaagttaaaaaaaataaatttaaataatttaaaagaaatcttcaaattaattaaaaacagtcaaaataacccaaaaatgcacagaaaaataatgttacaccgtccggattcgaactttgcccccccccaaaaatgatgcctcagaatccccaatcacacagggattctgaggtcttgactatgtcaaaagttaaatctgatcacgtattcgtgatcagcgtcataaaatagccctaatgacatgtttttggaagatttttgacgaaaaaattttttcactcaaaaatcctggtcacccccctttggtcccgaatctcaaaatcacttttatttttataaaaattcttaaaaaagtgataaaaatgccaaataaaatttatataatagagcaaaaaactgcggaaatgcatttatacataattaactaatattcataatatttaatataaaaaccaatttcacataatatttaatattctatgaattaaatataagaaaattaaaaatcaaatcattaaattagaatttataaataaaatgttgatttagctatattcaaatttacaaaaatcaaaacaaaacttcaaaataaaaaagtaaccgcattacatgaagcggcgcacgcgataataatcaaggaattaaattaaaaaaaactaggaaagtatatgtaataaa

SEQ ID NO: 66994 - DNA, 836 bp, Heterodera glycines
  Genomic contig location: Contig_ID=SeqID_8110; Location=532..1367; Strand=+
  SCN-specific regions: Sequence locations=1-324,432-474,497-614,687-836
atgagagttcagcctgttcgagaagtcatggttaaaggatcggaagcaaatgtgatcgatgtgtggattattgaaggaaagaataaagcacgtgtgtcggcttggaatattctggcattaaaattaattattaagctgttttaagggttgcttgatcaaattacaaaatgtcattttcaaagaggattcatacaaaggcgaatataatttcgtgtttaccaagtcgtcaaaaatttctattttggaaaaaacagaagaaaccgaaattgctaagactctaatgcacctttcaaaaaagcgtggtttagtttcatgtattttctgttataatatttaaaatattaaataaattaaaataaataatttaaataatataaattattaacttttatttttaaagtaatatattttaaaattcaattattaaaaaaggcgatgtccgagtgcaaattgcgagaaagcaaacggttctgaatcttgcaaatagacaagatgggacgttgtgtgtcgacaaagagcacaaggcgcaactgatttttccaaattcaattcagtttgatcaaaaggaagaaataacgctgcaaagcgtgaacattgattgtaacgacggtaacattaataaaaattttaattaatttattcttaaacaaaatattaagatattttaataatttcattaattttaagctggcgtgttgactctcactatctatgacaatggcgcatataaaacacatactgaaaaaccattcaaactcatttgaatgaagtggattatccaccaaccgaataattttttaagtatgataaacacaatgaatttttactatgtttta

SEQ ID NO: 66995 - DNA, 591 bp, Heterodera glycines
  misc_feature (537)..(537): n is a, c, g, or t
  Genomic contig location: Contig_ID=SeqID_8111; Location=1321..1911; Strand=+
  SCN-specific regions: Sequence locations=1-152,174-275,297-360,382-591
atggttcgacataaacagaatttttctgttggtaatgattttccaacttcttcaaaaaatgatcagcaaatgaatgaagggttcatagctcccgtaaaaaaagcggtcaattgaatgaaagggttgaaagctccctaaaaaagcagattgacaaaaatttcaatgattatgaaagtataaaaagacagaaaaaatcgcttaaacgaaagattgatgaaaatgatgagactatcgatttagacaaagttccaatgagtttttttgacgctggtggtaatgaaagcatccaacaaaacgaatatgtaatagaaactgagcaattttcgagccaattttcacacatgggaatgatatccaataaaaaagacactggaaaaaatagtcgaaatcaaatgacagaggaacaacgacaaattatcagggcaaaaaacgcaatcgccgcaaaaacgtatagaaaaaaagtaaaaaacgtagattttttgcttttgcaagcgtctgaacaaaacacttataatgttgaattgtatgaacttagtngatttaaagtaaagtgtaagcattgtccggttatacatttttcagaagaagaaa

SEQ ID NO: 66996 - DNA, 1207 bp, Heterodera glycines
  Genomic contig location: Contig_ID=SeqID_8112; Location=414..1620; Strand=-
  SCN-specific regions: Sequence locations=22-250,273-907,932-1056,1092- 1207
atgttccgttggggaattgaaccaaagaaaaaaataatgaaggtcagggcaatgaacgaggtaatgttacccgggtagacttacccgggtaagttattaactcagggcgcgtatctgtcctgatttatctgatttgtcctgatttgaagggtccaaatctgataaaattaaaatgtcctgatttgtcagatttgtcctgatttggagggagtgacccaactttgtcctgatttcttaaataaacttacaattttgaaattttatggcataatgtcactattttatcaataaaatataagatttatgacaaaatttggttatttttttaataaaaatctgttaacaaatcgattaaaaatcgcaaaaaattttccggcggcgcctatcggcaccgccggaccccctgtccatcctccaaaattttttgaaaaaatgcgacgcaaaaaaagcgtttttaaagcaaaaaagtcgtcgcttgacttttaatttaattgcaaaattggcattttttggtgaaaatctgttaacaaatcagaacgaaattacaaaaaattttccggcggcgcctatcggcatcgccggaccctccccccctcgcccatttcctaaaagttttttggaaaaatgcgccgcaaaaaaatagttaaaaatctttatttttttgattccgaatgcgctaaaattgatgatttgctaattttctacccaaaattgttaaaatcgataatgggagacgaaaaatataatatttgatacatttttgatcgaaaaattgtaaaaataactgatttgaagcaattttgcaaaatgtcctgattttcgaccccagaatctgattttttgggcttgatgttctgattttgaaaatttttcgatccgagccctgatattagcgcactcaatatgaacatttatttttacatattaagacttacaagaaaaaataaataaataacttaatccgataaaaacttcaaaaataaataaaactgaaagtatatgcaagaaccacgccaagttcacgcgcactaatggagcaatgatgcaagtataatctttaaaaatgtttattttttttaaaaacaaaataagtgtaaggcgtaaatagtttcagccaatagcgggaagggaccgccccaaacataccgagagaagtcatcttcaggaaaatgattaatattcttttcgccagttttacaaaaataaa

SEQ ID NO: 66997 - DNA, 383 bp, Heterodera glycines
  Genomic contig location: Contig_ID=SeqID_38072; Location=1128..1510; Strand=+
  SCN-specific regions: Sequence locations=1-78,100-383
aaaaattttattcatctcccttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccga

SEQ ID NO: 66998 - DNA, 1278 bp, Heterodera glycines
  misc_feature (6)..(6): n is a, c, g, or t
  misc_feature (87)..(87): n is a, c, g, or t
  Genomic contig location: Contig_ID=SeqID_38074; Location=44..1321; Strand=+
  SCN-specific regions: Sequence locations=1-108,137-158,188-297,328 -396,439-465,490-698,742-813,1057-1057,1092-1094,1116-1162,1184-1278
atgtanctaaaaattaaaatgttcgagaaaggtgagtttgctttttttgagcaatatgcaagataaatttataatcatttttcaatntatagcacaaatactttcttcaaataattaaaacaaattattaataattcgaaagtgaaacacgaaaagactaaaaataattacaaaataaataattaaacaaatactaatgctacggtactacctctaccgtaactctacacttcacatcaaatccgacaagaatgataaaaaaattatctggtaaaataaaaggcaaagaatacaaacaaaatataattaatattaacttatttatttcattgtagtcaattaatcaaaattaagtttgaaagaatcatgcaaatgttcagaaaaaggaattaaacgatattaaaaacaatatcattataacaaaaaaatatataataagtagggctggaaattttatgtaaatacatattttttcctctggcttctccatgctctaaatagcaggaaaaccactttcttttttgtgtttgcgaacaaaagttgggacttttattttcatatttttacatatttaggggtttttatacatatttgatacatattttggaattgtttcttatatattttcatttttttttacatattttgagatttttttacggaagtttttgggaattctcaaaaaaacacaaaatttcggcaaattttttgttaaattctccaaataataataatgttaaaattttcggaatgcctttgcgccacaactctgtcctaatattttctattatttacatgtctaataaacaaatcatatttttataattttatttaaatgaaaataaatttataaataaaattattaattttagtattaattctttttctaatttactttttttattttggtttaaatggcttaagtttgtattatttatactaaaaagttttcctaaaattaatatttaaattaaaatatttattaaattaatataattaacatatacgaaatattaaataatcaaaaaatttgagaaaattaattttttaaaattaggggccttaaaattttttaaaagggaattataaatgacaaaatataaaagaaatatgaaagacaaaatctttaaatgacctataaactgattatttatatattacatttcttttcatatttctgttgtctgtctcccccatcttatgtgaatatatattaaataatcctttactttgctgctatgcaaaattatttcacaaataatttaaatttaaatacaa

SEQ ID NO: 66999 - DNA, 410 bp, Heterodera glycines
  Genomic contig location: Contig_ID=SeqID_38076; Location=89..498; Strand=+
  SCN-specific regions: Sequence locations=1-410
cctttggtacaaaaaaatttcgcgggcttcatttttatgaaacatttgctggaggttgagcagaaagtgcagagaattcgcaattcgataacgataattcccaagcaattttatgaccgttgtgtttcttttgagtcgattttagaatcaagttcgaaattaaattcttcattgattgcttgtgccgacagattctcggtaattaaatcaatcacaaaaaatgatgacgaattccgaatttaagactcaaatgccgagcccaccttcggaaatgttttacgaaattatccgtcagacggggcccttttctatgatgccaccgtatttggccttggatttgttgtttgtgttcgaaattggcaaaacgtttcccttctttcagcggcttagcatcagcgataaggtaaaaa

SEQ ID NO: 67000 - DNA, 210 bp, Heterodera glycines
  Genomic contig location: Contig_ID=SeqID_38078; Location=183..392; Strand=-
  SCN-specific regions: Sequence locations=1-21,43-210
gtgaccgatgccgtcgccgcgaatctcaaaaatcccttctccgtcagaaaactcggcacccccacgccacaattgcacccgcggctttgcgctttgcccgccttcaattgccacccgcgccatttgcggcggcactcgcccagggcattggtttgcctggcgagccgaataacgcacgaacgggcggatctgctgcagagactgctcgcc

SEQ ID NO: 67001 - DNA, 1232 bp, Heterodera glycines
  Genomic contig location: Contig_ID=SeqID_8114; Location=579..1810; Strand=-
  SCN-specific regions: Sequence locations=1-171,220-500,522-953,986 -1014,1038-1075,1099-1195,1223-1232
atgtttgttttccttttttcaaaagccatttcacccagcaagtcgaatgcagaactcgcagaacaatttattgatattgaatcagaagacagatgccaactgatcaaggtgagccttgaaaaaaccgcgcaaaacggcaacatccaaattgagaaagaaaatctgaattggaaaatattttataaaaacattttaaatataattaaaaatttaatttttgcactgaatcatctcaagccggtcgggtcgggaagtattgaaaatggaaaaggaggatcgtgaggggggggggggaggaaccaatccggacatttggacaatggatgttccagcagcagacatttggacaatgaagtcatttggactgatatggacaatcggacatcggacattatgaatgttttttttaattttaggaattaatttttttttcaaatttcttgggacttttgataattcttccagtccaatgtccaattagtcaattcaaaagcacctctaataaataaacagcaattaaatttttatgtttcataaatttactataagccaatcattaggggtgtatttttcactttgaaaactcgattgttaggggtgtatttttcccgaaacttcgggtaaattatccgaagctcgaagttcgaagcccaaaaaccgcgaagttttcgaagctcgaagtttcgcccagccctgaccggcaccgccggaccctcattttaccttttttttgaaactctgaccccaaaacgacaaaaatagccctttattttcctcaaaaatattggctcaaaaacgtaaatttggtcattttttgggaaaaatctgctaacaaatcgcattaaaaatacaaattttttcccggcagcgcctattggcaccacctgttctgcccctgtgctcgaaaagttttttggaaaaagcacgccgcaaaaaaaaagcgtttacctatatggttttgtttctttaaaaaatcttttggatatttttccagcgattaaattccgttttttgttaataaatttaaataaaaaattcattcagaaaaattgtttacaattacgggtcacggaaaccacgggggttttggggtgccgtgatcacggttcacgggtcacggatttttttggaagccccgtgatcacggctcacggatttccgtgattggaaattcaatcacggccagccctggtgcgagagcgtagaaagagaaagagagaggatgaaataaa

SEQ ID NO: 67002 - DNA, 400 bp, Heterodera glycines
  Genomic contig location: Contig_ID=SeqID_38082; Location=237..636; Strand=-
  SCN-specific regions: Sequence locations=1-161,183-363,386-400
aaatgccaactgttcgcgaaattcttgagtgtttgcaaaagccaattaaacggcccataaatccaacaaatgaagacagcgtactgaatgctgagaggacggccgcagaacaacaaatggaaggtgtatcgaccagcaatgatttgaacgtcggtgagagcgatgatgaagaaaattgtgagcctgttcatttctaacgtggcaaaacaatccgaggagcgctttgtctttggcaccaaggttttaaaaatttttgatgtcgagtcaaaacggaatcagatgagcgattggtcaaggagaatccaaagcaacacccatctcaagccttggacgcaagtgttcgtcatcggctgttacgtgaaacaatcgatggtcgtcgcagcgcaagccttaatgcctg

SEQ ID NO: 67003 - DNA, 768 bp, Heterodera glycines
  Genomic contig location: Contig_ID=SeqID_38083; Location=7..774; Strand=-
  SCN-specific regions: Sequence locations=1-264,286-744
atggcaatcgaaagggtaagcgaattgaaaattcaaatgaaaataatgccataaataatactgaacctgttcagcccatctcagcgcaatcctctgaccaacagcaaatcgtattggacaacccaacggcaaatccattaaaagtgcgggaagcgatgggcactgacactgcggggaatgcaacggcagatgtggggagtgtcggaaacgggacggcggacgaagcgatgagcacgacatcgacctacaccgcaaggcaaaggcagaacttcaacaaaaaacaacggaaacaaaatgtgggttatatttaaaatttatagaattcgtgcacaaaaaaaagcaaattcttagggccaaatgttcgtggacgcgccggcagaaaaatttgggcctagggttcgcaagaaccctaagcagggaaaatacgaggtgcaggccattttggccacgacaacgtacaaaaaggatgggcaattacgacggatcttctatgttcagtggttaggtaaattaatttttaacaattttatacaattcttaataaaatgtattcaggctatagtcaaaaagactatagttgggtcttgagcgagtggatggacacgcaggagcttgtcacagagttcactgttaactctgtgatcagctgggtcttcaaggcaattcgtggcgaggaagtgccggaagaaattgccgaaaagctcaggacaaatcctgagtatatctcgcgtaagtttttatggggaaattgatgaaataattaataaa

SEQ ID NO: 67004 - DNA, 331 bp, Heterodera glycines
  Genomic contig location: Contig_ID=SeqID_38084; Location=955..1285; Strand=+
  SCN-specific regions: Sequence locations=1-83,114-114,136-141,283-331
atgctccacaaaagtgtgcttctgatcactttacttcttctgatcggtgctttcatgcaaataccaaccaccgatgcatggggtaattattttcattttaaataaatttaaatcgaaaaatcacacacaaaaaattcaggtggttggggcggtggcccgggatggggcggtggacgcggctggggaggcggacgaggctggggcggtggcccgggatggggcggtggacgcggttggggtggcggccctggatggggaggcggacgcggctggggatggggcaaaaaataaaagaaaaccaaaattaattccatcaaaataacctcatata

SEQ ID NO: 67005 - DNA, 362 bp, Heterodera glycines
  Genomic contig location: Contig_ID=SeqID_38085; Location=1..362; Strand=+
  SCN-specific regions: Sequence locations=1-272,294-362
  Gene Ontology: Mol. function=ubiquitin-protein ligase activity; Cellular component=proteasome complex (sensu Eukarya); Biological process=protein modification
gtgcttttcgtgtgaatgttgattttccaactgagtcccctttgaaaccgccatccgtgacattcgcaaccaaaatttactcatcctaacatcgacgataagggccaagtctgtctcggcatcattctcgcggagaattggaagccggcaacgcgtgcagagcaagtgatgaacgcgctgctgtcgctgattgccgagccggaaattgctcatccgttgcgctccgatcttgccgaggaattccaacgggacaagaagaagttcttcaaaaatgcaggtggagtgtcttgctattttaatttttcttacaattaattttagaagactacacgaaaaagtatgccgaacgtcgcgactgagtt

SEQ ID NO: 67006 - DNA, 226 bp, Heterodera glycines
  Genomic contig location: Contig_ID=SeqID_38086; Location=734..959; Strand=-
  SCN-specific regions: Sequence locations=1-226
aaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagcc

SEQ ID NO: 67007 - DNA, 1153 bp, Heterodera glycines
  Genomic contig location: Contig_ID=SeqID_38087; Location=53..1205; Strand=-
  SCN-specific regions: Sequence locations=1-298,322-505,543-1153
atggaaaacattgacactgttgtggtgccgatcatcgagactgaaatcagcgaattcgttctttgtgtaagccgtgccaatttcaattcaattggaaattcaaatttaattttattgttagcattatttcattgtttttttaatgttagcttaattagccgttggttaagctttttcagcctcagctgatgaaagttctgcaaaagttccccgaggcgagtggtgttcttgtccgcggccatggcttttttgcgttcggcagcaacacttggcaacgcaccaaaatgatgtgggaatgcctttttaaaattggatttttatttaaatttggaaacattggcattctgcacaggttggagtgttacgaatatttgtttgagttgggctgcgaattgattcgatatggcattccgctggtgaaggacgaggaggaggacaagaagtccatttccaaaagcaaagtcgaagcatagtgaagaaatgtggggaggacgaaacgccaaatgagagagagagagaaagagaatgagagagagagagagttacagtatgccaaacgaccatttattaccgtatacactaacgtaaagcactgagacaccgtagaatagatcagcagaaaggcagcaaacgcgttcaaataatgccctttgactttgggaatacagtcgatagtagcacaattacagtacctgcctttttttgttttatactgtttgtaattcatattttgtgaatccttttttctgttatttttttaatgtaataaattcttcacttttttatttacacttctttttgccgcaaataatttctaaacaaatagaattggtccgctaaaaaccgcctaaaactagttgcaatcaatctctaatgacctctaagcatcataataatagtccctaggcgcggaaaataaaaaacggttttttaatcggtttaaatcacgaaaaattgaaccaaaatcaaccagaaaaacattttaaataaaaattttcagcaattttggcatgattcgaaagctcttgacaagttaagtctaataattggggatgaagtcgaacctgctgcggatcacgcgcggatttcttccggagcccgtagtctcgccccacctattggccgccgtagtcgagagtgcgctggtttttag

SEQ ID NO: 67008 - DNA, 251 bp, Heterodera glycines
  Genomic contig location: Contig_ID=SeqID_38090; Location=201..451; Strand=+
  SCN-specific regions: Sequence locations=1-88,116-129,171-195,237-251
atgtgcaaaaagaaagtgacgaggagcaacactgaaaagaaaagaaagaaaactatgaaaggggaaaatgaaatgagaaaattcactgaaaaaattttaatttttatttattttagagtgccacgggaccgggaccgggccgggaattcccggtcatccgaggtcccggttcccggtcccggattttgaaacgctcaggtcccggtcccggtcccggtagggcaaccgggaaccgggaaaaacaatcactg

SEQ ID NO: 67009 - DNA, 4419 bp, Heterodera glycines
  Genomic contig location: Contig_ID=SeqID_8115; Location=455..4873; Strand=-
  SCN-specific regions: Sequence locations=1-463,694-694,725-727,748 -813,836-978,1001-1526,1549-1579,1602-1967,1989-2057,2079-2253,2276 -2619,2641-2775,2797-3380,3414-3520,3543-3706,3728-4080,4102-4419
atggaaaattataaattgatggattaccaatcgacaacttgcgaaaaatttggatttacgaaaaatattacggaatttcgtgtcaacccggatgtggagcgccccgatgaagcgatgaaggatgcgatcgacaacatgataaaggtggctttaaagactacggaagaaaaaatgaagcgaaaagtgcggatgtttggagttgcaattacgggtgccgggcttgctttcccggtgtgggtgccgtatcgggcgtacccccagaataatgcggatgttatcatggaggagattaataagctggagcagagcggggacggggatgaaaataagaaaatgcttttattatctgaaccgattactatgaaaattacatgcgttacaatgcccagtggagaggggccgaggaatgtccacaaatttgactttggattcaaggaacaccagcggatagggtaagtgttttaataaaataaaattaaaatagaaaaaaatcaataaataaatttaaaataattatttctaaaaaatttaatgaagcaaaaaaaaaaaattttttttaaagaaaaaaaaaatgaaaaaataataatttaatgaaacaaaaaaaaacagaataaaattaaaaataaagaaagtaaaaaataaatttaaaataattattttaaaaaattttaatgaaacaaaaaaaaaaaaaaacttaaaatatttattttaaataatttaattaggcaaaaaaaaaaaaaaaaaaaagtaaattttaggattgtgaatactgataaattttgccttttttacgcactggcgtcgtcgatgaattatttaattatggataaatattcgtttattcgttttatgaagaacttagcaagacaaaaggaagcggctgttgaacttttacggaattgtggaattgatggaaacgaaattagttatggtgtggagcaattgccgaatgttcagaaatattgggtgggttaaatgaaaaaatgcaaaattaataaatttttcaggatgagatttaccccggaaagtaccgggttgttgcgtttgagaagtctgcagatccgcggaaatcgatctgtgttttgtggaaggcccctatgggacgagagaaggtcgtaccgatatttttggagaatggtcactgggatggtctgaagaattacgtctgtttttttaatcgtgggagaaaattttgtattgattgtgagtgcttttttgacaaggatgtcaaacatactttcgagtgccgggcaaggtgttattattgcaatagagtggggggaatgccatgtgaaaaggagagtggagtgaagattgaatgcccaaagtgtcaccgttacttttacaattgggagtgttataattatcatcagggacatcagacttgcaaattatggaggcgttgcgtgatctgtgacaagacatatttatttaacccgaagaaggaacatgaatgtggtgagacttattgccagctttgtagtgtgagccatgaccccaagcgggggtgttatattatgccgatcgaggagaaggaggaaaaagatgtctacagaattgtagtttgggtaagttctacaaataaaatcaacaaaaataagtctttaactccaggattcggagacttcgcaggattctatttacaagggggaccagaaggagcatgttattaattatatttcggtgagagttacgtgtacggaatgctgtgatgacaaaaacaggacgaattgcaaaatttgtggggaggagaggatcaaggattggagcgaggcggagggacatgagccgaccaaggattttgtggagtggattttaactgcttttacgaattatgatatgtacatatttgcacataacgccggacgttttgacggtaatttcaaaatttaatttttaaatcctaaatttttaggtcattttgtttttaattacctctgccgtaccgggaagaacccgctaccgctcatcaatggattgaaaatttatgaatttaaagtgcaaaactcgaagaaacattcaaagctgatttggagagactcatgtttattgatgccggtgaagcttgagtcgctgaaagcgacatttaatttggactctgaggacaagccctttttcccctattattacaacaagaaagaaaattatggaatacgattggaacatctgccaccgatggaggactattcgccgggatctatgaacaaggataaatttataaaattcgaaaaatggtaagaaaagaaggacaaaattaacaataaataatttttcaggtacaacgaaaacaaggagacacctttttatttggatgatgaattgaaaaattattgccgaaacgacacggagattttattgctgtcaattattgagtttcgaaggatattgattaacgacattactaagggatttgacccactaccgaggagttgtacgaatgcgggggttgcgatgaatatttttaagggaatgtttttgttgacggagcagttatcgattgtgccggagaagggaaatgagcggtgtgatcgcgccagtgtgatggcaataaagtatttggagtggcggagccagcgggatggaattgagatacggcacgcggggaacggacgagaggtcaaagttggaaaatataaattggatggatttattgcgaataacggagctagggacaaatgcatcgaggttatgggatgttacatacatggatgtttgaattgttatgacccggcggcggaactgattggaggaaggacggcccaggaattgaacgatgagactcaggagagattagtggagctacggaagactttggatgtcgaagaagtttgggtatgtttatttgacatttgaatttataaattctactttttaggggtgtcaaattgagaaggaattgaaaaaggatgaggaaatgaggggcttcttcgacgacagaggaaatgagaaggggccgattgatccgaggatggcatatgcgggagggaggaccggaccgatgaaattgtttgcgaaatcggatgagaagaaaaagattagtgtttatgatattgtgagtctgtacccgtcagtgaattacggtacagcttacccgattggtttgcctgagattattataccgaagactgatgaaattaatgttaattggatgagaccggaggatttgaagtataagggattgtataaagtgagggtcaacccgccgaaggggttgcggattccggttcttcagttgaagtgcgatgagagattattgtttccgctatgttggagatgtgcgtcaaaatttaagaaggagactacgagatgtaactacaagtgcccacatgatgcggcacagcggcgatacgtggcaacatacaccagcgtcgaattggtaagaatttccaagaaaaaattttaaagaaaattttgacatttttcaggcaaaggcgttggaatgcggttatactgtggacagattttatagagcgtggcattacgaagaggaggtggacgatttattcaagggatatgtgagattatttttgaaactgaaggaggaggcgagcggttttccgaagggagttgagacggatgagcagaagaatatttggagagaagaatataaggaaaaatatggaatcgaaattgagttgactaaagtgaagaagaatccaggattgcggtacatcagcaaattgatgcttaatagtttatgggtaagaaaattaaaaaataaatatatggtcattaattttaacttttagggtaagttttcgatgagaaattgtttgaacaagaatgcggtaatagatagggcgtcggagtattataaaatggcgtgtgatcataaaattgagatgtgtgatattgttgaatattcggaggaagcgattagagtgatctacagggacaaggatgagtttgtgatggaacacaagtcaagtaacataatcatcagtttatggtgagttaaaacttataaatttgtatataaaccaattttaggacgacgagtatggcgaggttaaaattattggaattcatgagagaagcggagggaaacggaggagaaattttgtacacagacacggatagtatttttgttttgcactatagggacgtggagccgatcacgacgggtaaatatcttggagagatgaccgaggaatatggcggctatgagattgaggaatattgttgcggaggagcgaagcactacgcattgaagatgaaaaataagcagacgggggagactgaatacgttatgaagataagggggattacattcgacgtggacaataggaaaacattacattacgacacattcaggcagatggtactgaattatggaaaaggcgaggtggacccggcattcttcgtctataagaatgattttggatgagttttttaaacattatttgcttcattaataaa

SEQ ID NO: 67010 - DNA, 1056 bp, Heterodera glycines
  Genomic contig location: Contig_ID=SeqID_8115; Location=5732..6787; Strand=-
  SCN-specific regions: Sequence locations=1-155,178-746,770-1056
atgagcgtttgttggggaaaatttcgctcaaaccaaaatttatcgatgaaaaaagtggtaaagagttaacaattgtggaagcgatgcgacaaattgtgacggcacataaaataattttcggtggcaaaaccaaaaaaattattataaaatgcatcgaatattgtaacatcaaaaagcaattgccacaaatgcgctttgagaacaaagtgaattgttttgaggttggtaacgactatttatttgcaaaaaataagtaaaattactgtaaaaaccaatcgaaattgtttaggtgatcggttgggcatttgttctcgagaccactaatgagtgtcaaatgaaagaaagtgcattaatcgaattgaaatcggttaagcaatatttgttgttactctccgatggcaaatatccacagttacaaattacaaagccaccaaaaaagccaatgcgaaaaggaaatggtaaaagaagcgctagtcacagatactaatggacgggggaagtagtatatagcgtcaaaaggttgcgggttggttgcgggtgtttcccgcacgagcccgtgcctatgggaggggtgcagccctttgaagttgccgccccatcaaaaaatccacgatggggggtgtttcaaaaccaaaacctattggaccactttgaagttgccgcctgaccaaatccgatttcccaaattgttgcgggtgtttttttcccgcgccgcgcagcgccgcgggaaggtcatcaatcatccacctgtcaccaaagtgacaggtggaggaaattcaatttaacttttgcaaattttaatcttttgtttcaaaccttttagcgttttattttctcaatcctgaaatttttttatgatgattttttgatcctgaaattaaaaattctttttgaaaattagccaaaatcgtgaggttttttcatttccactcactccctgccgatgcgccgcgatgccgagtcgcgcaaaaaaaaaaatcgataacggaatttggaagaagtgcaaattaattgatattggcagcaaataattttgattatgaattggacaataaa

SEQ ID NO: 67011 - DNA, 441 bp, Heterodera glycines
  Genomic contig location: Contig_ID=SeqID_38094; Location=154..594; Strand=-
  SCN-specific regions: Sequence locations=1-51,73-157,181-242,264 -291,315-441
atggaaacgtatttaagaagttagagctaattaggtaagcaaaaatggtcattttcgaggtaggtatttttggtggctgattttgagaaaacgaagagagatacagaagctgagaaatagtgattaaatagagcaaagttagtactataagaatactaaaatataaagttttatttcataaaaattgaattattgaggggggggggccgagtctgaaagtggtttccagaaacggcatttttcaaaaccatcaaataacaaaattctttaataggggtcttggaaattccgaatttaattgaactagttaaaccgaccacgctgagttcgaacatagccttagatttgatctctgaattctcactgaacctgtacagctccaacttcatgcatggaattgaagcactacaagctcaagtagcaaagataggtcagatttaa

SEQ ID NO: 67012 - DNA, 864 bp, Heterodera glycines
  Genomic contig location: Contig_ID=SeqID_38096; Location=145..1008; Strand=+
  SCN-specific regions: Sequence locations=1-157,179-536,558-644,725-864
atgtgttcattgatgctattcgttggaagaggaaatcaatgccaatggattggcaccgcgcgaaggcgccggagaaggcggaaaagcggtgccattgacggaggaggaggagaggagggcacaacgcacgtttggcatcaatcaggcgagaacaaagagcatgggcaggcagtgatcataaggcattcagttcaatctgatggcgagtgatcggatgtcgttgcgccgatcactgcccgacgttcggcgaaggcaatgccgccaaaagaaataccctccggcggacaaattgccgaatacaagcggtagggagggggagagggaggctgagttgggcattgggttgctgaaaatgctgatttttacttgcccagtgatcattgtcttccacaacgaagttggtctctgtttgccattttccattcaattatcatcctcccctcgaggccttttccacccttgcgcgaacaattaccaggtcagttgcaacacttgtccattaatgactaatgatgatgatcaagcactatttgctaattaccctcccttcccttcccctgaagtgtggtctcccactcgcctccttcgcttgtccatgaactgattctcgtcgacgatttctcagccagaagtttgtttcttattctcttctctctctctctccctctcgcactctctctatttctcttccttccccctctctccttctctccccctctctctcagtctatctccccttcattttccctttatcttgtctcagaatttctccgtactgaattggaacagtttctgaagcgtctttcgattcggactaaattgatcagagccaagaagcgtgttgggctgatccgtgctcgtctg

SEQ ID NO: 67013 - DNA, 462 bp, Heterodera glycines
  Genomic contig location: Contig_ID=SeqID_8116; Location=291..752; Strand=+
  SCN-specific regions: Sequence locations=1-462
atgtatgcggatcctgccggatcccgcacaaaaatcaaatttgcggatcctgttgcaggattggaattcaaaattttttgccggaccggatccggccggatctatcctgcaaatcctgcaatcctgcaaatcctgcattttccaaaaaatgcaggattgcggactgggatcctgcaaaatcctgcgcaggatccggtcctgctccgggctctattgtcaactgagcgactaccgccttttttggcattttcaaaaccgggatttttcgttattggttatatcgaattttattcatatttgacatgctatgaaaataatatggaaatttgagatgagaaatttttcaagtttttcattgcgaatttttgatcttgagcgcaaatcccgaatcagtaccgaattccagttcaggcttgaattatgtaatagttaaaaaatcgagctacacaccgctgatgggca

SEQ ID NO: 67014 - DNA, 4027 bp, Heterodera glycines
  Genomic contig location: Contig_ID=SeqID_8117; Location=1515..5541; Strand=+
  SCN-specific regions: Sequence locations=1-56,78-235,270-442,464 -577,599-743,765-813,835-968,991-1465,1502-1756,1778-2082,2112 -2155,2193-2372,2394-2530,2552-2626,2649-2793,2826-2829,2851 -3212,3234-3435,3457-3578,3849-4027
ttggacagcccccttttccaaacaacatcattcagtgctcaagaaacgaatactcgtgctgcatttgtggcccaaaaagccaaggaaatgtgccatgattggtaaatattggcactatttcagtttacgcgtctaatatcaatatgactatcctcagtttcttagggcataacttttttcgaacttagtcaaagcatacattcttgtgtattaatcgactgcttaaagtatcgggaatttaaaaatataaaaaaagatttttaatattactacaaagtacactgagaaaaaacaagaaattcaagttttaaaaacagttgcaatgttttttgaggagccatagcacatcaatcccgactctatatctcgttaggaaatgtttgcccgccaaatttttcagattctttctttgaagaccgagagaagcacgattgataaaataatttattcagatttagtctgggtatttaataatcatattttcacaaagattaatttttgtcatttaattttagactaaaatttaataatacaaagaatttgaggctttcgtttgataccatgaatgtaggcattgaccaagtaaaaagaagaaactaagtatggtttttgattggtcacgtaaattgtgaaaaagccaaaatacttttgcgttttcaacaaaaaataaatcatataaaattcccgccaatttttgaaggtatgatgaagatggtgctcaatggaattttattcgtgatgtggaaacaaatgcttcatgtccatgcacagaaaaacagataattatttaatcacgcataattaaatttgtcgataatatatttaaattaaaaagataacccatcaagttttaggctaaacttgacttgggccgttttatgcctcatccccgctgctcccaagaatttcggtaaatttttcccgctttcaaattcttgactttaatttggtctatcgtatttgtccggattaataattaattttattaaagggatattacatgctccgagatgatcggtgccaaaaattgttacatgagcgcccaaaatgtgtacggctcttacacgggcaaagccgattggcaatggcaggtccataatttttaaattttgcgaaaataaaatgtattaatgttaaaaattgattttccccagactttcggggatagaagatgtggaatcggggataaaaattaccgaataatttttttttgggatggcttaaaaattttgaaaaaaaactcacttagaaaatttcatttcttttatactaaatacaaccagacaatctaataaatcccaagcatttaatattattgatattaattctcctaaatttatttgataaaaaaaatcaaaaagtttgtcaaactgatcaaattcaccagcaaaaaactgatcaagacggaataataagggcaaatttatggctaaataaaatgagaaaaataatctctaaaattgacattaatattatttttatttttttatttaatattattcaaaaatgcaattaaacaaattgaggcaagcaaaacaaagcaagaaaaaagttttaatgaaatatttggccaaagatgaaacgatggaaaagaagaaaatctttgccaaattggtcaaataattcatggagaaacagttgatcagaataacgtattaggtcaaaatgaccaacaatttgatcaaattttggatgaaaatttggaagtgaaagaagaggaggaaagtgaagaaatgtcacaaattgtgaagaatcggaacaatttgcagaaaatagtggacaaatttgtgaaactttagatgataagaagaaaagagaaattattaaaaattgcataaaattaaagaaaaaattaagcaaatgggaaagaaacattcagaaaaagaacggaagaaaattgaaagaaaaatagtcaaaaaaattgggtgtcagttacgccaaaatttacaaatggaaaagagaatttggactgatcagaaatttgaattcggatcaggaaaaagataaaatattaaaacagtttgatcaaatctatggcaaaagtaaaaataaattaaaagaaaaattggaaggaaaaagcacaaaatataaaaaaataaaattattttaaagcaaaaaatgaatttataggaaatggaaaacactcagcgaaggaatggaaagaatttcaatcaaaaattatacaaaaattttgcgtgagttttttgacgattgaaagatgggccaagaaattaaaaatcaaaaaaatgtatcaaaaggtttgattcattaaaaattatctttacagagggaaaagtgttaacaaaatttgaagtgttatctgaaaaatgttatttttttcatggtactatgaccataattttgttcctgctttgttgattttttgtgttaaatatttgaatttatggcgaaatgccgaaagattaaaatacgaaaatttttttgtattgactcttaattgtgaaaataagacattttgggaaaacctaaagttcttcctcgatgctcgaggagtgaaggtcgaagatgaggaagaaatttccagtcaaatttgtccggaattctgggaaattgaaaatgttatggagtaacatacctttttaggggagaaaatttcataaaagtcttaaaaaataaaaaataaaattctgaagcaaaaaatccatagaaacgtgaatattctcagagtgcaaatgacgatttcgcaatttgccggatgtggaggaaccccctaataaaacctattaacaaatcacatgcttatctgaaccgcccgccagacccttacttttcataaaatttaaaaaagtaataaaaaaattaatcgtcaaaattttcctttcttaattttttagggcttatatctctaatatggatgacagttaaattcttaatctaaccaggatagttattatttcaaaacctaataataagtcaagttttaacattcgataatttttttgtatatttaacgattaaattttagatttttttctttaaaaacctgatcctggccagaatctatgtcaatattttgggaccttgattcaggatctcgaaaaaaaagtttaatcctgaaaccatgtcccaagcgaccggaatttctcaaaattctgggcccctattaacattttatttactgatagatgtcatcaaaataattaattacagttagctgaccttgttttcgttagaattttttttgatttgctggaaaaatttgttcaaaattttaaaattttgactctttccccatgtcgtcggcgatctccctccaccccttcaccaacctctttttacacctgtcccctaacccaatgggaatggggctccatttgggcctcttttcgggcccaaaccacataaaataaacaattcaatttaagatttaaatcaaagcttgaagattttttcagaatagaacttagaaatttcttttttgtctcataaatttcctgaatttttttacagtacaaccaaggctggggtggtgctgcatatacaactggtgctggtggtacgctgaatcgagaagggctcagagcaggggaggaaggcggacaaaagtgagaaaaatgttaaaaaacaataattttattgcaaaaaatttttaaaataaatttttataataaattaataattttatattaagaatttagtttaaaatttagtatattattatatttgtttaaataattgcagggagcttttaaaacaaatttccaatttaaaataatttgacagtttacagttaataaatatttattattttttcatttttttttactacaataaataatttcagataaaattttataaattaccaattattaaaaaaaattaattaacagccgatttgccacccattatggccaagtgtgctgctatgaccaggagggctatttgcaacagaccacctaccagccgaccctgaaagtgatcgaccaaatgttctacaatccgggatttccgctacgggcctatgagttcggctcctacccatatttgggccaattcgaagtgccgg

SEQ ID NO: 67015 - DNA, 1000 bp, Heterodera glycines
  Genomic contig location: Contig_ID=SeqID_38103; Location=138..1137; Strand=+
  SCN-specific regions: Sequence locations=1-396,418-826,848-928,950 -1000
atggccgaagcagcaattcaccaactgtccgacgtgttccagcagttcttgactgctcagcaagcaaacgcggcagcaccagcacaaccgactccaatgccaaatttggcaaatttcgactgttttggtcttggtgaccatggcgaaagcgacatcgagggttggctggaacgcttcgcccttgcgcttgactgctcaacaccgaaccttcaggacgaattgaaggttaagctcttgctgacaaagctaagcgaatcggcctacagcgagtacaccaaacattgtttaccgaaaaagccaacagagtttgactttggcaaaacttccgaaatgctgaaaagcttattcgcgaagcacaaatcagtttggatcaaccgatatgagtgcttaaaggctgaaaagcaagacgaggaggaatttcgcggcttcatcaaccgccacaaaaggctgttaagcgattttgagtttaagaaactcaacgaagagcagttcaactgcttgatgctcctcgtggcgcttaaatcgccgaaggatgctgaattgcgaaagcgcatactgtcaaagttggctgccgacggtgacagagcaacatatgaaagtgttgttaacgacttacaaatgtttctgtcgaccatatcggaggcaaaagtaatggagagaccatcgaactccaatattttggctgtaaagcgcagccagcaaccgatgatgccatcatcgtcgccctgaggagtaggcagcgggggggagaagagaggaccacattaaaggcggaagaattgggcggtggtggcacagagcaaagcaaaaacaaagcggcagctataaaacaaaaagtgcgttgggatggaaaaacattgcctcaggggacactgggggatgaccaccaattgcaccacgctggctgctgaaatgggtatttgtggaaattttatagtgagcaaagtgtggtgcctggggaaatttgggcggagggacggcttttaaaaaaaaagtggca

SEQ ID NO: 67016 - DNA, 847 bp, Heterodera glycines
  Genomic contig location: Contig_ID=SeqID_38104; Location=197..1043; Strand=+
  SCN-specific regions: Sequence locations=1-63,109-437,459-612,634 -764,787-797,822-847
atggcctcattttgtacagtgttcgaatttcattggtactctcatgtccaatgcatcttcaggtaaaaataaaaatttatattattaataaatttatttttaaataaagtactacccaatggatgtgcaaacttgcctgatcgatttggcatcttatgcatacactgactcggacattggtaatctttcttaataggatctaataattcatttttatcctgtcttcattatttaattagctacatcaatcagggattcctagaaattccgatttacgatagttttggggttgaattccgattcataaattggctttggcatctctattgaaatccttccttccgtgcttttgtagacctcttattcatgagatttatccagttctcaaatgagacccgctttcgtctacttttcgtatttatacatagaagtgatccaaaaaataataaaatttaaaagtaattcggacaattttctccatattttcgaaaatcttttccggaatagaattgctgtcacaataccaaattatgctttttagaatatcgctggaagcaacaagaccccgttcagcttaaggacggacttgagtgagtttggaataaataagtgtttatttttaaatatttttttcaccaattttcaggtcatctttgccgagctttcagctgacgaacgtgtccacaacctcgtgcacttcaaagacaaatacgggcacatactcgtaaacatattaaactattatttaattaaaacccgaccatttgtgaaatgataaaattatagccgcaatacattcccccaatcccaccccacctcttgaattacttagcccagctatttgaaa

SEQ ID NO: 67017 - DNA, 70 bp, Heterodera glycines
  Genomic contig location: Contig_ID=SeqID_38107; Location=296..365; Strand=+
  SCN-specific regions: Sequence locations=1-70
tgtccgtttggggtactcaatcaattatggggagcaaaaatccaacgcagaattaaagtacaggctatag

SEQ ID NO: 67018 - DNA, 877 bp, Heterodera glycines
  misc_feature (22)..(22): n is a, c, g, or t
  misc_feature (58)..(58): n is a, c, g, or t
  Genomic contig location: Contig_ID=SeqID_38108; Location=264..1140; Strand=-
  SCN-specific regions: Sequence locations=1-64,86-468,490-499,521 -844,867-877
ttagagaatttgtacaatgtantacattaataaaacatatgccaccccgtattggtcncaaggaaatgccattactgaaagaacttttcgtacatatcacaacattttgtctaaatacatcaccaaggaaaacccagactttgatgaatacattgaatttgcctcattctgttataatacgtcgtgccattcatccaccaaagagaccccattctttttaatgtttggtcgggaccccattttctgtattgatcaaattttggacgttcgcgttcacaatcaagttgattttaaaactgatggcgaatttactcaaaaattagtcacaactttgagaaaagcttggaaatgtgcagcggaggcaattgaagaagcacagaaaaagatgaaaatacaatatgacaaaacaatgcgacagcccaaaatcagcgtcggcgatagggttttacttagaaactataccggaaaaattggcacttccaaaaaatttcaccttccctggaagggaatttttagggtagttgagctgaatggtgtccatgccaccataataagctgcatttcaccgaaccagccaccaaaaaaagtacatatcaaccagataaaaaagtgctttgagctaataggccccccctgcacatcgccaaaaactcctaatgatgagcaaatagtgccggaaaaattatcagttcatgctgatgtagaagcgctgagcaatgaaccatcagaagctggtaatttgaatcaagaaaacagtgaatcgaccattacaaacagacagaatgtgatcaatcaaggaattgcagacattaatggtgacagaagatattcgctgagaaatcgattagctataaccaaaccaaaacggttcactgaa

SEQ ID NO: 67019 - DNA, 603 bp, Heterodera glycines
  Genomic contig location: Contig_ID=SeqID_38109; Location=48..650; Strand=+
  SCN-specific regions: Sequence locations=1-459,482-603
catttcaatcactgggactcaattcatttccaatcactgggactcaacccaccagcatttcaatcactggcactcaacccaccagcatttcaatcactggcactcaacccaccagcatttcaatcactgggactcaacccaccagcatttcaatcactgggactcaattctgcatttcaatcactggcactcaacccaccagcatttcaatcactgggactcaacccaccagcatttcaatcactgggactcaacccaccagcatttcaatcactgggactcaattcatttcaatcactggcactcaacccaccagcatttcaatcactgggactcaatccaccaacatttcaatcactgggactcaacccaacagcatttcaatcactgggactcaacccaccagcatttcaatcactgggactcaatccaccaacatttcaatcactgggactcaacccaccagcattccaatcactgggactcaatccaccagcatttcaatcactgggactcaatccaccagcatttcaatcactgggactcaacccaccagcatttcaatcactgggactcaatccaccagcatatcaatcactgtga

SEQ ID NO: 67020 - DNA, 388 bp, Heterodera glycines
  Genomic contig location: Contig_ID=SeqID_38110; Location=429..816; Strand=-
  SCN-specific regions: Sequence locations=1-367
gcttaaaagcattgtacagcataattaaaagctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccatttttccgttccacaactggccaaaggcgactgtgctcattgacacgtcgttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaa

SEQ ID NO: 67021 - DNA, 1196 bp, Heterodera glycines
  Genomic contig location: Contig_ID=SeqID_38111; Location=168..1363; Strand=+
  SCN-specific regions: Sequence locations=1-351,373-1014,1036 -1066,1097-1165
atggccggcgcacttcgctatactattatgcatccgggcgccggtgtgaagagtgccgaggcacggctgaagggcgtcgccacatttcgccagggcgcgatcggcatgcaactcaaaagtggtgcgtgaaatggcagagcaaactgatcggagcttagtggaagagcaaagtgatccgagctcagaacaaatgatcaaaaagagttggctgggttctatcggctcaagtcccgttttcccagattttcctgatcctgacccaatttttgggtcgatgaccccgccaagaccgggaatttacgacgaatgattagacaaggaatggatttacagttccagttacaaaataagcaaatttcttggggatttgaatgcattttcaaatagtagctttcaaagaaaacaaagattttggaaaagaattcaaaaaataattcaaaaattttatccaacgaatgtttagacagggaatggatttacagttccagttacaaactaaacaaatctttgggcgatttgaatgcattttttcgaatagtaaaatctctgtgcaacagttggctaaccctcaaaataattttcggtgaaaaatcattaaactttgattttaggcgacaaatcggacacaattccattggccaacaaaccctttttggcggagcaacagggcgatcgcatttggggcctaaatcgggagccaattgcggaaaaattgcgggtggaaaatgtgggcgaagctgacaaaacaacgttggtgatcttcttcaatgacaaaactgagaatgagcagttggaccacgatcttgacgacgcacaagtatgagagcaatcaataattagttgaaacagtatttcatgccctcaataccgtatctggggacaaaagggggtgactaattaacacaaatatcagggattaagcctatcctaaatttaaaaaaataacattttaacctcagcagccgaaaatttatgtggatttgtgaaccacgaagcgaaaaaaatcctatccgttaaatattttctcataaattttagattatttaaaatcataattagttagctgattatttttaaaaaatttttcaatatttttcacaggtatttcgtacaccgttggataagcctgaccccgaaagtctcgtcatccacattgaattcgttgtaaaaaaaataatttttaaattaaaaaaaaa

SEQ ID NO: 67022 - DNA, 558 bp, Heterodera glycines
  Genomic contig location: Contig_ID=SeqID_8119; Location=836..1393; Strand=+
  SCN-specific regions: Sequence locations=1-176,200-254,277-558
atgtccaaatcagggctgggcgaagctcggtttggcactcgaagccgaagttcgaaacgaagcccaaaaattttccggggatcacaaaacagaaaagaaccttccttattcactacggcagatcaatcaatcacatgccaattgacaccaatttatgttgctgggaatattcataaatataaaattctagaaaaatgcatattaacaatgttgtatcgttatataatgcatgtgtctattggagattgattacaaattttatttcttaaaaatgtcggaatatggaaatatattcgaaattatttttgcgaaaatacaaaaaattgtcaatttttggcacttaattcatccgcctctgagcacttaggctgtcaaaaatatgttcaaaaattgatcaaaattttgagatgtaatttggtttgcagttgtgaagctcgaatttgatataatttggaattttaaaattttaaatccatttttagcagttttagtgtcttttttaagtctgtttaagcaaatattgaatattaacacactttttaaccaatttactaaaaa

SEQ ID NO: 67023 - DNA, 319 bp, Heterodera glycines
  Genomic contig location: Contig_ID=SeqID_38113; Location=11..329; Strand=-
  SCN-specific regions: Sequence locations=1-319
atgaaagtcgctttctttctgaacggaacacccgtccaatcgagtgggtgtcgactgatcagtgatttagcacagatcaaccaagaaagatctttttcaggtgaccgtgtgcaagtcttataccaaaacggatttgcattgctttcaatcgccgaagtcactgaacaggatgccggctactacgtttgtcaagccgaaaacgaaattggcagtgccgaaacatccgccactgtggtggtcgtgccacggaagggcgacggcaagtttttggccgaaagcgaaggtacgtgggaacgtggaagacatgcgcgagttgcag

SEQ ID NO: 67024 - DNA, 521 bp, Heterodera glycines
  Genomic contig location: Contig_ID=SeqID_38113; Location=621..1141; Strand=+
  SCN-specific regions: Sequence locations=1-85,241-303,326-370,393 -414,480-484,506-521
atgggagaaaattttattttcataaaagatttctgtagatattgcaaagaaaacgcaaaaattatgctggtaatttgcataaaagaaaaaataaataaatttatttatttacatattcggaaataactaaatattaatattaattaaataaaatatcaataaaaaatattttattgttttattccacccatttgatttttctttttttatcgttaattttatttattttatgtctttttaatataataaataattcattatttttctcagctaacaaataagttgcatattagaaggaaatcgttcccttttctgctttcttcgtccactttaaccataaaatccagtttttctttagaggagctttttaaagaaagaaggaggaaaatgagaatctccaattcaacggagtcgtagctcagtggcagagcaattgactgcagatcaataggtcaccggttcaactccggtcggctcctatccttttttcctaattttctattcacagtaaagccattaaa

SEQ ID NO: 67025 - DNA, 54 bp, Heterodera glycines; identical to SEQ ID NO: 55479
  Genomic contig location: Contig_ID=SeqID_38118; Location=119..172; Strand=-
  SCN-specific regions: Sequence locations=1-54

SEQ ID NO: 67026 - DNA, 638 bp, Heterodera glycines
  Genomic contig location: Contig_ID=SeqID_38120; Location=24..661; Strand=+
  SCN-specific regions: Sequence locations=1-113,137-248,271-638
atgtatgatattatttcagtgttcaacaatgaaagtcggctttattcactttaccttgagtttttgaccatcgccgactcaatgaattggctgaatgtaaaactaaaggtattaaatgcaattttaaaattaaaaattggctactttttaagttggatttgttcatttttgtccaatggaccgatgccaaaattgccaattccgccgcgtccatcgcccggcaaaagtgtgccaatgtttggaatcggcacaaatttttgttttacaaactgtacgaccgttggcatgacgaaccgctggacgaaatgccaaactttcaaatttatcaatcgatttttttgaatgaaatgaatttactttttgaaaaatttttgatgaaaagtgaaaaagcaatggacgaggaaattcggaaaataattgaaaaagcacagaaaaaatacgacgaaaaaaaagggacgagaaaagtgaaaggaaaagcgaaagaaagtgacaaaaacggggaaaattatgcgaaatttgaagtcaaattgggcgaaaagaatgttgaaacactgagcaaattggtggaggaaaacgccattttcaaaaaaatattaaaaaacagtaagaaaaagaaaagtggcaagagattactgtag

SEQ ID NO: 67027 - DNA, 485 bp, Heterodera glycines
  misc_feature (221)..(222): n is a, c, g, or t
  Genomic contig location: Contig_ID=SeqID_1057; Location=780..1264; Strand=+
  SCN-specific regions: Sequence locations=1-143,166-485
atgatgatgtacaacgacaacaacagccaagcaccaccgcaacaggtgccatttgaatgatcagcataatcagcgaattccgtttgtttttagccgccccttccgtacgcgacgaatgaccaccaaaggcaacaccaccacttccaacaaccagcacagcagcaggacccgcgcatttacccacagcaaatgttttacaatccgccgcagcctatgccggnntcggttgggcagtcgccccctcccctccccgtgccaacaattcgaattgtgtgcgaattccctcccattttttcagcatcaataccaccaccaaactctgctgaaccgtctgcccaatgttccgcagccgtccgttgccgatgcgcaagtgatggtgccaccgccagcgatgaccgatattgcgcttgccggtgccgaacaggccattcagatgttctacaacaatgccgggattcacaatcaacagacgcaccagcagaatg

SEQ ID NO: 67028 - DNA, 1468 bp, Heterodera glycines
  misc_feature (101)..(101): n is a, c, g, or t
  Genomic contig location: Contig_ID=SeqID_1058; Location=1144..2611; Strand=+
  SCN-specific regions: Sequence locations=1-476,498-1261,1284-1468
atggaattggaggacgtggacatggatgaggacgaaatcgtcaaaacattggtgggccaccggggggggggggggggggaatgagggggtcatacctctcncgttgagttttgtttaattttttttaaatttcgaatgctatttgtatacctatgacatttttcgatgctccgtcccttaaattcaaacaattcgtttgtcagaatatggtgttcaccaacctcgacctctcccaattgcccgctttgtctcccggcgccggactttatgcaatggccaattatgcaattgaagagaaatccatcccgaaaagaaaggcggcggaggttccctcccccttctcatctcaaaagtattttaatgagtttagaagaaggttcccgaggatgtgttggagcccactttcctctccctggagcaagccatgcaaaggcatcgaattgcttttcgtccaatttcatttggtttttagagatcagaatttcaaggggaagctgttggacgcgttcttggaggactttcgggagcattttcagacgtatttctcccgtccgaattcgcaaacatttgacaaggatttgtgtgtccgtttccttcttcaacacttccctttcgtacgtttttccttttcctcaattttgcttctgtttgtcccttttccttcagtgccgtgttccgctcattgaacgactcgccgacgaattcgccggtcgttacgccgtcgccgcgtgggtttgcttttttgtggagagtcgtttcggcgttctcatgcgtcgatgtaagtgctgacaatggcacattttcacttggtaataaatatattttttagattttttgcacattgaacactccgaatgggtcattttgtccattccgaacgaaaacgcgcgaagacgccgcgccaattggctgcccgacccgtcggaagaggacgacacaacgctggccaattcaattcgcgagttccgcgctcgtctcgcccgtttccgtgccgattatccgcaactgttcctacccgactccaacaaactgagtcccgtccgtattttatgccattgatttaatttaaattattgttttccttttcagaatgccgaggaagtggcggtgtacaccgaaatgccgggtcttccgctgatcgaatgcatcgtttgcaccggtcaattccccgtcgcacgcactgtgtgttgccaaaacattgtcaattggaccattaccattgacccgactttgccttgttcgcctcccccccccctttccattttattttttaccattttccctccttttcagccggcctctcttcccaccgtttctgtgtcgagtgtttgattggccactctcgcgccgccacccaagaaatgccattggcggacggcggcatcggattgcgatgtatggccagcgactgcccaaatgcgatacttttttgtgagttcattccaacggaatattggagccaaacaaa

SEQ ID NO: 67029 - DNA, 208 bp, Heterodera glycines
  Genomic contig location: Contig_ID=SeqID_1058; Location=2690..2897; Strand=+
  SCN-specific regions: Sequence locations=1-55,78-208
ttggaggagagtttgggcgaagcgaagttggaccaattggaaaggtgggcaaatggaggggacgggaggggaaggaaggacaaaaatggggcggggacgtttaaatggcgtccgaaaagacaccccttggataataatgaagaaattggccgattcttttcattttttatttagatgcaaatcgtgcaactttgccatcattatcgag

SEQ ID NO: 67030 - DNA, 1520 bp, Heterodera glycines
  Genomic contig location: Contig_ID=SeqID_1059; Location=1..1520; Strand=-
  SCN-specific regions: Sequence locations=1-275,297-406,434-1430,1503 -1520
  Gene Ontology: Cellular component=extracellular
ctgttacaaattgtcttaaataagtactatcggcgctagggatggcattgcgagacgcctatcattttcgaaattcggaattccgagacccaaaaatgacagaatcgaaatttcatgctcatcccagatcgtctccacttttcgaataatttggcaaattcgtttcacttaagtatttgtggataagttaaggcggtcgtcgctcggcgcgtcaaatgataagacaaagtcagtgaatgataaggcaaaggcattgatggcacccccccccccccatggaattcccccattcccttttcattgagtcactctttccctctcctttaaatttttcaaatttaattttgcttttattttcccaaatgcttttctccccgtccactgttctgctattgcttctgatcgtcctccctttctctctttctttcattttaatccctcaaaatgtccgccaaatttcccccgccctttcgtcgcgtcccttccgccgatttggccatttttctgtcattgccaaacgaaacccaattgttctcagtgagttcgcgttgtctgtgtgtcgcccatttgtccaattggccattcattttgtctaattttagtccccggcgacgggggaagtcggctaaaggcgaatttgacgggtgagagaagagaggggctgaagggggtaaggccaagggcactttaggcaaaccgtcggtggtccattacttttgccagcgacagaccaacgatttcttcgcgctttggctcgatttgcaagtgatctcttccgttcgcttcttttaattccctaattgcccagcaatttggcccttttgtcatcgattgttgggccgacaatatgcgcctcaacttcaacagaacgagcggaagggcgcaggatttggagggagtgaaagtgcgagtgcccggctttggacacacgcgaaccgtggaatggtcagaggggggggggggggaatggagcagcaaaacgcatccatttgaagaaaaacgcaaagggacggaaagacggaaagggttgggatgagaggggagggacactttcttcttaaatgggcagccaattcacaattattaaaaagaggtggaatttctgttgattttatgattgactcctccaaacggtcgccgagccgttacttcgcgcccatcgtcgcctccctcgccaaattgggctaccaacgcggcatcgatgtcatcggtgcaccgtacgactggcgaagagcgcccggtgggaagggacgaggaattattgggcacaaaaaattagaaattgccaaaatgagtttgataagtctgaaaatagatcgaaaaaccttttactgttcaaaaacaaggttttcatttggtccactcattttttatttattttttgctttaattttcatttgatagaataattttaatggtctactaacatgtcccaggtagtatagtggttagtatccgcgcctgtcacgtgcgagacccgggttcgattcccggcctgggagttcaattttttttgtttt

SEQ ID NO: 67031 - DNA, 1503 bp, Heterodera glycines
  misc_feature (45)..(45): n is a, c, g, or t
  Genomic contig location: Contig_ID=SeqID_1060; Location=1..1503; Strand=-
  SCN-specific regions: Sequence locations=1-45,68-736,764-771,945 -1453,1475-1503
  Gene Ontology: Mol. function=acetylcholine receptor activity; Cellular component=nicotinic acetylcholine-gated receptor-channel complex; Biological process=synaptic transmission
cgtaatgtgccgaaacattcagcggataattggctaattatcttntcattttccctctaattaaaggtcttttgggagcctccggccgttttcaaatcgttgtgccaaatcgacgtccaatggtttccgttcgatgagcagctttgccaattgaaggtggtggaggaatccccgccaaaatttggcatctctttgctgtttacagttcggttcgtggagttatcccgcggatttgcttcgtctcacattttgggaggacgccaatggcacggaaacggaaagggaggacggaattggcaagcactttgtccattcattcgttgctttttgctaataagctcctcattttctcttaattacgctttttcgctttcattatcccccccctctctcttctcatcagatttgtccgattattacccttccgtcgaatgggacattatgtccgttaaggcagtgcgccattcccacttttattcggcccgttcctccgccggtgggccccccgccaaatgtgcggcagaaggactttgatgacattgtggtgaagcattgccattacagtgccattctctctctctctcctttcagtacaatttggcgttgcgccgtaagccgctcttttacaccatcaatttggtgagttttccaaagcaatgggcgatgtgatgattgaatgggactgaggatcactactgatcaatcagattagttgcttgagtcgtctccactcaaatgtcttttccttccccttttgtcttcccaaatgcttctctctctctctctccctctctctctccctctctctctctctcgccctccctctctctctctctccctctctctctcctctctctctctctctctcgccctccctctctctctctctctccctctctctctcctctctctctctctctctctctctttctctttctttctctggcccaatttgcttttctttccccctttttctgctttaggtttttccatgcgttggcatctctttcttgaccattctcgtcttttatttgccgtccgattctggcgaaaaggtccgtccgttggctcctcttttccccaaatttgatcattttccccatttccccccccccccacagattgccctttgcatttccattttggtcgctttaactgtcttttttctgcttttggtaattttcttccgtcgtcgttttttttcttttctcatttcccattttccaattctccaaagactgaaattattcctgccactggcactgtcatccctttgatcgaattgtcctttgtcaatatctttttcttttctattttccttaattcaagcagatatttgctgttcacaatgtgaatggtcactctttctgtgatgggcactgtttatggtcctttgatttgtcttcactttatatttgcttcctaattacccctaattacacattacattcatcacttaatttccatttccataagccaaccactcactctttttccccatgg

SEQ ID NO: 67032 - DNA, 4214 bp, Heterodera glycines
  Genomic contig location: Contig_ID=SeqID_1061; Location=740..4953; Strand=-
  SCN-specific regions: Sequence locations=1-380,405-802,831-1252,1274 -1284,1325-1513,1535-1900,1922-2087,2110-2492,2516-3528,3550-4214
  Gene Ontology: Mol. function=protein binding; Cellular component =microtubule cytoskeleton; Biological process=spermatid development
atgttcggatatcagcagactcaattcaattacggcgcttacgcttcagcaaacggtcagcagcaaagtttcatcaattatgctcagcaacaaaacaattcggcgactgctccggtggcgggaaatgccacaacaaatgcatatgcgtaaggctccttaagaatttcgtgttttgtcgacgcaaaatttggtttttttagtgcctcccaatattcgttggctgcttcggcttacgcacaatacagccaagccgcaacacaacagcagtccgttgctgcaacttacggagttcagcctccgccaccacctcctgactattcaggtttggaatccttaggaattcggtaatggaatgtttaacggcacttggaacaaatgttgacttagaaaatgatttctttgtagagccaaatagtcattggtttgtctcacaatcagcttcgtcgaccaccggcgcttacggcgtaattggcggtggcaaggcgaccggggccaacgctacttccgcggccaccggcgcaaatgcttcccattacaccggttacgaagcggctgtttatgcggctgcctcctcttaccttcagtccaaaaaccatgctccacaaccgcaaggaaattgggtcaacaaatcgtcgggtgggaacttcaacaaaggtttttatttttcttcgtttttaacgttctagaaatttttaagaatttcgcaagaagcgttacggattgggtcatcaaaatcgagatgtgcaacagcatttttgtgaagtgtgcaaaataagctgtgctggacaagctgcttataaagaccacttggagggaaaaccacacaaaaagaaggagatggcggccaagaacaagagtacggtgcccacttacaagggcgttgggttccgttgtgaagtttgcgagctgacttgttcaaggtaagaagcactgtgaactttgttttcaatgaattctattcagcaaggacacttacgatgcgcacataaaaggacagaagcaccaacgtaccgttgcacttctgagacggatgggcaagccggtccccgagcaattggacgtgtccccggctgttctcacttcggcaaatgcccaagcgcttggcaaaccaattccgaccgttggtggcaacgtgccgttgaaaaaagtcgttggtgtgactggcaccaaatttgttggtggcacgaccctcacaaccacaggcgaggagttgaaaacaggcggcaatcctgcgaatgttgttaccggagcgatgaaaccacaggatttggaggctaatatatctattctcctttttatatttttaatgctctgtgatttatagaaggctctgttggcggacgttgacataaaaccgattgggcaagaatatattgaggaggagacggacactaatggaaaattcatcaactacaattgcaaattgtgtgattgcaaatttagcgacaaaaatgcgaaagacattcatctcaagggacgtcgtcatcgacttcagtacaaagtcagtagttttttattgcaaatgaatgaataattgcattgtaattcagcaaaaagtcgacccgagcttgaaggttgaaatgaaacagtggggcgggaagaagcagcaacaaaagcacaaattcggagggccaggggcttatgctatgtcgtatgtgatttgcttcagtaccccctaaacagttgattatgttaattaggtatcacccgccaccacagcagccgcgtccgtttgttccaatgcaacgtggccatgagataatggatgaccaacacgtggtgcacaaacttcagcagatccaattgtccatggatgaaatgaattcagttgaaagtttagccgttttatccgaagtgagactttataaaccaatttttagatcactcatcttcaatttgtatactttttagaaaactctgaaggctgtttcggattcaatgctttccgaggctgattgtcccccggaaacgcaagaagaacatcgagttctcaagggagtgatgagagttgggctgttggccaagcacctgatgctcaagacggacacgcaggtgccttactaaacacttaggattttatattcttcgagtactttaaacatatttattaagtttgatttggtcgttttgtgttcaaaaattcctacggtcactttgctttaccaagtggtcgaatacttcaaaaaacatgccgaggttttttttattttaaaaccttaacttccaatgtaattaggtttctcccgacgacaaattgagtgtatccgaattggtcgaagagtccgctttttctgtctcgctgaattctctctctttcacctgccgtgtcacgctcacttgcgttcttcttcgtgagcctcagcaaaagcctaccgaaggttcacttggaaaaccttttttcttgtaaaatccaattccgccaactgaaacgcattgtctgagacttataggggtgcaaaattcgttgtttatgttgagatgcggctgggacggtttttaaaaataagaagctttccattgagtcgtccatttgcgtttggccccatctgcacagtagcaaaacacacggacccgatcagtcaccgttgatcgatatttattgaaaactctaataacataattagcaagtcattagtgaatttatgagttgatgaatggaatgtccgttgattgattgcgtgtgtttttctatgtaagacgggacatcagccgtttctcaagtggaggagaagccacccactgatccgttgccaaaggaaccttgcttgaaagcgttggcggagttgcgtcatgctaaatttttccaggtgagttttattagacagtttctatgcattaaaaatgagaattttaaaccatttaatcatgttaattagaagctgtcttacatttcacccataaaaatgtctgttctttctcggatttctttttctcatgcttgtcatgtaatttgtctgttctgacttttacggttatctcatcttcattcataatttagttattttcaggcgaagtgtgtgccgttgcattcggtcaattcgactgtgaaaattgtacgggacattggaaatcgtgtccaaacttggtccgcattgaattgttgggtaattttccatttccaaaatttctctgatccacgagccttacttcaggctattgaattacttgttgagaagacgctcgcttccatttcgatgccattaagtccgggtgacgcggtgcgtcggctgttcgaagttatttccagcggacaattcttgagcagtgagttacacatcgtcttgcctaatggcatttctgatttactgcaattctctgtgcttttgtttctctttgtttattctgctttttctcagaacgttccaaactgaccgatccgtgcgaaaaggatcaggtggacattttggctcatatcacggatcaggaacgtgaggacatcacttcgtcggcccagcacgcgattcgtctgatcgcctataatcagctctacaagattctcggcattgagcgcttgcccgatttgcgccccgctcctgcgcctcccgtgggaaatggaggtgcagcatcattgaaaaggccgttgagtcgcgatgagtcttctgctaacggcggtggtggccctgcaggcgccgcctccgctgcagcagactcatcgtcggaagggaatattgctggtgagtcatcgaccagtccaagtgatgggcgatcagtagacaaacgcgcctattagcttttaaaattatgggcctgttcgaccttgtagcctattaagtccctaatgatgatgactcacgagagcaaaaagttgcgtcctctttagtgcttggctttcatagctttgcatttctaaatactcttaaatgtcaaggattttttgcatgttttttcatgttaatcttttttcagagaagaagatgcggatggatgacacaaaggaagaaacggaagactaagtttgatgggagatttgtctgttttacatttcgtcagaattcaagtaaattgatcaatgaatttggagacgcttggtattttaaattgactgttttaaaaccctgcattcgtctggtatcacttctcttgtcgttttgttttgctttcaaacttctattgccggacattgccattgcaaatccctctccccgttctatgctagcggctgtcatggtcccctccccttcggccaattccttttgcccgtggtgaagaataaa

SEQ ID NO: 67033 - DNA, 339 bp, Heterodera glycines
  Genomic contig location: Contig_ID=SeqID_1062; Location=1237..1575; Strand=+
  SCN-specific regions: Sequence locations=1-70,96-172,194-339
gacagtgccgtcaatgtcttctggcacagtgtctccccttcgtgacgttcctctgcgtctctctgataagccctcccttccctttccctcccctcgccgtttgaccaatgactgtccttcttccccttctcccgctccgatcactttgtatctccgattggtcagttgggtctgctcaatgagtggccttctgttcggctacgcttcttcctccattaatgatttggtaggccttttccgtccccatcccctcattgtccccccccccctttttcgctccctttcatcgtccgtgagatgcgtctttggcctgctgaggttggcgtggtcatctcctgc

SEQ ID NO: 67034 - DNA, 786 bp, Heterodera glycines
  Genomic contig location: Contig_ID=SeqID_1063; Location=1..786; Strand=+
  SCN-specific regions: Sequence locations=1-324,356-564,586-637,659-786
  Gene Ontology: Mol. function=glucose binding; Cellular component =plasma membrane; Biological process=signal transduction
ccacgaccacgaccctccgaatgaaaaaaagtgatcagaaaatagtttaaaggccgagttaatgggaaagttagctaatcagaagatgactaaatggaggaaaagatgggtcaaacaaattaagtgatctgatcagagtgatcaatcaaatgcgacgctttcccttcccttccaaaggttgtctctttcttcgcctcatgggccggactttttctcgtttctcggtttggcagacgaccgctgctgatgacgggacaaattggagtcattggaatgaacattctgatggcaatttgcttcggctttttccccttcggaccaattcggggatggctcacattggcacttttgctcgttttcctcacatttggccaaggatttatttctacggtcacatggtctgtgaaatgattctgtccactgattattgtatcaaaggcttctgacggctgaaatctttccgctgcatttgagggggatttgctcagggattggaatgtccgtcgcgtggggaactgcgttcgccgtcactatgcttatccccgtaagaaatggaacgaattccccgctttttatattaaaaaaccatcctgacagatcggaattcattccatcggcatggccgccaacttcgcatgccttgcccttcttggcctcatctctctattgtttgtgtggaattttcttccagaaacgcgcaacaaaacattggaagaattggaaaaacaattccaaaagagggattggacggcattgaaaagagaagggcaaaatgagagggacaga

SEQ ID NO: 67035 - DNA, 1290 bp, Heterodera glycines
  Genomic contig location: Contig_ID=SeqID_1063; Location=1113..2402; Strand=-
  SCN-specific regions: Sequence locations=1-269,297-861,883-974,997 -1014,1037-1182,1204-1290
atgagtcgcttctacaaaacatctctgtgcactttttaccagcagcgcggcttctgtaacaacggcgaccaatgtcggtgggcccatggcgaagccgaacttcgcaagggggcagtaagtgagaagaaaagagtaccccgtgttagacatttgtactaaacaaacatatacttaaggacggttcttctaatggactggcgaattattacgctgcgacaatgcaagcgatggccaccggtcagcagaacgccaacggctcgtcagccgaagcggcggcggctgccgctgctgccggttggaattgaattgattctcgatcatttgtataactaaccgattgtcaaaaattgttaagaatgcataacatttgggcaaaaatgtatctttcaatttgagcataaatcgcattttggcgctttatatcttttggtttataaaccttttatattgcagttttaatgattctttttttctgtcattttcctttttgattaagctgctgccgctgcggtctcttcgcaacagaacaattccaccagaggggaaggccaaatgatcggccctcaattggacgcccttctcagccagcggacgacgacgggcgtcgaaacgacggccaacgaagagaccgacgcagacgaagagagagggacacgaaagagaaaccgagaggaggcgggcatttgacaagcgaaaattgacaaataagaataattacaatgtaaaggaaaaagatcggggggggggggaatgaaaaaggcagctttggtgtgttcctactttactatttctatacttaattagggtaatatatgtgggccctctttttcagaaataattctcgtttttttttgtcggagtattcatgctgacatccatttcgaacccccgaacctggactcgaacaaaagtgtagaacttacttttaacaaagtcttattcttgcaccaaaaaaagccaattcttcgatgcgattttttagcttgaaattttaaactttctacgcagccaaactaatttagtttaaaaaaggaaatgaaacttagagtgtgaagacacgtgtattttgatttttggtcaaaatgtgagttttggcaaaagagttttcgactttttgttcgagtgggttcggatttgaaatgggtcgatattagatatcgtaatcagttcttcaacaccgaaaaccctaaaataatctcaaaacaattcgaatttttttttgtttgaaaagaggtaccacattagtgcttaaggaattttggcatacgtaccaaactattaattaataaa

SEQ ID NO: 67036 - DNA, 206 bp, Heterodera glycines
  Genomic contig location: Contig_ID=SeqID_1064; Location=143..348; Strand=+
  SCN-specific regions: Sequence locations=1-135,158-206
atgggtagagcacgtagaaaaaaggtaaattaaatcatttgttaaaaatataatttcgtttttcccaacctaatttacaggggaaaactgccagaagagctcggcaaggattgcttggatttacacgaattgcaagagaaggaaagaagccaaaacaatttgtgagcaattttatgctggttttaattctcagaaaatgtttttag

SEQ ID NO: 67037 - DNA, 560 bp, Heterodera glycines
  Genomic contig location: Contig_ID=SeqID_8120; Location=1970..2529; Strand=+
  SCN-specific regions: Sequence locations=1-85,143-198,220-427,449-560
atggtcgccgggatttggggggggggacgggtgagtcccgctttaacgaatgcttcaacgcgcacccaataatagcaacaccctgatcatgagcatcttcatcacatcaccatcatccgtcataaccccatcatcgtcatcaatgtgtaaaatgggagagacgaatccaaatttgtcctttgccctgcccccctccggcgcacattaattaatgcatttcattaaatttcatttttttttgtgacagcagcaagcacagctggtagtaggaagacaaatgaattgatgcgcaaaacatgctcaaaactgacgctccccccacccccaagttttaagcataattcacattttgatcatgctaatgcatgcgctcgcccatctccgtgttgttgaccatcagacaggacagggcaggaactgattaatgaattacatatatcattttttagggtttgacattacgcacagtcataattttatcaaatatttcatcaaaataatttaacccccccccccctatttttttttgtttaaattagagtaatgaagcttttttttaa

SEQ ID NO: 67038 - DNA, 510 bp, Heterodera glycines
  Genomic contig location: Contig_ID=SeqID_38125; Location=123..632; Strand=+
  SCN-specific regions: Sequence locations=1-213,243-248,270-332,355-510
atggacgtcaaactgatagtgaatgttatggagggaatggacaggacaaaaatgttgcaaatttgctaccagtaccaacagcagaaaatgaaggaggaggtttgttcgtccgcgattgtggtggtccccccgcttggagttccacagaaatcagtttcgccccaaatatgggcacataaaccaaaatgttaaccgaagaaggaaaaacgtcacaaaaaaaaaatttaaattcatttttttaactagccaagtttttgtctttcttctttaaggaaacataatttgttttcaacacaaaaagactttactgctgaatgcatgaatgtttataaacagagttcccaagtgtgcttatttctaagatttgtgcttatttcagcattacgtgcttattttttgatttggaagtaaaaaatgcaaaatttgaatgactgttttgacttataattttttttgaagcgaatatttgaattaattcaatattgaaaattaaaagtttattttcagtga

SEQ ID NO: 67039 - DNA, 279 bp, Heterodera glycines
  Genomic contig location: Contig_ID=SeqID_38125; Location=717..995; Strand=+
  SCN-specific regions: Sequence locations=1-189,216-279
ttagtacttatggggccggttgcgtctcaaacattttgttcggaaaaatatttttttttgatttatccgaaggcgcaaatattaataatttttttcttaaaactcatacgtatgaaaaagttacaagcatttttctaattcggagtgaaattgtgcggggtggaaacatagtgcacccatatcagaaaattgtttttgcatttttatacatttcatttgttttaaatcttttaatatagcccgaaaatggaaaacaatcaaataataacgaaacgaaac

SEQ ID NO: 67040 - DNA, 63 bp, Heterodera glycines
  Genomic contig location: Contig_ID=SeqID_38128; Location=302..364; Strand=+
  SCN-specific regions: Sequence locations=1-63
gttaacttagtcctttacaatggagaaggcctgcaaaatttggagagattatatcgattttag

SEQ ID NO: 67041 - DNA, 349 bp, Heterodera glycines
  Genomic contig location: Contig_ID=SeqID_8121; Location=4747..5095; Strand=-
  SCN-specific regions: Sequence locations=1-82,104-349
ttttcgctccatattgttttatattactcgtaaaacgacaccaaaatagtaaaaatgtccggcaattttgtcggcggcacataaaaatggtgacacatcaatacacaatcaaaaggagagaaaaaatgtttggcaaaaacaaacatttgttgaagcgaagcattgctttggatggatcaatcacaatcatcacaaattctgggaaaatttggtggcaacgacggaatgaaatattgtaatctttaaatatcgaaaaaagagagtgaaatttgacggaatgagagaaaggcaaacagtcgaaatgtgtaataagtgaaatgattgacgtggaagggaaatacaatgatga

SEQ ID NO: 67042 - DNA, 395 bp, Heterodera glycines
  Genomic contig location: Contig_ID=SeqID_8122; Location=317..711; Strand=+
  SCN-specific regions: Sequence locations=1-82,104-202,230-395
gcctcacagttttcccctttaggcaaaaaaagtttttttttgacagctatttcgagagagattcggatgaggaggaagaggcgaggaaagtggaaaaaggggaagagagcggccgaagacacgcgaaaagcagcgacagaaacggcggcagacaaagacaggacggcaaaaagatcagaagggaggaagaaaaacaaacggcggaggaggaggaggaagaagaagaggacccgttggacgcgttcatgaacgaaatcaacgaagtggcggaccaggcgaaggaggagagtctgcgcaaagagagccacgcgctgaacacgggcgaatacgcgggcggacagatgggaagggacgacatcgaacaggaggacatgcacggtcagctgactgactga

SEQ ID NO: 67043 - DNA, 505 bp, Heterodera glycines
  Genomic contig location: Contig_ID=SeqID_38132; Location=234..738; Strand=+
  SCN-specific regions: Sequence locations=1-1,23-126,155-265,287 -390,419-505
caaaagttttttacaaccacttattgccaatttaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgattcacttcaaaaaataattccttacctaaaagttttttacaaccacttattgtcaatttaatttcttgcagatttaaagccatccattgcctgccggttctcggcacagcaaagcactaatacggtgtttgactaacttcaaaaaataattcattacccaaaagttttttacaaccacttattgccaatataatttcttgcagatttaaagctatccattgcctgccggttctcggcacagcaaagcactaatagggtgtttgactc

SEQ ID NO: 67044 - DNA, 56 bp, Heterodera glycines; identical to SEQ ID NO: 52733
  Genomic contig location: Contig_ID=SeqID_38138; Location=790..845; Strand=+
  SCN-specific regions: Sequence locations=1-56

SEQ ID NO: 67045 - DNA, 151 bp, Heterodera glycines
  Genomic contig location: Contig_ID=SeqID_38139; Location=40..190; Strand=-
  SCN-specific regions: Sequence locations=1-151
atgacttctcactttctcgtcggcgctgcagccttcggggcgggaatggtaagtgtttttttgttgtttttcgctccaaattttacatataaaacaaattttttttcaaattttcagtgcttcacgaagacgtacatggagaaaccgaagg

SEQ ID NO: 67046 - DNA, 708 bp, Heterodera glycines
  Genomic contig location: Contig_ID=SeqID_8123; Location=844..1551; Strand=-
  SCN-specific regions: Sequence locations=1-229,252-684,706-708
atgatttccgtccaattttcccccatcgttttgctgctgcttctgctcactttgctgcacctttcttcaccggccaatgctcgtccccaatggtattacgccgacccaatttcgatggccaacaatcgcggcactcttttcgacaatttgtggggacggaagtgatttggcactcagaaagaccaacaaaacaattgtcaatttgtgcataatattgtgtaaagttttgtttaattttgttttaataaatgccattaattcatccgtttaacttcaaaaaatgattcattctgcaaaacaatttgtgcaaaaaattgtctaatatttttcactatataagaagaatctacccctctaactcatttaaaaactaatttaacactttctagcgagtttgcggggcgcgagtggtgtctatcgacgcagtttttcaagggctattagggaaaataagcacattcctattggttaagaattgttcgaactgcgttcgaaaaacgaggcaaaaattgcactttttttgatgaccaatttttgaacgctttttgcatgtcttaaaacgggtcaattcaaaaaacaaatatgtttatgcacatctacaaactcttggctttcgaatgataccagggttgttttggtccgggtccgggaagagctctaaaaagggatttcaagcacttttggtcgggattttttccaaaaaataaa

SEQ ID NO: 67047 - DNA, 348 bp, Heterodera glycines
  Genomic contig location: Contig_ID=SeqID_8123; Location=1290..1637; Strand=+
  SCN-specific regions: Sequence locations=1-11,34-269,300-316,339-348
tgaattaatggcatttattaaaacaaaattaaacaaaactttacacaatattatgcacaaattgacaattgttttgttggtctttctgagtgccaaatcacttccgtccccacaaattgtcgaaaagagtgccgcgattgttggccatcgaaattgggtcggcgtaataccattggggacgagcattggccggtgaagaaaggtgcagcaaagtgagcagaagcagcagcaaaacgatgggggaaaattggacggaaatcattttgtagaaaataaaataattaattaattaattatttgtgggaatttaaatgaatttgttgctgtttttgttgctgatgatgattt

SEQ ID NO: 67048 - DNA, 161 bp, Heterodera glycines
  Genomic contig location: Contig_ID=SeqID_8124; Location=5..165; Strand=-
  SCN-specific regions: Sequence locations=1-161
atgatttccgtccaattttcccccatcgttttgctgctgcttctgctcactttgctgcacctttcttcaccggccaatgctcgtccccaatggtattacgccgacccaatttcgatggccaacaatcgtggcactcttttcgacaatttgtggggacggaa

SEQ ID NO: 67049 - DNA, 1085 bp, Heterodera glycines
  Genomic contig location: Contig_ID=SeqID_8124; Location=2691..3775; Strand=+
  SCN-specific regions: Sequence locations=1-611,633-1042,1064-1085
atggcaccgcctgccgaaaaaaagaaaaagcattcctccgccgaccaccgcctcattatttctgcatcaattggtggaaagaagcaacagcaaacgttgggctcagttattacatcatttggaaaacgacgaagtctccgcgtggccatgaaagagaattgccgaattttgaggaaaatgtgagcgccgtttcattttcaacttctattggcaaatgaaaagctttctttttgcatttcagttgggtgtgcaacgacatttggatggacattttccctcattttgatcgtcctcaactcggcctcaaaatggctctgctttcgccacgtttcaatgcgttggtggacaaacatttcgatggcataagccaattgacaatttggaacgcaataacaattcacaggatcggaacaaaagcgaaattggttgtagaggagaacaatgccaaatttccactgcccgaccatccgctgcgcaacaaaattcgctttaattaccttcgaatcgagtaaatcaaacaaaattcaaaaaagaattattaattgataaaagcatttgctgctttcaggtacattgactattccgtcatcacatttcttcgtgccaatcagcaaatttttgacaaaggcaccgatttgaatttgtttatgccgtactacgaccatgatgacaagaatgtccagccaatttgggatgattttgcccgtgcaatttggcccatttttgcaccaaacattcgccatttgtccttttccgatgcccatgcttttggcaatttgcgtcgccacatttcgccaacaattctcactgatctcaatcagttgaattcaatcgattccgattatttgttgcccgatgtgattggtgatgatgggccaaatgcaactgctggtcaagcgctgtccaaatggttgcaaattctgggaaaagatggaaagccaaagcaattgagttgtagcaattattatcatgcagctatgcctactatcaatgaatggatcgtcaatttcaaagaggtcaaaaagggactaatcacttttaattggcctttgttttttggtttccaattaaaatatttgcattaa

SEQ ID NO: 67050 - DNA, 90 bp, Heterodera glycines
  Genomic contig location: Contig_ID=SeqID_8124; Location=1031..1120; Strand=+
  SCN-specific regions: Sequence locations=1-90
ggattatttttcaaaacacctcgtagactgggggataattggagactgcgggataatagagactggtctataattagagcatatacggta

SEQ ID NO: 67051 - DNA, 815 bp, Heterodera glycines
  misc_feature (36)..(36): n is a, c, g, or t
  Genomic contig location: Contig_ID=SeqID_38147; Location=17..831; Strand=+
  SCN-specific regions: Sequence locations=1-325,347-378,410-675,709-815
tgcttcaacaggcgtttctccttctaggtcgtgcanggaagaagagaagaggagggcgggccctttcgacgggcgaagccgaccgagagaagggccaacagagacaaacggggccacacgcagcgcgacgagagaggggaaaggcccggaccgaagcaagacggacgacagcgaaagcaaccggcaagaagggcaccacaaaccaagaacgaaagacagagggacgaaggcgaccagacaccgcccaagcgcagaccgcaaacgacgccaaccagcgacccgccggcggacccaggcgcccaggcggggagcaacccggaaacgaaagcccaccggcgccgggggaagcatgcacgcaaagcagaaacccaaaggaacagacggaagggcaccaccaggagaggagccggcggcacaaaccgacacaacacggggaaacccacccggcccggacaccgcaaggaaagacagaaagagagcacacgcaggacgcggcggaaggaggagcacggccgcccccagagcgcggagcgaaaagacaggcgaataccgagaacgagcgagacacgagcccaccaaaaaggcggcacaacgccccggagggcacaacaacagagagggaacaccggcgcgcagccgcacgaaaccgagcaacaacaggccagcgaagcccaaagacgaccggggctgcacgcgcgctacactggcaaaatcagcgtgcttgtccttccccgaaaggggttggtaaaccggtgaaaatttgccgtgattgggatcggacattgcaattattgtccgtgaacgaggaattcctt

SEQ ID NO: 67052 - DNA, 516 bp, Heterodera glycines
  Genomic contig location: Contig_ID=SeqID_38148; Location=189..704; Strand=+
  SCN-specific regions: Sequence locations=1-35,80-404,428-516
gtggcaagaaaagtggaagtgaggcgtaaacattcaaaaaattgaaaaaaaattaataattaaattttttaaattttttccagacacaattccccccggtgaaaacggtgcgcagagaatgcacaaagatcgcagcttcatgcccatgcgggtatggcagctgtgtgtttgtcaccaggaagcaaatcgttgacgtttgttgtgccggcccttacgagtttaagtgctgccacaatgtgaggaatgccaattttggcgtttttatcacatttgaaatgtgccgggtcaccccaccaagggattatgatggatagaactggattttaatttctcaaacataacccattattattcggagcaatttaaaaatcagccacccatcacatgacgggggatcagtaacgcaaatgttttcctaattacttccggcctctctctggtcccatgcaccgactcaaagtgcatacaaaaaattgtaaaaatattcgctggcatgggaaataattttatggctaa

SEQ ID NO: 67053 - DNA, 471 bp, Heterodera glycines
  Genomic contig location: Contig_ID=SeqID_38149; Location=455..925; Strand=-
  SCN-specific regions: Sequence locations=1-471
atgtggttattatcctttcgcctgaccgggataggatcgtcgttcaccctatttctgagaaacgtgatgactcaacttaccccactggatctggtactcgatacgctgcagcaggtcgtcgccagcccggagcaccggccgacgcagctcgccgcccgtttcagcgcagactaccgccagcaggtggatggcaaggcgctgaacttcgagcagtttgagcaacacatggcgctgctgaagcggcaaacccgccgcatgacgctgagcgtgatcgcggcggcggagcagggcgaggcggtgctgacccaccatctggtcgagctggaaaagtgcgatggttcctgcagccgcgtgcgggtgctggcgcacttcaccgtgcgtgagggccgcatttgcgcctgtgacgaactgaccgagctgttggcgggctcccccggcgatcgcgatcttggctcgcgcgtgtcggaatga

SEQ ID NO: 67054 - DNA, 1721 bp, Heterodera glycines
  Genomic contig location: Contig_ID=SeqID_8125; Location=621..2341; Strand=-
  SCN-specific regions: Sequence locations=1-88,110-293,320-368,390 -605,627-758,780-869,891-1524,1546-1721
  Gene Ontology: Mol. function=ATP binding; Cellular component=Golgi cis-face; Biological process=cell communication
atgcgccttttggacctcttcgctttggccacggtattcgcgcatttcttctaccgctctgtgcaaatcgtcaatcgaagtttgtttggcttttaggattgactttttcggtttcattttcaaaaattccgccggattatgcaccgaatgcatttgctggtcactgtcagtgatgtcgtcatcatttgtgcacatcgaagaagaagcactcgtagaaaaacctttagtatccatttgaagtttcccaaataataatcctaaacgaagaaattggaaaagggaatatttagggaatatggaaaagaaagaaacaacataatcttgagttaaataaaggcaaaagtgcagttaaaagataaaacgaagagtaaagccaaaaataaaactgacgcagaaagcgcacataaaaatgaatacacagcaaaattcagcgaattccaaagcaaaagagaatcgaattaaagtcaaatgaatgagacagcggcacttggcaatgcaatgcttaacaaaagaacgaaagattcacttttgactttttgggcatcagagaaagcgacataaaaattaggaaaagagcagaagaaagtcaaggaatgcgagcgaaggcgacggctaacggacagaaagaccacaactcggtcgggaattgaaagggcaaaaaaaaaacaagcaagaatatacaaaaaaaaaaaaaatcacttacctaactaggtacctattccttttccttatttttaggaaaaaaattaattacctagttttatttttataaattttatgccaaaaaatgatttggcaaatgccaacgcaatcgccaaagttaaaaaacagccaagctaaaaaaagacgatgcttttttttgtctacgttgctttcttgtttcattttgtaaatttttatttgaagtacctatttttattgacaggttaaggcattgcattgtaaacatatatttttgatcttttgacttcacgtgccattacgtatggaatctctaataccgatcattaataaacttcaaggtgtcccaaatgatacattattaaataactcaaaattttagatgtttttgctacaactggatacaaagaatcggaagtccaattgccacagatagtcgtcgtcggttcacaggtttattgatagatttttgattaatttcattgagaattactcaaataatgaatgcgtctaaattgatacgtttgacagagtgccggcaaaagttcggttctcgaaggaattgtcggcagggatttcttgcctcgcggaattggcattgtgactcgtcgtccgcttgtgcttcatcttcacttttgtcctgtcgccgatcctttacgtgtgcaaaaaggaggtttcataaacatatttaaggttttcgtggcttattctatacaaaattaagcgcctacccacgaagactgggctttgtttggacatcagccaaacgaagtttatgctgacttccaggcactcacaatagcaacagattttgtaacaaattattcgaatttcagcaagttcgtgaggagattgagaaggagacggagcgtgtgaccgggtccaacaagggcatttctccggcacccatcacattgacaatttattcttctcgggcggtgaatttgtcgctgatcgatttgccgggcatcacaaaagtgcccgttggagaccaaccaccagacattgaagttttgaactcgctctacgatttaatctaa

SEQ ID NO: 67055 - DNA, 623 bp, Heterodera glycines
  Genomic contig location: Contig_ID=SeqID_8125; Location=2427..3049; Strand=+
  SCN-specific regions: Sequence locations=1-485,527-623
  Gene Ontology: Mol. function=type 1 serine/threonine specific protein phosphatase inhibitor activity; Biological process=energy pathways
atgaatattcttgcgacgcatcatccgcccgataaggactacggacacatgaaggtgaaatgaagtttaactattttatcgaactttgtcttaaatttaagatcgatgagccaaagactcctttcaacaattacagcgacagtgagggcgaagaactcacttccggtggtggaacttctcgaccgcgaagggtgtcgctggttggtgcggtggatgcggacgaattgcgtaaaactatttcggggggcacgcggagccaaatgaaagtgttggacccgccgggttcgggcgaagacgacgaggacagcgaaagtgggatgaccgaagagcaaatcggtgagtgtaatttgagcactggacgagaaaaataaaagcagaattcagtagctatgagttaattactaaatgaattccagtaaaaaagcgtgaattcgaaaagaagcgcaagacgcactacaacgaaggcgcctttctaaagaaaatgcgggagagagcagcgaaggaagaggaggaggaagacgaacagtgatggagaggaaaggacggaagatggagaagacggattgatatacttattggagtagcccagaagagaggggacttaactcaaaccattgaagcaa

SEQ ID NO: 67056 - DNA, 828 bp, Heterodera glycines
  Genomic contig location: Contig_ID=SeqID_8125; Location=3577..4404; Strand=-
  SCN-specific regions: Sequence locations=1-326,348-540,562-579,602 -654,683-828
atgcattcggccggactcagtccatttgtgaaccattggagcaaagtgaccaaatccaagcgaaagcaatcatttttataaaattataattgttttaggtgcacaatttcacccctgagactggcaaatgccatttgtccccccacggcgtcgttttccaatccgccgccattcacaatttcccattggccgaacgcctcaacgattttgtcgcccattcgccgttggtcgaccggtggaaattgtgcattggaaatgcaaataattcgccactttttgtggaggaaaaagacgaaaactgtcaaacaactgacaatgagaaggtaatggtgaaacagaaacactcaatgaaaaaaaggaatttgtctttttaggacaacaatgtcttggttctgttacaacccgtggacggcttcaaccccggcctccgtttttatgccgaatccgtacaaatggccattgatttgcgtggcctgggaagactcgtggcgatgcaggacatcgacctgagggcgggagagtgggaagtgttgttgtgccaaaacaagcagcaaaagaaaaagcacatgacaaatagtaggttttcaaaaggaatttatatggcaaaaaaatgccttaagtggaggggagtacaatttcttctcccaattttcgtaaataataaaattattttaaaatttttgatggagtttaaattaacttttgtagtttttttttattttctcaaggaaaatttttttgttttgaagaaaacttaatattaaaaattcagtgtgggaaaacgacctgctacccaggaataacaagggaaatgaaattgtaaattaa

SEQ ID NO: 67057 - DNA, 96 bp, Heterodera glycines
  Genomic contig location: Contig_ID=SeqID_38154; Location=365..460; Strand=-
  SCN-specific regions: Sequence locations=1-96
cggtacaatgagagggtgaaacaatgcgtgaaggagtcgaacgtggcgcttgaaagtgattaccgcgacatttcaaacgatggagaaggacgccgg

SEQ ID NO: 67058 - DNA, 868 bp, Heterodera glycines
  Genomic contig location: Contig_ID=SeqID_38158; Location=184..1051; Strand=+
  SCN-specific regions: Sequence locations=1-114,156-245,278-379,402 -520,551-771,793-803,831-835,863-868
atggtcattcgtccgtcctctgttcaaatgcatccgccgctgcacaacaatcgcttccattccaaccaattttcgtttgccgttgccgctgagcagtgccaacaaccgccgatgaacggcggcggcggcacacagccgcccccggcgggaggcgcccttttccaacagccgttccctccggcgccgccccgcgggacggaagccgcggcacagattgaacagcaccaaatgatgctcatccgacaacaccagcaacaacagcagcagcaaatgctgctccatcagctgatgctgaggggcgaagttagccttcccccgcaggggcgtccttctgcccaaccgccgcattctttcccgccaaatccccacaacaattaccaacacattgtgggaggtgaataaaaaagggcctgttggagagagtttcgccgtgcccatttttaatcgagagtaattagcgtaattagcacagactactgagagggggttacgggcaagagtatctgctgcagtattctcgctttttctttcctcttctttttgtgttgtgtctttggcttaattaccgcattgttttagaactgacgccgcccccctctcagccgtccctcggcggactttcgtccccccaggccaacggcaacacgtcgtccgcggcactgttgttgaacgggttcaacccctcgtccaccaccgcttccgtatcctccggctacaattttcattctgtcggcgatctccaccatcccaccaccactgccactactgctgtctctgcctctgaactgctccaacggcagtgccaacaaatgcttttggccagacaggcagcggctgtcctgcagcaacaacagcagcacaagtcgat

SEQ ID NO: 67059 - DNA, 564 bp, Heterodera glycines
  Genomic contig location: Contig_ID=SeqID_38160; Location=350..913; Strand=-
  SCN-specific regions: Sequence locations=1-564
atgcttttaagccccgccgtgaggcgggacagttccaaaattttgtactacattttactgtggaaagtccaagtaccttattggacaactacgtgtcaatgagcacagtcgcctttggcctgttgtggaacggaaaatggaaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttagcttttaattatgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaatggaaatatcagatggggtgcgctcttttctaaaaattcctcttttcgtctaaccatccctcccttttgtgcactatttcgtttcaaaattgaatcatttttttttgtcttttgaaataaa

SEQ ID NO: 67060 - DNA, 441 bp, Heterodera glycines
  Genomic contig location: Contig_ID=SeqID_38160; Location=685..1125; Strand=+
  SCN-specific regions: Sequence locations=1-277,299-441
caattttgaaacgaaatagtgcacaaaagggagggatggttagacgaaaagaggaatttttagaaaagagcgcaccccatctgatatttccattttccgttccacaacaggccaaaggcgactgtgctcattgacacgtagttgtccaataaggtacttggactttccacagtaaaatgtagtacaaaattttggaactgtcccgcctcacggcggggcttaaaagcattgtacagcgtaattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttgtatatttttcacaatttatttcaaaagacaaaaaaaaa

SEQ ID NO: 67061 - DNA, 478 bp, Heterodera glycines
  Genomic contig location: Contig_ID=SeqID_38161; Location=382..859; Strand=+
  SCN-specific regions: Sequence locations=1-288,312-333,375-478
atgaatgttagaagcttcaaacaaagtgtagaaccttttttaagtcagcaaaaacaaagttatttgactataattcccatccctaattggtgatattgaatctcattaaagtcccattaaattctttttcaccacaatatataagtgattgattgattgcgtaatgcttttttttaattctccatggcataaattaaaaaaggcattttcttttcaaagaaattttagctcaaattgtagtatttatgcctcagaaataatttaattttcgcactaagcgtgctgtttcttgttttttgaaaaattcacggcccaaaaacagaaaagtaaacgaattttttaattttttttatataattaaatttaattttttagcttggaatatcgcacggcatttcaaaaagaatttgcacttttgttgaaattattttgcgagagttcttcttattctgcggttgcccacaacagcagtaaagaa

SEQ ID NO: 67062 - DNA, 976 bp, Heterodera glycines
  Genomic contig location: Contig_ID=SeqID_8127; Location=297..1272; Strand=-
  SCN-specific regions: Sequence locations=1-3,99-308,347-356,379 -854,890-976
atgaaaaaaaatatttataaaagattggtaatatttacaaaatatttataatatttattgacaaaacttcaaaatattgaaaaaaaaaatatttttttcaaaaacccctattttttattgaccaatagccaactgctgctggcttttgtgaggttgtgaactgatgagactctgccgtggtataaagaggatatgaaaatattttcattcacctattttattggttagccgacatttgcggaccgacatttgcggaccgacatttgcggaccgacatttgcggaccactatttctcgatagaactgtctaaataaagaaaaaaataataagaaattttaataaattcaatattcccaaattgaaattagtgaaggtaagctgatgcaaagcgatctgtctcaattggagagaagtcttatttgacataacttttttctttcttttttatagaatttctaacttataattaaactgtgaaattggcgaaaaaattagctaaattaaatataaaagtcagttcaagaattttataccaagaaaattttttatcttgtttcacttccacgctttagttaaccgagagcttaattttttccggcatgtcaaaccaattaaattaacaaacaaaaactaaaatagtttatctttttctcaaaattgtccgtaatttgctgttattaaaactatgggtccaaaattaaaaatgagcaactacatactatatttatctatggaaactaaacttctttaaaaaatgggttctttcgatattgattgcagaaagttgatcaattactcttgaagggcgatgttcaacttggtaaaaatcacaaataaaactacttagtcactcaatttttgaaaaaattattatttttttttttttttgacagttcaacccagaaatagtggtccgcaaatgtcggtccgcaaatgtcgcactacgccaaaaagattgaaaacgcttaaaataaa

SEQ ID NO: 67063 - DNA, 1163 bp, Heterodera glycines
  Genomic contig location: Contig_ID=SeqID_8127; Location=1645..2807; Strand=-
  SCN-specific regions: Sequence locations=1-18,40-664,686-773,819 -954,980-1163
atgaaactctgtttattattcttttcaattgtatttttaattgctcaaattgaaattggagcggaaaagaaaaaattggaacaaaaaacatttgaagaaatatttggagaaaaatgggaagaaaaagaaaatgaacagaaaaagagagaaattgttcaaaaattcaacaaaattaaagagaaaattaagcaaaaagagagaaaatattcaacaaaagaatggcataaaattgaattgaaaatcggaaaaaaattgggcacaaatcgaaacaaaatttacaaatggatcaaagaattaggaatatacaaaggccacaacaaatcaaaaacggatgtacaaaaaattgaaattgtgcaaaaatttaatgcaatgaaaaatgagtataaacaaaatggaagaaaatattcgacaaaagaatgggacaaaaattatgcagaaatttgtaagaaaattggagttggccatgatttaattaagagatggaagaaacaatttggaatgggtgaaagaataaatgagaaagaaaaaatggagaaaatgaaaatgtattggcaaatgaaaggagaaaatccaaaaatgagtgactcaaaaatttcaaaaatattgaaaattagtcaatggaccattttcaattggaagaaacaatttgaagaagaattaaatgaggattaaaaaacattgaggagataaaatatcttttcatttattctttttttcacgataaataacatttattttctttttacatttttaggaaaaaaatttatttcgcgaatttttataatttttatttatcttaaaaattattttaaaaaatagatttctattagagcccggatagaacatgatcttgtcatgatttgcattcactcaactttttgcttcgctcctaatccaaggccttgtcttcatatttgttttttaatccctatattgtatagccttacatatttttgatttttcttaagataattaagattaaaaaaaggtaacataggccaaaagaatcattggaacttgacacgggaccgccttttgcgttgaagtacagcagacagatgcattttatgaagcaatattggaacagcctaagaacgcaaactaaatacacgcctaagaatcgatcccaacaattttcagaaaatatacccctatgaaataaa

SEQ ID NO: 67064 - DNA, 2316 bp, Heterodera glycines
  Genomic contig location: Contig_ID=SeqID_8128; Location=649..2964; Strand=+
  SCN-specific regions: Sequence locations=1-231,265-694,716-997,1019 -1062,1091-1142,1170-1232,1254-1520,1542-2162,2184-2316
atgttcatttctttaaattcttatttctttagcaatttaaaaatgtcaaacttaaatcctggtaattggtggtattattttgagcgtcaaggcaaatcaactgctaaatgtaaagccgatggatgttcctactcaaagacattaaatgcttctctcagtacaacagtgcttgcttctcatctcaaaaatcaccacccacaactttacaaacagcgtgaagattgttcaagcagagaagcaaaaaacagaaaagaagggacaaagtggaataaacccattaaaaagggcttttgcaaatgcattttatggttcaagtcaacaaattactgatgacgaagaaaaggaagcgccgatttcatcaaaatcacctattttaattgggctaaatgcaaaaagtatgatctgattttttttctatgcgttattacattttgattaaggccagtggagcacggacggagacgcaacaattggcgcaaatcgggcactaatggaaatgctggttactcaattactgccatttaatctcgttgacggtgttggatttcgacaattcgttggaaaattacagccaaaatacaaaattcctcggcgcaatcatttcgctcaatatgaattgccaaattgttttgaagcgatgaaagtaataatcaaatttgcgctttcataattctaaaatttagaaaatagtcactgatgaatttctgtcagttaacaaaatcgctttgactgctgatgggtggacttcaaaggataatcgccattctttgatttcagttactgggcattttttggaccaaaaattcaagccaaaattttttgttttgagcaccaaaccaataaaaagtttttaatatagtcagagtttgaacattttatttttcagggcgacacacagctgaatcaattgtgtcatttattagagaagcattaaatgattttcaaattcaagagcagaaaatttcggctttgacgcgcgatacagaaaatacgatgaaaaaggttggaaaggacttgggttttgtgtcagtggattgcgcagcgcatgttttgcaattggtgataaaataatttaattaaatattaaaaacaagaattttagtgcattaaagagggactgaggtcaattgaagaggaagaacgtttaaaaaatctttttgaaaatgtcaaaagatttgtaagaaaggtgcgaaaatcaagagtgttgacggaacaactcgctgaactccaacaaaaggaggaaattgaggaagtaccaccaacagttttgattaaaaatgtcgaggtgcttttcttctatatttaactattcttataaaggaaattaatttcaggtgcgctggaatagttcatacaaaatgattgaacgttttatcaatttgctgtcaattgaacattaccagcttccaaaatttaacgctgatgattggttgcttttgtcatctattaaaagcatactttcaccaatttacgaggccactgttcttttacaaaatagaaattcctcttgttcaattataattccgctttttaaagtcagtattaattttctccccaatttattttaaaattcaggcaatttcattcggtttacgtgagaacaaggacaatcgttattcaaatataaagaaaacaattgcgaatgccatcgaattgcggcttaaacaagccgaagaacaaaaaaacctagttcttgcaactattttggacccacgttttaagaccatttaccttgacagcagtcggctgaatcagtacaaagactggttgataagtgaagttgagagttaccatgcaaagactgatgtgattttattttttctatttttgtaacttaatttttttaggaaattgatttacaaattgacgtaagagactgcagtggttcaagttcggctggggatattttttctcgttttgaaaaggacgcagaatttgagcaaaaatgaatactgtaaataaactttatatacccctcataataattaatttaaggcaacatcccccagtccatctgccttggagacaagacaaaaagccgaagttgaagtaaatgaatatttgcgggatccaaaaatcaaatccagggccgatccatcattatactgggaagtcaattcacaaaaatggccaatgattggtgacgttgtacggaaatttctttctccacctgcaacaagttcagaaattgagaggcttttctcaacggccggtctaatttcagatgacttgcgaaagagtttattaccagaaaatattgcaaaacttttgtttcttcatcacaatttgcttgtaaccggtttctcaattgaatga

SEQ ID NO: 67065 - DNA, 533 bp, Heterodera glycines
  Genomic contig location: Contig_ID=SeqID_38164; Location=242..774; Strand=-
  SCN-specific regions: Sequence locations=1-56,83-164,210-210,236 -391,418-533
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatttttattcatctcccttttgatagaaaaagcatcagagagccttatttaacttttaattaacatttggtgcgtttcagagcactttctgaaaaaatacttatgaattaattttgcaaaaaata

SEQ ID NO: 67066 - DNA, 434 bp, Heterodera glycines
  Genomic contig location: Contig_ID=SeqID_38169; Location=80..513; Strand=+
  SCN-specific regions: Sequence locations=1-270,293-333,355-434
atgccttcgcatgagtttcagaatattaaagttaaaaacagaccaaactttgtcgaacagttcaacaaatgcaatgtgttctgtcagcagagtgaagctgaagaaaaggcgtcgcgaccgattgagcgcgtcacggaaaatgcgttcggttggtgccgtgacattgccgttgttgttgcattgttgcaggaacagtgccgaagaggacggcgcatttagcacatcgtattgggcagagggggtacaaaggacgtcgtaatgggccgaaaaagtggaggcaattaacaaaagcaatggcaaagacacttttaggggtaaacaacaaccattggcgtggtttgttcatccgatgtgacttcgcaaatggggccaacgacctcggaacagtgcgaatgtctgttgccggcggagaggcggtcgtattggggccgtga

SEQ ID NO: 67067 - DNA, 309 bp, Heterodera glycines
  Genomic contig location: Contig_ID=SeqID_38169; Location=668..976; Strand=-
  SCN-specific regions: Sequence locations=1-153,176-309
ggagccaaacgcaactcgggaaaggcttggacgattcattgccaccgatgcgccaacactccgcgcaacaaacgaatggcgaaaggaaagggacgaggaaaaccgacggaatgacaagcggaggggaaagcgaagaggtaggctaatcaaaatatatcttgtaaaagccttttttcattttcagcattgcccttctccgtcttcgccgcaaaatggcgacgctttcgacccgtcccattcgcttgcgcctccgccgcttccgcctcgaacgccgaggcaaaatgcggcacaatgttcaacagaaagtga

SEQ ID NO: 67068 - DNA, 52 bp, Heterodera glycines
  Genomic contig location: Contig_ID=SeqID_38171; Location=391..442; Strand=+
  SCN-specific regions: Sequence locations=1-52
gctttagaggtaaaaaaggctaatttagctgatgggggacgttctaatagag

SEQ ID NO: 67069 - DNA, 1727 bp, Heterodera glycines
  Genomic contig location: Contig_ID=SeqID_8129; Location=321..2047; Strand=+
  SCN-specific regions: Sequence locations=1-291,313-528,550-717,751 -982,1052-1249,1271-1328,1350-1562,1602-1684,1706-1727
atgggcatttcccagttgctccttcaattgcgacaacgttgtctgccctattattcatactctaaaagtgatcaaaagaatcatcatcatcattttgcactcggtggtggcttgttgctgcttttactgcttgccatcggcacttttgaaagcccagtgccattggtggcggtgccatcggcaacgaccctaatcattggcacaatggtcaccttgtttttggcttcccaagccgatttcatctaccggtcatggctgaccttggaacgggatttgacgtatggaaaaagcatttgggctttatttaaaattcgcaaaactcatttttcgaaaatcggtaaacactgatttgaatggttgtgaccggaaatgatcagtgcaaaatgcgttagtgaatcataatttcttgaaaatgagatactgagtagtatgatgatttaaaatttaagcgtaaatcatctgggaaaaagcttaaacaataatccaactacagtatattcagtttttccggatttggctttttcaaaattttattaaaatttttggacatttgaaaaaattaaacgaagaaattcagaacaagctttttatataattttaaccttttttttactacaatagctaatgctacagaactcactgaagcattttccgggagcccaaattgaccttaaacgaaccacagaatgtgatacatgatccgatcttaattttctgaaaataataaatttaaaaaatgtttaaattattcagcggcctttttcttctgatcaaaattcgacttgacatgaggcgacggatgcgagagaacaaaggcatacaacagatctttgttgatgtggtaaatgccgttttcaactggcacattatgttttctaacaaaaaactagctatgggaatttgaaaagatattcttggcattgttgaatattttcaagggcacatccgttaatggatttttactttataataattgggactgtaaattatatattaaaaaaaaatcgcaaaaatagcatataaaaattatataacttaaaataattttttagctatttaaaattgatataccattatcaaaaaatcaatttttgggggtacatttttcaaaaaaaaaaaaattctttagaatttttaattttcagccctaataataaatcatgaattccctttaggtcaatgcaaacccgaatggaatatgtgccatcgatatggtctgagacacattaactaaattgtttatcccaaatttttaatcttcttttttaaattaagacatccaataaacagtacacattccgcgaatttaatgcacttgccaatcgttttgccaacacttttttacaaaatggttaccgcagtggcgatgttgtggcacttttcatggaaaatagtgccgaatttgtagctggtcagtctattattattgtagaattcaattaattgttggaatataattaatttagcatggattgggttggccaaaattggtgtcgtaacggcatggatcaactccaacttgcgcatggactcattagtgcagttaattattttttgcaaacaattaaataattttatttattttttaaatttatttatttctaaacgtaaaattgtttaatttttcagctgtcttcgcgtttctgaatgtaaagcagttttatgttctgacatacttaagccaagtaatcgtttataaaatagttgacataattcaaatttaaaaa

SEQ ID NO: 67070 - DNA, 953 bp, Heterodera glycines
  Genomic contig location: Contig_ID=SeqID_8130; Location=445..1397; Strand=+
  SCN-specific regions: Sequence locations=1-91,122-174,222-288,331 -441,518-562,584-772,795-926,949-953
  Gene Ontology: Mol. function=transporter activity; Cellular component= extracellular space; Biological process=transport
atgctttccacaattcggccaaacaatccattgttggtgtttgacggttatttgaaccaagaggagacaagtgcgtttttgattctaatctatgtaaaggatttttattattgtaaccatttttaaatctgatcagagattctgatcagattaattcgattaattctttggtacaataattaatctataatttttttaaaaatttgttgaaaaaaatatttgttttccagaaaaaaaagttgttcaaaatgtgttccgccatggggacagtgcctttttaactggtacaaaaaataaataattatttaaaaataaatatttttttaatttgaggtgacattcttcactgggaccgtcttggttatttgtattttcgaattcgaactggtgacacgttccgattcaagggtgaaaatgttagcactgctgaggcatgttttcaaatttatttatattttaattaaataaatttatttaattacctaattggataaattcaaattttatttttaaattacactcttaaggttgaagctgtccttctcccgttgaaatgtatcatcgacgcggttgtatacggtgtacgtgtacttgagcttgatggaagcgtcggcatggcagcattggtcaaaaacgacgaggcaggaacggacgatgtaagactgagcagacctgggacattaaaaaatttttttttggaatttagggattaaatggtttagcaaaaaaaaaataatggatttagctcaattaaaaaataagtgcccaacaaattttatttttaaagaaatttcttcgagagttgagtgcccgtcttcatgccaaccttcccgcatatgccattccacgattcattcgtatttgcaatgctgttgatagaactggtcattgttttcaaatttaaaattatggaaatcgcaactagcataaattaattaatttgaaaatcttaa

SEQ ID NO: 67071 - DNA, 173 bp, Heterodera glycines
  Genomic contig location: Contig_ID=SeqID_38174; Location=679..851; Strand=+
  SCN-specific regions: Sequence locations=1-2,24-56,81-173
atgctcctcctcctgcgcgttctgttggctgttgtgttgcgtgtcctcctccgagtcggctgctgctgctgcggcggcgctattagaacgaatggtgtccaaccggcgaagcaatttgcccatcagcgacgtcaacagttggaagccgccctcgttgccaaactgtgccaatt

SEQ ID NO: 67072 - DNA, 90 bp, Heterodera glycines
  Genomic contig location: Contig_ID=SeqID_38177; Location=793..882; Strand=+
  SCN-specific regions: Sequence locations=1-90
atgtgccgcgaattgaacggcggcgtacggcacaacacgcgcgagagaagcggaattgccgcgaaaaagggctacaaatccttgttcccg

SEQ ID NO: 67073 - DNA, 348 bp, Heterodera glycines; identical to SEQ ID NO: 62244
  Genomic contig location: Contig_ID=SeqID_38178; Location=236..583; Strand=-
  SCN-specific regions: Sequence locations=1-1,24-160,190-348

SEQ ID NO: 67074 - DNA, 381 bp, Heterodera glycines
  Genomic contig location: Contig_ID=SeqID_38181; Location=229..609; Strand=-
  SCN-specific regions: Sequence locations=1-381
atgtgcccaaaagaattggtggagcagcgcaaaaaggaaattgagcgcggattcaacaaaatgatcgaatatttggagggcagcaggtgacaaaaaacagcgagcaaattggtgcaatttgtctcccgcttcgtaccccccccccccccccacttaccattcctccgaattgcaagttcaagaaaatgtagaaaatttttttgatgaaatagaaaatttaaaaaaaattgttcgaaactttttttattgtcttttgtgaaaagcagaaaataagaagaattattataaaaatttgctggatttcaaaaaaaaaaaattctatgtaaaatttttagtgaggaaacggaaactccaaaaaaatattcgaattttttaatttaa

SEQ ID NO: 67075 - DNA, 486 bp, Heterodera glycines
  Genomic contig location: Contig_ID=SeqID_8132; Location=2279..2764; Strand=+
  SCN-specific regions: Sequence locations=1-239,261-486
atgtttaacgcaatatcgattgctcaccgcagagtcaaaccgatgcttcgccattttgctgcgcagggatccatctccttgattgttttgctgtccggcagcatagacgaagatgaatgtgttgttcgtgtcgttatcgaagtagtcgcgccagactggcactttgtccaatacagcttcctgctgctcccacgccctgttttcggttgcccatccaccctactcctcttcctgcgttgccctccatcttcctccttttcctcgcggggtgtgaagctggtggggtaccgtatcggccagggtcgacagtgcctcaccggtggatcattccaaacccggtgttattgtttgtttggggcggggtgtgaagctggtggggtaccgtatcggccagggtcgacagtgcctcaccggtggacatcccaaacccgttcacttatgttcgggagtgctggattgcggcaagctgacccttcggcactctga

SEQ ID NO: 67076 - DNA, 523 bp, Heterodera glycines
  Genomic contig location: Contig_ID=SeqID_8132; Location=2802..3324; Strand=-
  SCN-specific regions: Sequence locations=1-494,516-523
atgggacaaaacggcattcaggagcagcaactactccgtgacgagcgcacgcaaaaacgaaaagtagaagaccaattctatttttgcaatctgtcggcagatatgaaacgtgtgtatagtccaggcttttgcggcctgctctgcaaccatccgagacattctgatgttttggatgtaaggatgagcatttttgcttttgtcgaggtataattgctaggaaaatgtctgtgtgccagaaaaattgcgtttttagagcatgaagggcaccagcggcgaatactggcatattttgacgcccaagagcaaacggaattttgaggctgacatcggcaccactccgacctttctccaacccgggggaaagacggtgaccaccatcgccttaggcaaatatggccagggcaatcctgagccggtggccttgcgaccgaactattggctggagaccagccgtgagcgaaagcccgggctcggttactttcaagaatcacgctggaaggtctatacagcaaatgacctttaa

SEQ ID NO: 67077 - DNA, 335 bp, Heterodera glycines
  Genomic contig location: Contig_ID=SeqID_38182; Location=4..338; Strand=-
  SCN-specific regions: Sequence locations=1-93,115-152,203-248,270-335
atgtgttcaaaatttcttgttttaaccatgcttttgcaaatggcactggcaaatccctttggcacaaaacaatctgtaacagtttctggacacctcaaatgccaaggaaagccaagtgtcgggacaaaagtaaagctgtacgacaatgaccgtaaatatttaaaataatttaagaaattaataattttcaaattttttttttgatagattttacaattgatgatttgatggcacaatccaaaaccgacaataatggacatttcaaaatgagtgggacatcaaaagaaattgcgaacattgacccaaaattgaatttgtaccatgtgagaaattaa

SEQ ID NO: 67078 - DNA, 267 bp, Heterodera glycines
  Genomic contig location: Contig_ID=SeqID_38183; Location=85..351; Strand=-
  SCN-specific regions: Sequence locations=1-15,38-38,60-267
tacaaaaataaaagtgattttgggattcgggaccaaaggggggtgacaggatttttgattgaaaaatttttttcaccaaaaatcttccaaaaacatgtcattagggctattttatgacgctgatcacgaatacgtgatcagattttacttttgacatcgtcaagacctcagaatccctgtgtgattggggattctgaggcatcattttgaggggggagggggcaggttcggatccggacggtgtaacattatttttctgtgcatttt

SEQ ID NO: 67079 - DNA, 295 bp, Heterodera glycines
  Genomic contig location: Contig_ID=SeqID_38184; Location=1081..1375; Strand=+
  SCN-specific regions: Sequence locations=1-295
atgaaggtcagcttcaatcagtcttttcaaaattcacattttcttaaaatttagctctcacaacttttttctgaggtgtcaaattgcttagaattcgcttagaaaaaattctccttttcaaaatcttttttagatatcaaatttgttcggtttagttgggaatcaagcgaattatggttggtcaaaagaaactgcaaaatggcaataatcagtgtaatttttgaattagcgtgcaaaaaactacgccaattacttatttggcgtatttaaattgcattcgcatagtgcccgataa

SEQ ID NO: 67080 - DNA, 126 bp, Heterodera glycines
  Genomic contig location: Contig_ID=SeqID_38186; Location=370..495; Strand=+
  SCN-specific regions: Sequence locations=1-126
aaaaacttcgtgcttcgagcttcgaaacttcgcggtttttgggcttcgaacttcgaacttcgtgcttcgaaaaaaattgggcttcgccttcggcttcgagtgccgagccgagcttcgcccgtccct

SEQ ID NO: 67081 - DNA, 246 bp, Heterodera glycines
  Genomic contig location: Contig_ID=SeqID_38187; Location=679..924; Strand=+
  SCN-specific regions: Sequence locations=1-107,134-216,238-246
atggagaaggacctgcaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaatatttatgaattaattttgcaaaata

SEQ ID NO: 67082 - DNA, 76 bp, Heterodera glycines; identical to SEQ ID NO: 51235
  Genomic contig location: Contig_ID=SeqID_38187; Location=323..398; Strand=+
  SCN-specific regions: Sequence locations=1-76

SEQ ID NO: 67083 - DNA, 136 bp, Heterodera glycines
  Genomic contig location: Contig_ID=SeqID_38188; Location=273..408; Strand=-
  SCN-specific regions: Sequence locations=1-136
atgatgggatcgccaaatgcagctcagacgcttgatgggctcaacaaagtgggccatgacgaattgaagaaaatggcaactgctcaacgtggcggtgattggatcggaacagtgacaattgggggacaacaatttg

SEQ ID NO: 67084 - DNA, 590 bp, Heterodera glycines
  Genomic contig location: Contig_ID=SeqID_38191; Location=214..803; Strand=-
  SCN-specific regions: Sequence locations=1-417,439-498,520-590
ccggccccctggtccccaaatcaccaacatttttgcctacggtatcagttcggtgccgactgtttcggcgccgccaactttgaaatgccacaacatttttctttgccagttcacgtagcaaatctgggcaccatttgatagcacaatttgtgctatttgtaaaaaaaaagttatggcatgtagcgctgaaaaagctatgaaaaagtcaattttttcaccatattttttttgtaaattgatgaaattttttgaaatttagcttactaattgtgaaccttaataactatcgcatcatatcaaaaatttaatttggtttataatgaaaaaagtcattaccaactgcgccgaactgggcgtttcccttccatccaccggtctttctattcctcagtttttttattaagctctccaacctcttcattttttcctcattttcccctcattttcccctcaaaaattgaccccccccccataaattgttttctgatgcccattgatcacaatggcaaataaattaatgcgcattgcttttgctttcactccaaattcaatggatgaatagtgcgtgaattatctattatattattctc

SEQ ID NO: 67085 - DNA, 559 bp, Heterodera glycines
  Genomic contig location: Contig_ID=SeqID_8134; Location=311..869; Strand=-
  SCN-specific regions: Sequence locations=1-209,232-354,376-559
atgatattgcatacagaaaggcggtcgatatgctccaaacgtcatggcgtgccatctccgcaacagagaagaagacgaaaaacgacaaatgaacaaactgccaaggaggtgaagaagaacgtcgagaacgagttggaagagaagggccgagaggcgttggtcggtgccattttccaagcatttgttcgttcagcttaaacattgacggtaaaaaacaatcaaacaaattttcggtttgtgaaaagtcatccccattttcagatccccagaaggcaatgaagacgaacgaagatgcgtaggacattgcccagcagaaaatgcggccattgcatccgattcgccctggagtgggagtggcgctcaatttctccctttttctgcacggattcatgaaaatgccggaagagggtcgcaaattggctcaaaaggtcgtggacggagccgaacaaaacttttaactaccaatttttcatctcccaattttttacaggcttacgacgacgacagaaatgctgagctatttgacggagtcggctcttatatggtttacgccccataa

SEQ ID NO: 67086 - DNA, 1688 bp, Heterodera glycines
  Genomic contig location: Contig_ID=SeqID_8135; Location=75..1762; Strand=+
  SCN-specific regions: Sequence locations=1-9,31-737,759-1197,1219-1688
atgtcgggaagagacgcagagacagagagaacagcagtgaaagaggagggcggaagaggcaaaaaggacagttcatggttggatgagagtgagtccagagaaagagtggaatggaaaagaaaggtgtcgagggggaaaaagcgaaccaaaatatcgccacaaaagcgacagatgagaaagaaagtagaggaacagagaaatgcagcattaagtgatcaggaggagagccgagagagtgaccaaaacagagaaacaaagaaaaaatgggtaaaaacaagcgcaggaaaagtgccaaaagggcaaccacagtacagtacccacgctgagaaagaggcgcaccagcgagacggtacccaggcagacacaggagaacggaatttgtcattgcaacaacaggcgaatgatgctttaagtcagcagcagctgacagaaacagaaaccgaccgtcctatagacggacaacagtacggtagatttgctgtccgtactgtaaaagggcttccgaaatggcgacgggacggtattctgacagaggcgagcaaaagcacagaatcggaattcgaaacggcaccatcaaaaagcgaccgccaccattacgatacggatggaacacaacaacttcggcaagaacaatcttttctgagtggtgccagcacagaattgtccgaatttttggtcgaaagagttcgaccaaaaaatgagtaccgccgttacggtaacagtaaggaaagcagtgcagaagccatggaaaagagcccccgacacggaattggcatgacaaatcacttaaatctatcatcggacgaaatcgaaacggaccaatctttggagagccatcgctttcatagcaccgaaacggcaagccattttttgagccgatcggaacaaaaagaaacggatgataaaaacagcgccgggtggagaatcaggacggtgaaaaaggggggagaagtggtgccaacggaagaagatgagcagaaacaggcacaatttctgatgagaaaaactgaaagtgggacggaaggaaatttcggaataatggccaaaagtgatggccaaaaatggggggacagccaaaatgccaacgatggagcagacaatgagcgcagaaaagagcagcaggaggtaaaacaattcaagaaataatccaaattttacctaggtacaaaatgtgtacatgacaattaagtcaagggataatctgcaatggtttaatgaaagcgaagcagattgccggaggaggggtaatcactggcccgcttctgcccctcctttatgggcactcgccgcctctgcccctccttatgccaaatttgccctgctaatgagtccatcccgttaatggaatattcgttccataatcagttgttgttcagctgttccacttggccaatgctcaaccggcactttggttaaatgagtttggcgaggtgtcgcacagcaccgaccaaaggggtggccaaatgggactgccacactctgacgggtcgcgagcaatggccgaatgtcgcggttgggaagatgttcatcgagccataaaacggttcgtcaaatttcaactggcaaaggaagcgaaagtcgaacaaaaggatgattcatttttggccaaagttgcaattcggccacggattttcacccaaaagaggcaatggacggtcaaaatgccgaagttccactggtttcactga

SEQ ID NO: 67087 - DNA, 123 bp, Heterodera glycines
  Genomic contig location: Contig_ID=SeqID_38192; Location=126..248; Strand=-
  SCN-specific regions: Sequence locations=1-77,100-123
atgcaaagaccgataatcgtaaatataattgctctcgctaatctcggtaccggaattaaactaaactctctgacgatcaccgaatgcgaatttaagtataaccctagaaaattcaatgccgcg

SEQ ID NO: 67088 - DNA, 478 bp, Heterodera glycines
  Genomic contig location: Contig_ID=SeqID_38195; Location=75..552; Strand=-
  SCN-specific regions: Sequence locations=1-478
  Gene Ontology: Biological process=locomotory behavior
atgtgcaattttgcatcacccgacatggttggtcacaccggtaaatatgagccgacggtgaaggcgtgtgaagcgactggtacaaatccacacttttgtttctcatttttagatttaatttcccctaattattaaagatgtggcaattggacgcattttggaggcatgcagaaatcacggttatgtgctgttggtgaccgcggaccatggaaatgcggagcaaatgaaagcggatgatggcggcccacacacggcacacacgcgcaacaaaggtcagttctcgaaaagcattaattttgaacactcgttcatttttttttgcatttttcagttccgttcacctgctcttccgctgcacactccttcaaaagtgcgccgcccaccactgcggagggtgtgccccgggcgcgggcattgtgcgacgtggccccgactgtgctttaccttatgggactgcctaagccggaggagatggacg

SEQ ID NO: 67089 - DNA, 794 bp, Heterodera glycines
  misc_feature (98)..(99): n is a, c, g, or t
  Genomic contig location: Contig_ID=SeqID_38197; Location=112..905; Strand=-
  SCN-specific regions: Sequence locations=1-345,367-481,503-634,661 -743,786-794
tgtccgtttgggtactcaaacaattatggggagcaaaaatccaacgcagaattaaagtacagactatagggaagctaatcccgaaggattcggtctcnncataaatctgggcgcatcggttcggggggactgccccgaaaacaaaaaaatcgattttttcaagtgtccgtttggggtactcaaacaattatggggagcaaaaatccaacgcagaatcaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 67090 - DNA, 639 bp, Heterodera glycines
  Genomic contig location: Contig_ID=SeqID_38199; Location=233..871; Strand=+
  SCN-specific regions: Sequence locations=1-132,155-639
  Gene Ontology: Cellular component=small nuclear ribonucleoprotein complex; Biological process=mRNA splicing
gtgcgactcaacccaccagcatttcaatcactgggactcaacccaacagcatttcaatcactgggactcaaaccaccagcatttcaatcactgggactcaaaccaccagcatttcaatcactgggactcaacccaccagcattccaatcactgggactcaacccaccagcatttcaatcactgggactcaacccaacagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactc

SEQ ID NO: 67091 - DNA, 757 bp, Heterodera glycines
  Genomic contig location: Contig_ID=SeqID_8136; Location=1354..2110; Strand=-
  SCN-specific regions: Sequence locations=1-55,84-296,318-757
atggctgacgagaattggaaaggatcgataggtgatgggaatgttgggataaaatgcacaggaagaggaggaggaggcacggatttggggattgatggggcggaagaggtcgttttcggaagaggggtaattaggaataattgagaggatgatgatgatggttaacgcatggataataaaatgggtctcgggatttgtgtcgagagcgaggggaaaggcatggaaatgggtgatggtgatcgcgagtagcaagtgggtgacacgagagtcaaccacactgggaggattaccataataaaatgggacaaaaacattttgtgatttgaattttactcaattttcgaaattaaatttaaaaatgccactacctttgttatttgattgagattttgacatgccccacatattcaggcacggatacattttatatactgtccgatcactgctgatcaattactttcagagtcaatcaaaatcggcttacacctaacaagttctaaatgaagttagatcagtcactgggattaaccaaaaacgtggcatttgatcaagcacaggcactggtacaattcaatctgttgtccgctccgatcactattgattagtgcgtaccgtcgggactaatcgacggtgcgagagcgatttgtcaaaaatggcgacgcgaccaaaagcattatttctctccaaaaataatcatcgctaattatcacaatataaacgcatccgtccgtccgcgtccaacgaatttacgaataaa

SEQ ID NO: 67092 - DNA, 369 bp, Heterodera glycines
  Genomic contig location: Contig_ID=SeqID_8136; Location=4295..4663; Strand=-
  SCN-specific regions: Sequence locations=1-55,77-369
atgccggtcagccaagcaaattcttggatccctttggtattgtcactggtcttgagatttaggggtataaaaatggttgataaatatattcgagactcaatcaaaaattgcagagactcgacacactgaaagcaaaaatttctcgggtcgagactctcgagcagcaaattttaaagaaatatatcggtcagagcagttcaaaatttccgctctccttaaagatacagctcacaatcagtaatttttcctcaaaaatctgccgctattttatatacagatatatggtagggacgtaaaaattgcatttttttcccccgaaatttgggacgaatggtcgccgggaaccaattaaattggcaaaaaaataaa

SEQ ID NO: 67093 - DNA, 1401 bp, Heterodera glycines
  Genomic contig location: Contig_ID=SeqID_8136; Location=4753..6153; Strand=+
  SCN-specific regions: Sequence locations=1-126,148-212,234-294,317 -521,568-711,734-1097,1127-1172,1194-1200,1224-1401
atggacaccatttctctgcaagtactgctcgcatttgcgatgtttgccaccactgcgttggccggactgcttccgatcaaagtgatccgaaattattaatcgtggattttaattgagagaatttttagaagaaatttattttgtatattataggactgctgataatcttgaccaattttgattaggaattaatggatttttacaaaaatttaacagaaatataaattttaaaaaatcgaatagaataagcattaattattttaaatccaattttaatcaaaacatttgatcagaattttaattaattttcagcttcttcacgcgatcacacgtcgtcaggacgaaaatgatgagcagcggagcagaaaatcggattacattttgacgcttttgtcctgttttgcgggcggtgtgttcatgagcacttgcttcctggacattttcccacatattaagttagtttccgcttatgaatcccgattacattgtctggatatgtcttcgagagtcacgagacaaggattaaaattttaaaatatttatttaaaaattgaaataatttttatacaaaaatgtacgcaaaattccgatcagaatgtttgagttcgacatttatgtcaacaaataatgatccgatactgaacagcaaacaaatcctgacgatccccacttatcccccatttttcagcgagaattacgcccatttttggccaagtcccagtggaacaccgacttcccattcccgcaattctttgtctgctgcggctttttcttggtctattttctggaggagatttgcctaaaagtgttcgcgtccgcaaaacagcaccagcaacacgcgcactgtcacaacggtggccatggcggccattctcatggcaacagcgaagggtagggaaaaactggcaaaaaattttgaattcgaaacgagaaaaacatttgatggaccttgccttgccaccagaattggtttcattttcccattggaggtcctattttccaaatttatggtcctaaatcctaatcctagattaattttgtcggtttttggatttttcgaaacgaatacccctaataggcacagacaaatggtcgacattttttaaaacacaaatttgatgcccaatttttggtgcaaaaagcacacagcatttttgagcactagtgaaatgcacaatttgaaaatttcaacactaaattaaaacaaaatcataaagaaatgagctaacgccaaccaaaaaataattatatgtctgatacggtaaaatgccttaaatttctgctaattcgatcatttacagcaaatctcatcatcatcatcggcatggccatgaagagtgcaataatgagccgctgaaaacaaacgccggcagcgacaaaaaagggtcgaatttagggaca

SEQ ID NO: 67094 - DNA, 254 bp, Heterodera glycines
  Genomic contig location: Contig_ID=SeqID_38204; Location=410..663; Strand=-
  SCN-specific regions: Sequence locations=1-133,155-254
atggtcgggggactttcgtcaacaaaagtcgcaaaaagtcggaaaaatcttaataaacttttggcattagggcgccggcgatgcaggtaggcgccgccgggaaaatgttgaaaaattagattgcaatttgttaactgattttcaccaaataacaatttttgcgattttgagcgaaatttttaagaaaaaaacatgtttttagggtccagcggtgccgataggcgccgccgttttgggcaagatttgttaataaa

SEQ ID NO: 67095 - DNA, 552 bp, Heterodera glycines
  Genomic contig location: Contig_ID=SeqID_38206; Location=73..624; Strand=+
  SCN-specific regions: Sequence locations=1-108,130-297,336-552
gatgaagatcctcgaacccgaccagcaggacaggaacctgtacaggattttctcggatctgatccgtatgctgtatgttttttgttaaattcaacaagaccagcgacctgtttagataatatttttcatcataattcagataaatccagagaaaaatatgaaaaatcccttaacaaataaggaacgaaactaagcattcttaatgttgaaatcactaagttttcttatttctctacaaaatttccaaatttgttaattttcaataaatttaaagcaataaaagaaacttttgtgagcttttttgctcacaaaattttaaaaattaactaaaaaatctttttggcggatttaagaaacgccttatcactgccctcattgaataagcttttttagaccgaagaagactctctgcaattctttgaggaacaagaacggcaaattgcgctgcaaattgcacaggaaaatggagagaatgagcagcagaaagaagcggaagatgatgctgaggatggacaggcggaagaacagcaattggaagaggacgaagaagag

SEQ ID NO: 67096 - DNA, 103 bp, Heterodera glycines
  Genomic contig location: Contig_ID=SeqID_38207; Location=517..619; Strand=+
  SCN-specific regions: Sequence locations=1-103
atgaatacaaagaaaaaagcaaatattcaagaaaagaatggaaccaaaattattacgaaattggcgagaaaattggagttagccgatagaacaattaccaaat

SEQ ID NO: 67097 - DNA, 928 bp, Heterodera glycines
  Genomic contig location: Contig_ID=SeqID_38211; Location=54..981; Strand=+
  SCN-specific regions: Sequence locations=1-398,420-521,543-561,683 -728,764-928
ttccaccaacattggacccgatgaggttggacattggcaacatttatgattggttcacaaatccacttccatatcaggtcatttgaattttaaaaattatcattccgtaatctgatatgtagatcctgaactgagatttcgatattgagacaggatttttaaattttatgaaaatttttggtaatcatcgcaaaaaatttttcaaaaagtttgcaatcttggctttgatttattttgaataaaaacggcaacagtatgccaaaaatgcaagttttgtcaactgatcgactaccgccttttttggcattttcaaaaccgggatttttcgttattggttatatcgaattttattcatatttgacatgctatgaaaataatatggaaatttgagatgagaaatttttcaagtttttcattgagaatttttgatcttgagcgcaaatcccgaatcagtaccgaattcctgttcaggcttgaattatgtaatagttaaaaaatcgagatgcacaccgctgatgggcaataaaatgtttttaaaacctaattcatttcaataatgagaaaaaaatatcattaaataaaaaaaattaagtctatattttttattatgtttcaaatttaatacaaaaattgtttgaaatttttataccttttatgaatattttttatttttaattaatttgttcaccaaaattgcttgatttttttatagtgagacgaacaacttttatttttctaagatattttaaattaatattaggttatgccaatctcgtggtacccacggaatttcacgaaccctgaccttaactacttggatcaatatgttcggatcagtgacgacacattgtacgctgttcaacttggcttatatgtggtcggatacaaagagtttcaagatgaccaggtgagcctaattacttaataa

SEQ ID NO: 67098 - DNA, 713 bp, Heterodera glycines
  Genomic contig location: Contig_ID=SeqID_8137; Location=372..1084; Strand=-
  SCN-specific regions: Sequence locations=1-159,181-713
atgcgatctatgacaattgatggatcttttttttgttcaattgtttatgatttgtcttccgccatttttgcttcttttacaatgaaatcaacagttagtgtcactttgtcctcgcttttgttgtaaaagcctttgctcgggtccatcaattccttaattacctcataattggaagaattaagcaaaaaattgaattattcctcaccgaaaatttaatgaaatttttaaatccccagtcatataattcaccgttaaaaacatggtctttaaattccttcctgaaatcccaaacaccgtccatttgcggcacaattcggtaaattgccgccgaacatttgcaactccaatttttgtcttaatggcaattaattactttttaatatgaaaagaaaaaattgagagaaaaaaaaataaaatctcataatttataagagctcagactatccagtttctttgccctgctaccaaaatagcgagaaatattttaaaaaatgacctaaaacgggagaggaaaggagataatttgaaataaattatttttgttcattcagcaaaatattttcaaattgattggtcaattaatgcttctggtcatttaattgtcacacaccgtaaaagtggtaaagtgtgggaatcccgagctgttcgacgtgttgttaaaaacttcgccattaaaatctctactcaaatccgccacttcgctctttaataaa

SEQ ID NO: 67099 - DNA, 541 bp, Heterodera glycines
  Genomic contig location: Contig_ID=SeqID_8138; Location=518..1058; Strand=+
  SCN-specific regions: Sequence locations=1-106,139-352,374-472,494-541
atgtccaaaccgttggctgaacgaatgaagcatttgttgagcgcgggagaggacgcggatgtttattttttggtgggggacggagacgcaaaagaggcgagtcttcaaattaaaaatttaatttattaattaaaaattggaaatttagtgaatggtaatttttgttgtatttttttaaatttaatccgcttaagcttgtgccagcccatagaatcattttgaagttggcttccgacgtttttgaggcaatgttccgttttgacgccaaaaaagaaagaccggaaaatggtaaaaaaataataattttaagggaaaatgccaattatgctatttgttcttcattttgtctctgctaatttccctaattaatttttcaattagtttctggtaattgtcctgatgttgtggagatacctgacattgaagcagaagcgttcaaagtgatgttgagcttcatttatacggatgatttaagtgatttgaatggagaaaatgcaatggctgtgctttacgccggtggatttaattttatgtgacaaaa

SEQ ID NO: 67100 - DNA, 279 bp, Heterodera glycines
  Genomic contig location: Contig_ID=SeqID_8139; Location=90..368; Strand=+
  SCN-specific regions: Sequence locations=1-69,117-279
atgaaagcactgacaaaaatgagaaatggttgggcttttctctttggtgcgatgcttctgaagaaggtgtaaaattactaataattaatatatatattaacaacaattaattaattgatattgagcagaaaattggagttgcaaatgttcttcaactcttcgaattgtttcgcaaaagcgcggcgttgcggatttcagaagaaaactcgatgaccatgtttttgacaataaaaacagaggctggggatacaatttcatttcatttgctgtgagtgacaa

SEQ ID NO: 67101 - DNA, 573 bp, Heterodera glycines
  Genomic contig location: Contig_ID=SeqID_38212; Location=43..615; Strand=-
  SCN-specific regions: Sequence locations=1-573
attgagtggcagacagggaatatggtgcggattgagcttccatcatcaaatgtcaccaacccccacgagcttagcaaaaatttatacaggctcctgggtgagggaagtgatcccttggcaaaaaaggtacgctcaacacagaattctttcatgcttgcaacaaataaggctcgccgctgggccagagaagagtacattaggcgaaaaacgaaagaaaaactgggcgtccgtgacgaagagctgctcctacaggccctaatgacagatactggaccattggttggtctcaacaccgtgacgcaaggccttctggcacgcgaaaagcatgctgaaacaagcaatatcgcgttgagaacgccaactgacgataacgattcgtaccagaaaaaattggatgactacttttctaaattaagtgagaaaaatttgagcattgttgatgaattgggtatgataaaattgaaagccgaaatcaaaaatttgacagaagaggaacgtgtgatcctcgaagccacaaaggaaatgggaacggaaggatggattcaatcctaccgtgagattcgtctagcttgg

SEQ ID NO: 67102 - DNA, 178 bp, Heterodera glycines
  Genomic contig location: Contig_ID=SeqID_38213; Location=237..414; Strand=+
  SCN-specific regions: Sequence locations=1-13,35-178
atgttttttctacttttttatttatttttattttcggttccgaaaacaaatgcagaggtaagtaaaatttttacatacattttgagccaataatgttcttaatcctataaaaattaaatttttttcagaacattgagactttggtttgaattgtaggattagaaaatgaaatattata

SEQ ID NO: 67103 - DNA, 370 bp, Heterodera glycines
  Genomic contig location: Contig_ID=SeqID_38216; Location=439..808; Strand=+
  SCN-specific regions: Sequence locations=1-144,166-191,213-370
atgccgcaaggtaaatttcaaattaaaacttaaatcaaattttgggatgttaacctgcttaaaaatttggagattaattacctcacagttaaatgttttttaaaaaaattcatcaaattcaagctaaataatttgaataaacccaagataaataaaatatttttagaaaaattccgacggcgccgaaaaaagcgccgcgatgaactgcttggaacgattatttcaattctgattatgttaggccttatgatagccctacgatgggttatcctgtttatcttatctcgtagccagcagctgaatgccgcaaatgcgagatgggcactaagacttccagcccaaattggagaagctcgtgaattttaattta

SEQ ID NO: 67104 - DNA, 1396 bp, Heterodera glycines
  Genomic contig location: Contig_ID=SeqID_1065; Location=45..1440; Strand=+
  SCN-specific regions: Sequence locations=1-368,390-1017,1039 -1182,1204-1221,1244-1325,1348-1375
  Gene Ontology: Mol. function=transcription factor activity; Cellular component=nucleus; Biological process=transcription from Pol II promoter
tcgccgggactcaaccctccagcatttcaatcaccgggactcaacccaccagcattccagtcgccgggactcaaccctccagcatttcaatcactgggactctatcctccagcattccagtcactgggactcaattctccggcatttcaatcaccggcactcaattctccagcattccagtcgccgggactcaattctccagcattccagtcgccgggactcaaccctccagcatttcaatcaccgggactcaacccaccagcattccagtcgccgggactcaaccctccagcatttcaatcactgggactcaatcctccggcattacaatcactgggactcaatcctccggcattccgaacactgggactcaaccctctagcatttcaatcactgggactcaacccaccagcagttcaatcactgggactcaattctccagcatttcaatcaccgggactcaatcctccagcattccagtcactgggactcaattctccagcatttcaatcactgggactcaattctccggcatttcaatcaccgggactcaatcctccagcattccagtcactgggactcaattctccggcatttcaatcaccgggactcaatcctccagcattccagtcactgggactcaacccaccagcatttcaatcactgggactcaattctccagcatttcaatcaccgggactcaatcctccagcattccagtcactgggactcaattctccagcatttcaatcactgggactcaattctccggcatttcaatcaccgggactcaacccaccagcatttcaatcactgggactcaacccaccagcatttcaatcactgggactcaatcctccggcatttcaagttttttgtttacatttcggcacaacatttggcattttcctcgtctttacttgtttctggcattttcttatggcacacgtctcttttctctaccttttcttccctttttttcattttcttatggccagacatttcttctcaatattttaatgacaaaacaattttaaaaacttcttacttggcaaacgttaatgccaaaataagtgtaaacatatagtcatttactaatcaaagcacaaatcaaattcaaagtcgagctttttcctattacaaaatgaaaacaattcaaaatcttttgcttcttcattttttactaaacaaaatcaaaaacacacgtctctttaactataaaattcttttctctttaacaataacaaattctttaataccattaacaaattcaaatgaaatcgcaaacaaaaaaacattaaataatgtagaaaagtaaaggcaaaattttctcacaaacaaaaacaggaatcaaaaagaaccattttcctctttcttttattaaatattttatata

SEQ ID NO: 67105 - DNA, 225 bp, Heterodera glycines
  Genomic contig location: Contig_ID=SeqID_1066; Location=3367..3591; Strand=-
  SCN-specific regions: Sequence locations=1-107
atggccgcaaaagcggtgaaagaggcggcactgtttggcgacgaaatgggcaacaaaagggtgcgcaatgtggccgcaacaattctctacacaatgccattgaaacgggaggaggaggaggcgaatgatgagggggaggagggaggaaaagaagggcacggcacagcggaggaaacggaggaggacgagcagaacaagcaaatgttgaaggaggaggaggaggaa

SEQ ID NO: 67106 - DNA, 719 bp, Heterodera glycines
  Genomic contig location: Contig_ID=SeqID_1066; Location=1632..2350; Strand=+
  SCN-specific regions: Sequence locations=1-306,333-719
gaccaattgctgtcggagacggatgtccacctggacactctgttggcaccgccgctggggcgtggcctcttttacatgtccaaatttacgttggcgcgaaagcgatggaaacaatcgccggcggagaatgaaaaagttttggaccgttttgaagtcagttttacataataatttcattttgtttttcgtttgacattcgttgctccccccccccccctccaatctgtaaaagtctgtgtaattcgttggtcgtgaatattacatcattgtgcagttaaaacccggttttgactatttttttaaagaaatcaaaaaaacaattttatttgaaacattttatgacttttgaaaaaaaaatcgaaacgggaagggagcaaacttaactgtttgttacccattgaatatgaatttttggagaggaaaagaggggaatgaaattgggagattcactctccataacactcccattttttactttattaaactttcttaagcctttctcacaaattgccatattttcaggtggctcttcaacatgtgtacagcttcttcttgacctaaagaaactgcgatggcacaatttttaatatgtgatggagagacaacaaattaagagagattttttgtttgatttatatgtgcaactaaggaaaatgactctataaaaatagttcgaaaattgtatcttttttcttttttaaatataatcagtgtgaaga

SEQ ID NO: 67107 - DNA, 753 bp, Heterodera glycines
  Genomic contig location: Contig_ID=SeqID_1066; Location=5674..6426; Strand=-
  SCN-specific regions: Sequence locations=1-122,144-289,311-714,736-753
atgaagaaagtgttcgacgcctacgagaacacctacaagacgccgaagcagaagctggacaaagtgaagcagctgcaggcggaaatatcggatgagctgcgcaacagcctgaagatgaccacggaccctgaggtgctgaaggaggcgtcgttcgccttcggcgatgtgccgaccttcaccggaatcaccaagagagtgtcggtgttgccgcccaaatacttgagcatcaaaggccatgaacaatgcgtggacaagtacgtcgtgtacggttggcaccagggatggcattccgaggcctcaaaaaggtcggaaatcgaaattccgtgccatccctggttggcaccagtcgtttgggattaagccaacgtcgctcaatttgccggcagggaaacacttgtacagaaacaaatgaatgttaaggtactccactggaacagaaaaaattcggcgtcaattcttttcaatttcaattgttcacgggtcaattcgttggtcagatcaaaggccaaaacggagtcagcaaaaggcaaacgaagccaaatgcggacaatgaaattgacgggggaagaagcataggcaaacacctaaaatgtggaaaattgattaagaaaaagtaaatagcaacaaatgtatgacacttttatgattggggagtggccatgaaaacccaaagacgcgcaatttggttcgcacagttttaattaagcgaatgatcattttttgtcaatgtgtaccgtaaaattgccaaataaa

SEQ ID NO: 67108 - DNA, 136 bp, Heterodera glycines
  Genomic contig location: Contig_ID=SeqID_1066; Location=2786..2921; Strand=+
  SCN-specific regions: Sequence locations=1-136
gaccaattgctgtcggagacggatgtccacctggacactctgttggcaccgccgctggggcgtggcctcttttacatgtccaaatttacgttggcgcgaaagcgatggaaacaatcgccggcggagaatgaaaaag

SEQ ID NO: 67109 - DNA, 728 bp, Heterodera glycines
  Genomic contig location: Contig_ID=SeqID_1066; Location=9266..9993; Strand=-
  SCN-specific regions: Sequence locations=22-87,109-236,258-532,554-728
atgctgtgctgctgctttttgtttcaattgtctctgtttttattccccttcacttcagcaacaatcgccggctatgagtcaaaaggtaattaaaaattgaaaatttattcgaaacccattgaccgtccgcacaattgggcccacccattcgagactaagtttcgctcaaattgaggcaactgatcagtcagtgtccaaaatgatcaaaatgaaaaaaagggttccgtggattttgcaaaaaatattcttaaatgagaatgaatcttttttttcaattttaagctgaaatgcccgccgctgcgcctcccgcgccgaactgtgccaatttagacgagaccagcgaggccaatgccaacgggcccaacccgttctgtgtgtacccggcactgatcggagtcactcattaatcacttttgcaattgtccaaattgcacctttttaggaccacccgtcgcccgggagacgccccggcgccaccaatccgactcaattcagtggcacggcgtttaatgaggaccacggggcgggggtaaaacaaagaatttcaaaacttagaatccatcaaaattttaggagtctccggccggcggttttcaagaggcttttgagcccggcgttggcccattcaaaccggcgggacgaaggcgacgagcgacggcacaattagcgagacaaatcaattgaaaaattgggatattaaaacccgaattgtaaaattcaataataaa

SEQ ID NO: 67110 - DNA, 1032 bp, Heterodera glycines
  Genomic contig location: Contig_ID=SeqID_8140; Location=430..1461; Strand=+
  SCN-specific regions: Sequence locations=1-210,234-346,371-405,428 -532,554-775,797-1032
atgaactcgagtttggaattatttggagaagagtcagtccacgcttttgatgattgggctgaccgatttaaggactatttgtcactgacagggaaaaattggaccgaagaagaaaaggtcactcgccttaaactagcgctcaaggacacgccgagggaactattcaaagaactcaagtctaaccaaatcacgacattcaccagcgctttggaagcattgagggccaaattggactcgcctcaaagacgagaagtggcgaagcggaccctttcagtttgccggcaacgtgaggacgaaactgttgcccaatttttgagacgtcttacgccattgattgactcaacaaatccttctttaacgggtgatttgcgcaaagaaaaaatttgtgaggaatttctggaccgattaagaccaaacatgagctttttgattcgtttggtcgggcttacgcaacccaaaaatttggaaatggtaaaggcccaagcagaggaacttgaggcacttcttctcagcactggaggcggtgttacgcaaatcacacaactcatcaattcaatgacggaacaacgcggaaatgaagaaccgaatgaacaaaacgaaagaaaattcgaacaacaatggagcgacaatggtggggaattcagaaatgccacttcacatgacgcgcagtgctcgtacttagaaaacgaaaggagtgaaggtaaccaccaaaattggccaagaaggcgccacggaaatatgaaccgtagaaattggtccaattatccgacctgccaattgtgcaacagggccggacacagttcctacaactgccatgaaagaagggcacaatttgaagaccaagcaaatggcgaatggcaccaacatcgacgactaccatggaacaactggcgtgatcaggcaaatgaaatgaatgaaatgccgcaatcgacatcctctttggcacccgaattcatggaggacttggtaaaatcattaatcacactgaacttacaaaagctgaacaatacgaggccaaacaacagggactga

SEQ ID NO: 67111 - DNA, 133 bp, Heterodera glycines
  misc_feature (93)..(93): n is a, c, g, or t
  Genomic contig location: Contig_ID=SeqID_8140; Location=1..133; Strand=-
  SCN-specific regions: Sequence locations=1-133
tccggaataaattgctaattctcacataaaatgtccataaaagaattccattaatgtcgtctctatcaaatgaatgtgcaataatgtccgctnaatgttcacatgaagtgtaattgatcgaatctccgataaa

SEQ ID NO: 67112 - DNA, 756 bp, Heterodera glycines
  Genomic contig location: Contig_ID=SeqID_8141; Location=1062..1817; Strand=+
  SCN-specific regions: Sequence locations=1-674,696-756
atggacccaaatttgaccaaaattacatttaaattgcctcgctgccctgtggttacagagctctttgacaaggcagaccgatgccccaacatttatgccacagtggaggcccacagtaagcactgcgtcgcccggccgctggacatggaattcgaaaggaattccagccttgcgcagctgggccggggagaaaaagaagctgttgtggcccaaggggttgcgacagcggggccaacggtcgccaaacaatgacttccccagctccatggccttcttctcccattggccaccaacaaacaaccacaactgaacaaaatctgattttttttctttttttttctccattttacgcagccaaaacctttaaacccggccccaggttgtagttcaaatgatggacatgctcttcctccctgtgaagcgcaaacgcggaggttccgggaggcgcacagagcccacggatcatccgcgcatcgtccggcaaactggcctaggattaaaaccgtacaaaaaaaacacccaaattttgccaccattttttcatatgggccattgcaggactccaacaattgggtaatttgccggtaagagtccgtcgtttcggccggcggggcgaaccattgtgagccgtaataccattgtttcttcggcactaatccgctcacaaattcattgaaatacctatttttaataattgttcatatttcaggaaccaaaaaaaaaaccgttcaattccagcctccgattcatcagtga

SEQ ID NO: 67113 - DNA, 1707 bp, Heterodera glycines
  Genomic contig location: Contig_ID=SeqID_8141; Location=2442..4148; Strand=-
  SCN-specific regions: Sequence locations=1-189,211-297,319-383,405 -460,488-726,801-1073,1119-1296,1329-1396,1418-1663
atgccctcttttgcactgtccgacgatggaaatgaattggaacggttgaaggcccagcgaaaggcaattgacgcaaaaatagcagcagaattggtgcgatggcaaatggtgaattggggcaccgaattgacaccaaaggccaaggacaatttgaagcattgggaaacaattgaaaggttaaaagaaatgaattaattattattaattaggggtgatatttttagcttttacccccttttttaagcttcaaacgtttaaatttgagttattaatgcctatttttgggtttttggagccaattttaagttaaacaaaaaacattgagtcagtattgggcccgcaggcctatcacaattcattaccatagaaaaggcaattcagtaatagaaataataaattttattatacacctaaacatttttttgaaggactgccgaattaagggccgaataaaaaaaagtttttttttttttttttttttttttttgagctgtcattggcgctaattaaatttttgaaacacctttaattttgtactcatttttgtcagattgtacaccgacgactcgcttgcattatgttgaagcaaaagttgatgaggcgacacatcgtcccgaaaaaattggtgggtgagaaaaaaaacttaggggttttaatcttagtgattttaaacagcactaaattatgaaaaccggcttattaagaacaaaaattaggttttataggattttttttttttttttttaatcttgttaatactaaaaattaaaaatttttcaatggtatattttttttaaattccccaaaagtcgatccttaggggggtatttctcgcttttttttttttgcatttttcttttgaaaatttgccaaaaaaatgaccgaaatatgctctaaaaatgcaaaaatggtcaaatatacacttattctcaaaaacccccaaaatatttctttgtattgtgccctcaggcctcatactttactcaaattaaaatcagctttttttttaaatttctggacgaaattcacaatcggcttttatggatggttgacctgcactttgtgtacgaaagaaaaaaaaaaatgttttttttttttgaaattttagaaaaataaaagagagaaaagaaaatgttggccgtttaaaaaaggctaaaaaaaaaattaaaatttccaattttagcttttcttcgctcgtcccgtggtctttgaaggcatcgtgtccatttcgttttgtatccgatgtgccggatttctgctttttggtcgcccaatttcaggtttgcataaatcggggaaaaatgagaaaatgaataaaaatgatttaacatagaggggcattgaacctagcccttaaaaaaaaatagaaaaccaactgagccatgattttattgaattttaatgatgcatttactgagcacggaaaattgatatgagggaaagaataggtataaaaatagaaacatggctttcagcaaggcatcaggtccaagctgttcagagagaaaattttttttttttaagcatttccttctatttcaggtcatttctgttgaatggttcggcgacgattatgatggctcaaattgaatggtgggcacagtgaaagaagaaaaatggcgagaccagagaaattgaagataaatgaatttataaatgatggttttatttatttatttttaaaatcatttttaaatatttaataaa

SEQ ID NO: 67114 - DNA, 271 bp, Heterodera glycines
  Genomic contig location: Contig_ID=SeqID_38224; Location=136..406; Strand=+
  SCN-specific regions: Sequence locations=1-117,139-271
atggcactttcctcgctgatcgaattgggtaaaaatcggcaacaaactcagcgagacgaggctgaaaatggcattgacaatgagtaggcaaagattggcttacaattagcgtttaattgtcatttatcttttcttaattaattgcagcgattgccgtttcgatgggtccgtcgccgtttcgtcgccttcggtcatttcgtcgacttttgcggcaacaccagcgaactgttctgccgaaacattccaatcgcacgccaacggcacacacaat

SEQ ID NO: 67115 - DNA, 153 bp, Heterodera glycines
  Genomic contig location: Contig_ID=SeqID_38229; Location=596..748; Strand=-
  SCN-specific regions: Sequence locations=1-153
cacaatgtcgctgagcttcgccgcgtgcacgtcgatttgggggagcacagagtgggacagttcagtggacaaaccggcaaatatgagtacaatgcggagaagcaaacgatggaattcgaaaatttggaagtcgagaaggacgatggcttctga

SEQ ID NO: 67116 - DNA, 1569 bp, Heterodera glycines
  Genomic contig location: Contig_ID=SeqID_8142; Location=883..2451; Strand=-
  SCN-specific regions: Sequence locations=1-331,384-384,413-478,502 -505,537-584,662-923,945-1313,1336-1537,1559-1569
atgatgggcagaagagggacaaatggaagacaaacgcagccaaaggaggaggaaaagcgggtggagacggagcagaagaagcaacccccgggggacgaggggacgtacggagggaccggtgagcagacgaagacacccagcaaaagcacggcatgccattggaattttatttagcgaaaaatgccaaagatgcaaattcgactgcgaaacaacgcaaagattcggccgtttcggagtttcttttgacggtggaacaacagcagaaaaagcgcattcgcagcacatccatatgcacggcacaaatgaaagcggcggaatgtcaggttggcacggcagagaaaaggacaaaaagacatttttggaagggggaggggagaagatgaacagatcaggaggaggaggaggaaagtgatcaatcagaccatgagaaaaaggggtgataaaattcggcatttattgaagaacaaaagaaggaatgtgaaaaagggggaggagaaaagatgaacagatcaggaggaggaggaggaagaaagtgatcaatcagaccatgagaaaaaggggtgataaaattcggcatttattgaagaacaaaagaaggaatgtgaaaaagaggggcgagagagagagagagagagtgaacagataacaaagagaaggaaagcaattgaacacctgtaattcttctaatcactgattagtgctattctaccattcctaaggtgatcgccaacctctcctatcaacacgcactcgccggcgatggtctcaaaaacggtcgcaaattctcctcttcgaccgcaaatgggggagcgatgcccccactgacgcgactgcgcattcagcaatgcttcagaaacgcaaagtcggtgaaaaggagggacacggggcatacttaaagcgaaacatttgccaattaacagtccattaaaatttaattaattcttttctgtgtttcggcattttctggccattctccgcactttcgttctgttcagacccgtcattggtccacaaattctgaaaagagcttctgccctccgtgccgaattcaaatcgttcattggccatttgcaggaagaaaaagcggacgaattggcaaatgacattttctcgctgatcactgaatgtgtggcgaacatcgaattgccatccaaagtcgccgccacttcgttcgcttttggcgaaatgcatgcccaactttgccactttggctttcggcccgagtttttttccaccatcgccgacgcgacaatcgccgaatgtttgcgattggacgcggggacgcagaagcgatgtgaaacattgtgagcagaaaacagcaaaacaaatgaacaatcaaattaatatggaaaatgacacaacgcaaaaaaagaaaaacggaaattgaaaaaagggaaaaaatgccaaaagaaatggccaatttggatggaatgcccttctccgtttttcaggttggcctggtctcagctcatgcagtttatgttttccaatgtccgtgatggttattatgccgaagtgcgccaacagcggcggtcctcacttccgcagcagcgattattgttaaaacag

SEQ ID NO: 67117 - DNA, 283 bp, Heterodera glycines
  Genomic contig location: Contig_ID=SeqID_38236; Location=138..420; Strand=+
  SCN-specific regions: Sequence locations=1-283
gtacctcttttagacgaagcgtcctaatttccctacaaagtttgaaaacgggcgcgaagcgcccgtcctgaggccgcgaagcggccgaatatcccccaaaaaaaattaaaaaacgggcgcgaagcgcccgtcatgaggccgccaagcggccaaatgttctcaaaaaattaaaagacgggcgcgaagcgccagttcttaggccgcgaagcggccgaatgtccccaaaaaaattaaaaaacgggcgcgaagcgcccgtcctgaggccgcgaagcggccgaatatt

SEQ ID NO: 67118 - DNA, 437 bp, Heterodera glycines
  Genomic contig location: Contig_ID=SeqID_38237; Location=150..586; Strand=-
  SCN-specific regions: Sequence locations=1-437
aaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcatccaattccttctacaatcgcctttatacatcccattatgaacgctaaaattatcagagtgccgaaaatggc

SEQ ID NO: 67119 - DNA, 362 bp, Heterodera glycines
  Genomic contig location: Contig_ID=SeqID_38238; Location=118..479; Strand=+
  SCN-specific regions: Sequence locations=1-362
atgctgcaacgatgggtgccaaatccgaaagaagtcaactgcgtgccagccaatttcatggagccgtaacggaatgattggatcggcgtggtgggcgtaatttgcacttgattaaatcgattgatcacttgtaaattagtttaattaagtgtaatttcaattattttgcttctattttaggtttgatcacatttgcaacacatttatttttttcgtttttatttgattgtgtctgcaggcagggccgaaacacgttttagcattttccttagcattctgacagggtctgtactgatgaggcccgccctgtcacaatgcgattgcttttcaaatttagaagcaaagattactctatttgaaaa

SEQ ID NO: 67120 - DNA, 122 bp, Heterodera glycines
  Genomic contig location: Contig_ID=SeqID_38239; Location=483..604; Strand=-
  SCN-specific regions: Sequence locations=1-122
tgctcggctacgacatttcctggacaacatttaacatcattgaagtgatgtcgagcacgcgttacagcgaaaaacgcattggttatttggcggcggtgcaagcattcaatgacgaaaccgat

SEQ ID NO: 67121 - DNA, 57 bp, Heterodera glycines
  Genomic contig location: Contig_ID=SeqID_38241; Location=775..831; Strand=+
  SCN-specific regions: Sequence locations=1-57
gctatagtgaagctattccggaaggattcggtctccccataaatctgggcgcatcgg

SEQ ID NO: 67122 - DNA, 1555 bp, Heterodera glycines
  misc_feature (31)..(31): n is a, c, g, or t
  Genomic contig location: Contig_ID=SeqID_8144; Location=1..1555; Strand=-
  SCN-specific regions: Sequence locations=1-31,103-317,376-633,657 -900,922-1158,1180-1336,1376-1555
aaatcattctggtttttttagatgaattccnttaaattttaataaataatttttgtattatttcaattaacaaattttattttatatatatcataataaattcacttgggcaatattcaaaattaggctgttaattttgacaattttcatctttaaacgtgttggatgtgttgatatttaatattattaagtttcgacacgaatacttttattgattagttatttgttgatgggtcctctcccatcgactcattctttgcatttgtgttattttgcattcggtgtttattttcggactctctaatttgactccgtcgttattttattattattttgtgattctaattttattgtttattcatttaataaatttatcttgtttatgtgttagcaaaacacaacaactgccgacgcccgcgcatttttgagcttaaccgtgaattcaccaaaaagcgactctgacggtgcgagactgttcatttcctgtggacgtcaaatgttttggatgtcgaaagcaagggcacacgagaaatatttgcaccaattcagctcatccacgtgttcaatcacacgtcgtggtttcgactttcagtgtgaatggtgcgaccaaagaatggatatggattccattacaagtcaatggccaccagatcaaacttgcagccgattcgtgttcacatttgtcgatcatacagcttgcggtttggcaaagtttgggcgaaccgaggttggaaaaagttggtaaattagtgggttccttttcgggccacaaattgaagttgttgggaagtttcaagtgtgacgttctgttcagaggagtcacaatgcggcttgaactttcagtggcagacaccgaagcgccgagcatcatggcattggattggatcatccctttcgagcgtgccacccaacagccagtttcaaggcttccttcccgaaggtgtttcaacctggcttcggacattgtgtgaagacgaacgccacgctgcattttaagcaaaatgtgaagccagtgttctgcctgtcgctgcggatgacagccaaagtggaatcggagccacgatcagccatgtgtttccaaacggagtggagcgcgtcatcgagcacgccagccgaacgctcacccccgcggaacgaaattacgcccaaattgaacgagaagcgttgtctttgatcttcgctgttcaaaaatttcacaggatgatttacggtcgtaattttactctgttaacggatcataagcctctcttggctatattcggtaataaaaatgggatcccgatctacacggcttcccgattgcagcgttgggccctaattttgtccaattatgattttacaataaaattttaaatctgcaaattttggacatgccgacgttttgtctcgactgatttctgagcaccggacagactaagaagtcattgttgcccacacatcggacaacgacgtggacagcactgaagaagtcgaatatgctcttcttgtcaacttggagcagctgccagtcgatgcaaaagaagtgagcgaattgacgatttcggacgatttgttg

SEQ ID NO: 67123 - DNA, 780 bp, Heterodera glycines
  Genomic contig location: Contig_ID=SeqID_8145; Location=1899..2678; Strand=+
  SCN-specific regions: Sequence locations=1-82,121-234,280-333,373 -391,430-559,582-588,610-707,744-780
atggttaataatcaagctttgtcaacgtgttgtttgaaatgatttttgcagctacaaaaagtctttgctctatgtcttaatcattttaaatagaaattaataatttatatttaatttaaagcggtaaaagttaatgaaaattggttaaaaactagctgtatgtcatgcatcctctatgccttctcgtgccgaatgttaattaattcttgttgattagaaaaaagattttaaaccataaaaaaaacttattatatcatttaaaaaaaatgaaaattataacaaatcgataataatactaaagttaaaaacactttaaactaatgtcagttgttcaaaatttaagtaatatataaaaacaatttttaaatttaacaaatctgccgacctaaagaatataaatatattttcaaaaaaaattctaaaatataacgaatttgcttaaatgttagtaacttttaatttataaaatcactatactgattaagttagttgaaaacgaaaaattattttataagtattagcaaatttagaaaattaaaatatttgtaaacggtgtgcgaaattttctaattaaaaataatattatgctagattttaaaccataaaaatcgagccaaaaaacttattggtacttaatacgacgaaaaaatttacgcactgattctcaagaaaaagagaattattgatctgcttaacgatttaaatggaaaattatattaaaaaaaaaattattttgttaaaatctcataccgaaagccctattaaattctcatttggaaa

SEQ ID NO: 67124 - DNA, 1026 bp, Heterodera glycines
  Genomic contig location: Contig_ID=SeqID_38242; Location=87..1112; Strand=-
  SCN-specific regions: Sequence locations=1-39,62-102,136-168,226 -392,414-426,449-612,634-794,818-837,877-1026
atgcagaaaaaggatgtcactgtggtaaagaatactatgaattatttatttttaattaatagggctgggatttttaggtaaataaaaaattgattgattcactaaaatataaaatatttttttgataaaaattttggtttaaaaattgatcttattcgaaaaagtaactttaaaatttttaacaattcatttacaaatgaaaaataatcaaaattaaattttttaggttatgctacctaaaaatcgttactaataaattttaattacctatttactcgtaataacttttttgttatacttatttaaatacctactttacggtttttgcttatcttaacatcccagccttattaattaatttttcttaaattctaccctggaagtgtcatttacttattaatgcattcaaaaatgagcatttcctttaaaaataatatttatgtgtctttcagaatgtgttcgaagctgcccgtcagattttgagtgcggagacttcggttatgcagaagaatgagctgtacttcaccgattattcactaattccacttttcgtacaagaaaattatgtgaatgttcgcggatcacggatggggttttcttaacaatgtcctctaattaaattcattgtttttgcttaggaatttggaccatttgaatgcaattggacgcgccgcagatgcaattgcatttggagacataatcgacaagcaaattcgagcccatggaaattggaaccttatgccggaacatgtgattttttattttgtctttctattttcgtctttttatgataggaaaatggcaatttaaccattttcaattttgcagaggccaaaaacatttattattttatatttcataaactttttccatttgctaggcaatgttttcttctgcgcttccctccgctcggatggacggttatttgactgctcagattcaattccccgcttggtttggcaaacgttcgaccggacagaaaaggcaaagattaatgcgacaacttttgctccatacccatctaaa

SEQ ID NO: 67125 - DNA, 1285 bp, Heterodera glycines
  misc_feature (95)..(95): n is a, c, g, or t
  Genomic contig location: Contig_ID=SeqID_38246; Location=116..1400; Strand=-
  SCN-specific regions: Sequence locations=1-133,156-156,179-559,581 -830,853-1285
ctgctttatttcgaatcaacaaaattgaggaggcgcatcgagaatgtgcacgtgtgctggagaagaacccattggaccaggtgaaaagcgggggngggggggggggagagaatgggacgaaaagcaattggaaaattaattaaaatggtaaaattgaaaaagaatttggtaaaaagttcttttttccggaattctccttaatccattatttttgatatacaaaaatgttcacataaaaggccgcttggagcttgaaattggcctgcttcgcggaagaagtgttcgtggacgagttggagaacgacgaggccgggctggcggacgcgtacatggacttgggcacggcggtggccactgcggcacgccctggcacatcgctttcaaggcaaaaaatgcgaactaaagtaaatgcaagcagcgaaactcgtcattttacaggcctctgactggcacgagtgccggagggccgagtcccgcagttcggccaaggtcagtccgttgtcctcgggaccgtactactcagcttttttgaaatgagaaaactggacggtacaatcttcaatgaatttgtttattgtatttctttcttctaggactgcctcgggacgtccactttctggtaaactttgcatattttttcgaatttttgaattatttattatgaatttgtccatttattccaaatgggtgccaatgccattcattcgttaacccttccaagggatgcaacggcccgaaagccgtttgaagacgggcacccaaaacagcatggagcgcatgctgcgtacgtcgcgtacctcgcgcacttcgcggccaatctccgcggtcaccgcgcgacaagcgcgacttggcacagtttggaaacgcagcaaaacttaaatcaaattaacagcaacttaatcacaggcatcaatggttgcccagaaggacggcccgttcgtgaacatggcacggctcaatttggagaagtacgcgcgcgagggcaacgtcaacacgcacttggtagtactgtagtaccgtaattggacaaaatttgaagcaatccgaaaattaaactcttccaaagaattaattaatagaaaaaggtgctcattgagaccaattgatgatttatttagtcggtaatttaaacttgctaatgacacttatccaatgctttactttggtttatcgtttataccgtaacctttcttttccctacagtaacaagtgctaccgtatcattcttcacattttcctttagtttaattacgttttcctacacgaggctgatgctcgcagcgca

SEQ ID NO: 67126 - DNA, 277 bp, Heterodera glycines
  Genomic contig location: Contig_ID=SeqID_38247; Location=683..959; Strand=-
  SCN-specific regions: Sequence locations=1-277
atgctgttctgtggagctgtcgccggcaaaagtgatgattccgccgtcgcgcttggcgcgtacaaaagtcgccggaaaaaaatccccaaaaattttaaaatttaccgaaaattttttcaggaaatgcccaatatcatggacattgatgacaacgaatacatttcttgaaggactttgaattaatttattttgttggagcaattttttgggcggatcgttcgcggatttattgaggctcaacggacggacaaacgaaaaatccgttttttaaaataaa

SEQ ID NO: 67127 - DNA, 732 bp, Heterodera glycines
  Genomic contig location: Contig_ID=SeqID_8146; Location=5730..6461; Strand=-
  SCN-specific regions: Sequence locations=1-83,153-607,656-732
atggattgatctttctgctcctcaatcatttccatcgtcgcaattgtctgtttgctgtgcaaatgctgcttttcggcaccccgtattaaataataaaaattttaattaaagttcatttttgtttaaaaagatccatgctgtcctggcagccaacatgtcgtttcgatgatgaaagatcacaccggcacattctccgcttcgatgccaaagtcttcgctttgtatgagtgccgaaagagtcgccgctgcggtggaaaaccaactgaaaacaatttggtgccctggcaatggtagtcaaacactcatcaacgagatcaacgcaactcaatcatcatcaggtaccaaatcctcaattaaatccctttaaaatcatttatttttttaattgaaattcaatttctttaatttggctcctattagatgagtgtgctcgcagtctcggcttcgtccgtgccatgttcgaaattgccgcttccgccgcttcccatgccggtgccaacgccgatttggctgtccagttccgagaacaagttggcacaattgacagcaactgtgccgcgttgggcattcatgttgggcaaatcagcttggatgcccccaagggtttgaaataattattaaaatttatttttatttattttaatgaattaatttttcaggagaccatccgcaagtgcatgactctgagagtgtgcttagtaaccctggcaccagcgggtctcacaagcgcttt

SEQ ID NO: 67128 - DNA, 399 bp, Heterodera glycines
  Genomic contig location: Contig_ID=SeqID_38253; Location=69..467; Strand=-
  SCN-specific regions: Sequence locations=1-54,76-275,306-399
atgaccttcaaaatggacacaacaacggactcccaaaagaacagagtattgagcaggtaaaagcaacaaaacattttcacttttcctattatcttttttaggctgatgattcggtggacgaccttttcgacttggtctactgagttggacattttgccattgttggacaaaaaaggacaaagcgaagaagagtttttcgattttttatatttgaaccatcctcaaatttcctcaaacaattctaagcgaaaaatctcattattgtcatacgtctttttcaaaattttcccaaattcaaatattttcacaatgattcgtctcattttcatacaatcgttttgtttttctatttattccatttgtttcttcctgtttttctttttggctacttcattttaa

SEQ ID NO: 67129 - DNA, 298 bp, Heterodera glycines
  Genomic contig location: Contig_ID=SeqID_38254; Location=103..400; Strand=-
  SCN-specific regions: Sequence locations=1-24,46-111,135-156,178-298
atgcgccagtatccgacctgcatggagttcaacgagcgcttcctgattttcctgttcgagcatgcttatgcctccgagtttggctcatttttggtccgtattttaatttgaaaattttaaatcccaaatttaaactgcggattaattaatttgtgaaattctcagggcaacaatgagctggagaagaagcggttgggtgttaaggttggttttttcgagaaaattttttgaaatttttggacacttttaattgcgtttttgacttttttttctttcttcttaaacatattttaataaa

SEQ ID NO: 67130 - DNA, 740 bp, Heterodera glycines
  Genomic contig location: Contig_ID=SeqID_38255; Location=1..740; Strand=-
  SCN-specific regions: Sequence locations=1-102,125-533,555-740
aacatgttggcactgaaattcacattgatttgcatgggttcggtgcggaccaatggcaccgatctaagcggtgccgaagtggcggaaataatcaaaaaatgcatttttatttttaaaaataaatgaccattttcagcaacactccgtcgcttacactccgcagcagaaaaaccaattgatgtaagcagcagaagaatgatttcacacttatgagcatgccttggcacttttcaggtgggccgttgcggttggctcaatgctcggcactttccccttctcctggctgtacacccgtttcggcgcccgtttcgtgctgttcggtgccggattggcatctgccattgccactgcgctgattccaattgcgacatcgttcagtttcaacctgtttttggcacttcgctttgtgcaggcaaaaagaataaatttgggaaccgaatggaaagccatcccatttgggcggctaaaaatttctcgaaatttaatcgaattgatagctatgtccgactcacagtattaaggatacggtaccgaccaaatttccccctcccccaattattgtctgaatttctccgcaattcttcaatcactcttttcccacttttccagggcatttcctttgcagctgactttgccgccatgggcatgatctgttcccggtgggccagcctgaagcagaacgcgctgttcatttccgtgctgaggtgctactcgcccctgtccaccaccatcaccaaccc

SEQ ID NO: 67131 - DNA, 490 bp, Heterodera glycines
  Genomic contig location: Contig_ID=SeqID_38256; Location=68..557; Strand=+
  SCN-specific regions: Sequence locations=1-26,49-104,147-490
atgtccaaaaaaagaaaacagaagcaatttgcggaagaattgggcattggtgaaaagacattctaccgatggaaaaaggaatttggcattgaaatggacaaaagtaaattattttatttttaattcttttttaattatattatttaggtggaaatgcgtattcgaatgtagaaaaaatgagtaaaatgaatatttattacaaaatgaagaaagacaattcctccttaagtgacacagaaattgcgcggtcattgaaaatctctttacccaccctaagcaaatggaaaaaacaaaaattatcgtaaattttcataatttctttttagtcttaatgacctaatattgtttcatatttgtaattattagagccccgatttttatgtgctaaaaatcctgaaatatgtatttttccgataaattttttgttatatattgaaagctccagcagagaacttcgaattccaatgaccaattaagaattcgattgtaa

SEQ ID NO: 67132 - DNA, 770 bp, Heterodera glycines
  Genomic contig location: Contig_ID=SeqID_8147; Location=54..823; Strand=-
  SCN-specific regions: Sequence locations=1-246,274-637,659-731,753-770
atgggcgattcggcgttggcagacgaagacggcaaccttcacaaaggaggcaaagcatcggcgacaatgttggcatccgtgccattgttgtcaagtgacgacgaactgcgcaatgggccaacactttcggcgccgccgctccccgagggcaaagagaacggcggcggcggcggaatgtgcattttggacacgatgaagccgaagatacatatgatgaagcagcaacagaagcagcaccgaaagatgaacatcaacagcaacaacaacaacaactgttacaataatgcagtgaatggcactttgccacaattggcaaagggtggcatacgataccgtatgcacagcaggtcccagtcgccctcactgttcggttcatcaaaggtagtatggtagacagacagttgtcaatcgtgtgctaattcgtttcgtatgctaccatggaattcttaagcaaaatttctcttggtagagtagaaatttcaaaaaaatttaattcttgaccatagagaaaacttttgacaaacagcaatcatttgattcaaagtgctgctgttgaagagcggataaagaccaagagtcttgattaaggcttattgattgcgtaatcagatgggtgtggtagtgatccagttttttgaaaatattatatcaacaaaattcagcacgaaaatagtttcattttaaatcagaagaatgtgttttctccgttgtaaattctcactccatttttgccctttttcactgacttcccaaaattggcaccaaataaa

SEQ ID NO: 67133 - DNA, 1504 bp, Heterodera glycines
  Genomic contig location: Contig_ID=SeqID_8148; Location=260..1763; Strand=-
  SCN-specific regions: Sequence locations=1-813,835-1504
ttgtcgacggacgcattaatttattaactatcaccctccatttcccctttcgatgcgcaactcgtgtccatgcttggcaatgcgacgagggcggagaattgcgcggaatggaccgattggggaccatgtataagcaaagacagcatagaaaagcattcaaattatcaccaaccgtccccccccccccaaaaaaaaggcgtttggcttcgaggcgacgatccccgttggcagcgctcttactttgaccagttgttgccgggcagaagcgggtgccggaaccacatgtttttcaaactgttacgagaacgttggggacaggtgatggatgatgtgggcagtcgggaactcatttgggctgagctcccttggccaaatcgaaattttccgatgctaagatcccagtttaagcattgtcgaactacacaccccatgttcccattattacacgataaaattttttttgggaggccgtaacggataatatgacaaaacaaattagacctttaattgggtctctaattatctctgggtcagtgtcggcttattatgggaagagttaaaattaaacgaaaaatagaaaataaaatactttattcaaataaaagatttcacaattcttaatagttacttaaaaatttcaactaagaaagctcattccaaatgctttcgccaaattagctgaaaaaacatgcagtgattagactcataagtgtcgacctagcaggcccactgtatcgtttaggaaaaaaatgccaaaattttaaaggctgtctccaatgttatggattatttccgtcagctgaccacgagtacaaaacagtgcggcttttgcagttttcagcacagctgtggccggcgatgccatcgacggtcagtggcacgcgctttgttaatgcagtacatactacagtagaaatctctatttgaacaagctcccgatccgggctctttttttaaaaaaaagctgtgaaaggcacaacccacgggaaaatcctggtagaatctcgatcccgtccgggctctagaaaatactaagagaaatactgtaaggcgtaaaaggggttagccaatcaacgatcaggactgttggtaaagagtgttaggcactttgaaaaactcatccgcaacgatcagcaacttttattgctcccatttctttggataaaatatactgattttttgaacaattagttccaatccgatgaatccactgtttgttgccgaacggcactgtgacggtgttgatcaaagtgcctcgtgtgtatcgcgcacaaatggcgccgttgctgctgacgagtgccaactgtggcccaaccggcaaattgcattgccaaatgtcagcgattggatggcatccattctgagaacagtgccatttctcaactgcgtgccgcagacagcgtaagtgtgcatatatacagtatgctactgtaatgcccatataccacaattaacagttaagggcactttgaaatgccgaattcgctcaattaataccggacat

SEQ ID NO: 67134 - DNA, 1704 bp, Heterodera glycines; identical to SEQ ID NO: 38264
  misc_feature (20)..(20): n is a, c, g, or t
  misc_feature (52)..(52): n is a, c, g, or t
  misc_feature (57)..(57): n is a, c, g, or t
  Genomic contig location: Contig_ID=SeqID_38264; Location=1..1704; Strand=+
  SCN-specific regions: Sequence locations=1-41,83-225,283-566,588 -804,826-1704
  Gene Ontology: Mol. function=structural molecule activity; Cellular component=intermediate filament; Biological process=nuclear envelope reassembly

SEQ ID NO: 67135 - DNA, 717 bp, Heterodera glycines
  Genomic contig location: Contig_ID=SeqID_38265; Location=183..899; Strand=+
  SCN-specific regions: Sequence locations=1-318,352-501,523-615,637 -682,712-717
atggacgatgcgccaattgacccgcaccgaagggttatcagacgaaacgctgcacaccttctgcataagaaggaggcaaaatatgttttggaaaaacatggactgctaatgcaccttggcacacgtaagacaaccagatttattattgttaggaagaagctggttgggcggttaaaacgcggaaagcggggattgataagatccataaaagaaagggtggatgtgcctcggtagatcaatggtagagatgcccacgcaaatggtgcacgagtgggttcgattcccacccgaggcctaacatttacttatttcttattcaaataagatttatttatttttcaaattttgtttagctgtctgtgaatggcatcttgatttgatcaagaaagggatggctgaacaagctgaaagcagcagaaaaggtgaaagccattcaattaatgaagggatggccgaacaagctgaaagcagcagaaaagatgaaagccattcaattgacaatttattcaaactagaataaaaaacgctgaaacaaaacgaacaaagtttaaaaaaaacatgatgttgtagaattgaaaaagagctttcgaattttgcatttttagtccatatttcggccatttttggcaaattttctcaagaacaatgcaaaaaaagcgaaaaatacacccctaaaattcgattttttggaaatttttaaaaattacatccccaaaa

SEQ ID NO: 67136 - DNA, 574 bp, Heterodera glycines
  Genomic contig location: Contig_ID=SeqID_38266; Location=188..761; Strand=-
  SCN-specific regions: Sequence locations=1-23,58-189,211-349,399 -473,511-574
atggtaacacgtattcccatttattttatgatgttaataattcttattcaccaaaattctggtaatagtcagtttatttcagggtttctttatgttcttttttctaagaaatgttatgatttgggggtagtgtcttattttcatctaaaagaggaaatttctgaatttggctaatttctaacaaaatccattaaaaattttaaaaattttccacgcacattcacccgagttttttggaaaactgtgccgcaaataatgttaaaaatctgatttaatggatccagaatgtctgatatttatggtttgtttatctcctccccaaaattgttaaaagcgataatgggagacgaaaaatataataattaaataacatttttgatgaataatttttaaaataactgatttgaagcaatttcgcaaaatgttcttattttttaccctaaaaaacaaaactcatagcaatttttctacgcttaattatataatttattttaaaaaatattaaattatggattatttaaatcgcactttttagcgcattgggacatttgaggataattttgggaaaaataaa

SEQ ID NO: 67137 - DNA, 432 bp, Heterodera glycines
  Genomic contig location: Contig_ID=SeqID_38268; Location=128..559; Strand=+
  SCN-specific regions: Sequence locations=1-215,295-302,324-388
atgacaaatttcggactggccatttttgtggtgtcaatgcttactatgccattttctgacgaaggtgaggatgatgtcggtgccatttgctgtttaagtcgttgtacatatgccaatatttgttcgccattgaaatttttgacgcgaattcttagcggattcattccaaccgttatgcatttgttcaatcggcatcgcttacataatgtataatctatatatatttatagaaatatagaattttatttctatttttatactttttttagattataagtcaaaaataaattaaatgtttactcaaaatgtttattttcacaaaagaattctcatggtaattaggtgctatttacaaaactgaatgaataattttgatgaatccactctcaatttttaaatttttatcttatatttaaattttatagtatatta

SEQ ID NO: 67138 - DNA, 447 bp, Heterodera glycines
  Genomic contig location: Contig_ID=SeqID_38269; Location=157..603; Strand=-
  SCN-specific regions: Sequence locations=1-58,91-99,143-447
tcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgtggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 67139 - DNA, 412 bp, Heterodera glycines
  Genomic contig location: Contig_ID=SeqID_38271; Location=290..701; Strand=+
  SCN-specific regions: Sequence locations=1-225,293-304,357-412
atgacccaacaccttttgaaatgcgaaattgaaagcgaaacccatcccctgctaatccctatcgaacagtatgccaaaaaatcctttttttcctggggtccggacaatccgtcagtgaaggacaatccgtcagtaatggacagtccgtcagtggataatccgtcagtggacaattcgtcagcaaatttttttgagcaatgataaaaaatcttgctaaaatggttgttaaatttaataaatacaatttcttttatattcttaacatttctaattatttttaattcaattaattgaccatctcgagaaattatcatttaattcttttaaaaatgattaattcataatttttataataacccaaattattaattcatatttttagcgacttaaattaatttttacatgattacaa

SEQ ID NO: 67140 - DNA, 1331 bp, Heterodera glycines
  Genomic contig location: Contig_ID=SeqID_8149; Location=1710..3040; Strand=+
  SCN-specific regions: Sequence locations=1-74,147-176,198-226,248 -385,408-427,674-677,700-890,920-1209,1249-1279,1302-1331
  Gene Ontology: Biological process=N-linked glycosylation
atgcacttcgaagtgatcagagacctttgcgagaacattcataaaaccgatgagatggttcagcagaaatttgcaaaaattataaaaggtaaaaaaataaaattagaattttattggcattttaattgaaaaaataattttaaattggaaaaggaaaggggggggggaggcactctatttcttaaaatagatttgttaaaagtgccgcttttcaacaaaatgccgtcctttccccccgtccctttttggcattttaatttaagggctaactgagagcaaagaatgtcggcagaatttgaattcatttttgaaaaaggaacaaatcaaaaagattttcgaagtgattggaattccatttgaagaaaaagactttgaaaaccctgaacaaaaaatggaattttcatctgatcaatcggaagaaaaaggcaaagaaacgcagaaaaaagggaggaaaaatcgacgggataaaaatgggcaaaaaactcaaaataaaaatgaggaaaaatgggaaagtgaaaaagaaagtggcgaaaaatggacaaaaaatgaggaagaaaaaatgccaaaggaagaaaaagaaagccaaaaagtgccaaaggaagaaaaagaaagccaaaaagtgccaattggagaagaaaaaagtgaacccgtcccagaagaagaggaagaagaacttcctaacacaaaaggtgaatttaaaggcctttaaagtgttaattaattcatttgattaagaattttgtgatgaaaattttatttttggagtttataaaaaatattttatggaaacggaaaaaacggaggcggaaaaaacaatcatttgggtggacataatgacaataggcaatgaaatagaaggacaattaaaaggcattgaagaaatgaaaaagttaaattttataaattatttttattttatggacggaaaattattggaaaatttaaaagaaaaatggcaaaaaattccaaaaacaaaaattgaaaaaagaaattacgaaaaattaattttgttaagagaaaaaatgctcgatattttaaatgaaattttaacactttgcgaattgagagaaaaaaatggacaaaaaagtgaagcaaacgcagagaaaaatgaaaaagaatatttattgggcaaaatccatcgaaaaaatttaacaaatgccatcaaaatgggcgaatttgaagaaaaatggaacggcacggcaaaggacgaaaaattaatgaatttattcaaaaataattatttaattacctcaaaattaggcaaatttagaagcgatgcgcaaaaaatgacgaaacaaattgaaattggtagtgaaatattaaagaaaaaa

SEQ ID NO: 67141 - DNA, 1561 bp, Heterodera glycines
  Genomic contig location: Contig_ID=SeqID_8150; Location=1262..2822; Strand=+
  SCN-specific regions: Sequence locations=1-28,89-395,421-436,481 -727,761-876,898-1025,1055-1057,1084-1237,1259-1473,1518-1561
atgacgaaacaaattgaaattggtagtgaaatattaaagaaaaaataaaataataatttctaaatattaaaaatattattattaatttcagagcaaattttattcgatcgaatgatggccaaagaagcgggaaaagaattggccaattgcttaagcccatccttcgccaaagcgacgcagcaattaattagcgacgaattggaccaacaaaactcacaaaaggtaattagcgctaattagcaggttaataaatgaattttacggaagttagcttgagcaatttgtggaggaaagggcaattaatggccaaaggacggagggaaagtcacggaaaaagcgcgaaaaacgaatcaaagcggcgataaacaaagtgaaaggaatggtgggcgaatgggtgagaaaagggaaatgaaaaaagaatcggattaatatttttaatttaattaaattaattaatttaatttaaattaaataattaaaatttttaattttaattccatctttcagtcaaaccatcaggccaaacttttgatttcgggctcctttctgctcggactgaacacaaccgattcggacatcgatttgatttgcgttgtgccgggaaaagcgatcgaaaaagaacacttttttggagagccaaacgaaatttgtgttgagagggaatgtgaaaagggcggcagacaaaaggacactttggcacaatcattttattgccaattgtgtggggtaattaattattaattaaataattaattaattattatttttgtaaaacattcgaatttaaaatatttttcacaaatgcatcagaatggaaaagttggcgatcttctaaagatcaccaaaggtcaaatagcgatgatcaaattcactttcgatggcatcgattttgacatttcattggtggcaattcccaaaatggaaacattggcacagcgaataacggacagaacattaaagcattatgtaaacaaattttacaccgaaaattttgaacaccgacagatgcttcgcgttttatcgagtaattaaaaaatcaaaaaatattaattatgtgtaattaattattcaattaattaattagctataattgatttaggttatctctcaaacgttcacattgtcaaattatttgacgagagtcagaaaaagatatttattctaaacgacgatatttacgatgaaaaaataagacaaaatggcagaaattatgaaaatttgcgttttttgactttggcagtgaaattgtgggcaaaaggtattaaattaaattgtcctttttcaatttgcaaattatttttgactttttccagccaatttcatttactccaacaaatttggctttttgaatggcgtcattttgacaattatgacatcaaaaatcgtgcttctttacccgaattcgtcgttgcgctttttacttctcaagtttttcttaatttacgcggcgaggttaaaaagaaatgaaaaaagaaattaattaaaaattaattaatttaatttttgaaaattaaaaagagagagagaaagagagagccaatgggtaattaattaaccaaaa

SEQ ID NO: 67142 - DNA, 84 bp, Heterodera glycines
  Genomic contig location: Contig_ID=SeqID_8150; Location=381..464; Strand=+
  SCN-specific regions: Sequence locations=1-84
ttccgttcccgcgacttcaaccgcgaccgttggtggcgagattggcccactgattggccccggatggacacaattgtgccaaga

SEQ ID NO: 67143 - DNA, 321 bp, Heterodera glycines
  Genomic contig location: Contig_ID=SeqID_8150; Location=3112..3432; Strand=+
  SCN-specific regions: Sequence locations=1-269,291-291,315-321
atgataaattcggatgattggccaacaattttagcgacaaattcaatgaattttgttgaaaaagtgagagaattttccaatttacaaataatttattgcccttttcagtacaaaacttttgtcgcaattaattgtcttggtcaaaacggagctttcgtccgcaatttttgccaatttgtcgaaggtcgaattcgtcttcagatgacttatgacattggccacagaggggcgacgacgaattggcacatttacccggcactattccaagaaacatgccaaatcacacacaaattggagcaaattccagcaaaatttcggtag

SEQ ID NO: 67144 - DNA, 1255 bp, Heterodera glycines
  Genomic contig location: Contig_ID=SeqID_8151; Location=832..2086; Strand=-
  SCN-specific regions: Sequence locations=1-419,441-1083,1106-1255
atgatggacgagccaatcctcgcggtgatttcgctgacaatgtttatcggctcttatttggctggatttattccgttattcttttcgcttaatgaggtgctttttggtgaagaattagtatgaacaattcatttctagaggaaagttcggatagcgagcattttcggcgctgggcttctcgttggcactgctttttgcgttataatccctgagggcatttcttcacttgccgctgcatcctttgtccaaacgaatgaccgtgaaattgggaaaatgtctccggaaaaaacggaagacgcagcctcaaatttggtagtggacgaaaagaaaattaaaacggaagggttttttcattacaggaaaaagaaaggaaaacgaatgaaaaaatgcatcggagaaatatcaggcaaaattgggatgagaatgagcagagaaaaggggcaattggacaagggaaaacggcgagagaccggcggaagaaagacgcaaaggcagaaaaagtgccaacggcagacgaaccgcacaatgggggcgaagaggggggacaatggcacgaggaagggacacggcggaccgatttcgaaaggttgaacggaccgatcggcgtctctctgctggtcggctttctgtttatgcacgtcattgaccaactctccaaactgtcccacagccgtcagaagggaatgcccaccctcggccttgtcatccacgcttttggtgcgtttctaccaaaatgagtgttcttaaataggtgtccgcttttgttttttccaagtgcagccgatggaattgccatgggaagtgcgtcgagtgccggttctcaactcgaacttcaaatcctcgtctttgtggccataatgttgcacaaggtcagttagtctgtcctatccaatcaatctctacaaatgcggtgtttctttaggcgcccactgcttttgctctgattagcattttgctggccagcggaatggacaaagcgcgagtccgtcgccacttactcattttttcgctttcgtccccaattggtactgtactcactttcatctttctgcatacggtctgtgctgggggtaccaaaaaagaaagagataattaattggttctttcctttcagatacaatcgtcgtcttcggatgactctttgagcggcgtccacgaagagacgacgccctcccaattcaccggaattgttttgcttttctctgcaggaacatttctttacatcgcaactgtgcatgttctacccgaacttgtg

SEQ ID NO: 67145 - DNA, 1354 bp, Heterodera glycines
  Genomic contig location: Contig_ID=SeqID_8151; Location=2861..4214; Strand=+
  SCN-specific regions: Sequence locations=1-136,161-175,197-260,283 -389,412-752,774-1333
atgtacaataccgattccgaaagcccatccgactttgctgccagcacccgcagaatcgagcagtttctgttcgatgatgccacagccaagcacttccagccaattgtcattgaaaaagacttccaattcgtaggatgggtgggtgaaggggaagtagcaagaagtccaccgcatcggcacattcggaccgaaaagcgattggcacagcgactccaacgtcattttgagttggacctccaaacatttggccgtgtccatggaatgtctctgttgcctcagttcatttctctctgcttcctcgaagagagagaacattctcgacattccgggacgttgttcagcgaacagttcatggagtgcataaagacgcacgcctaaaacatccgaatattggcaaaaggcacaaaaattgttgtttcatttcacattaatgcacatgcccaaagggtgcgccaaggcgaggccatgtccattgaagcagggaggggggggggggggggcttttaatggattttttccgaatattcaaattattgagaaatgataatacttagtttaccttcttttattcttcaacattactacctcgggacccattccccaaatagaaaccgttcccaaagtgtctaccttcaatctgatgaaaacaaggaaaatgcgtcctgtcgatttcgtcgcgtctgtacacatctccaacaaccaagaaattgtctagcccttgcttcaaaagtctaaattggtgtgccgaagtgtgcgcacgtaaacaatagtcgcggttgacataataagtgtcggaggcacgtcgactcggatggtcggaagggattagcagagagtcgaaattgtcaaaaatgctcaccaaccgaggctcatcctcacaaacggtgaaaagtggagaacttccacgaggctttctcaaaaacaatggtaataatggccaaccccaattaatcccaccggtaattagtgtcaaaaaaggcgatgattcgccgcttcaaaagttccaaaggatttccattctcacggagcagccgacggctcaacaaagatttgaccccttcggaaacattaaacaggtcgagatccggcgaaatgctgagaccatcgagttcaaaaggcacggaaggaagccccttgccagtgggagaatgaatggaagcaaattgtgaatcgggaacacccgcagaaaaagcacttaaaaatgagaatgaaaatagagcatttcctaaaaatacagacgcatgccagccaaagcattcacaaagctagtcttgcaaaaaaaaagttcaactcacttgaaatggatgcagcaacacactctaactcttggccacaataaattagaaaatttaga

SEQ ID NO: 67146 - DNA, 308 bp, Heterodera glycines
  Genomic contig location: Contig_ID=SeqID_38283; Location=767..1074; Strand=+
  SCN-specific regions: Sequence locations=1-34,56-66,89-117,185-308
atgcgagtcatttctcaaaatcacaaaatgatcagaaggaaattctggaaaacagtagtgagttggagaagcagaaaaaggtaaacgaagggggaagatttatattaatttttgtggaattttaaatatatttatttatttatgcctcctataaatttaaaataaattttttaaattaaattaagatgaatattttcaggtgcttttaaacttccgacaaaattattgggatgctgaagcatgtcacgaggacctcgaaatttctggtgacaattctttgactgtttaccgaaagagaactaatttgg

SEQ ID NO: 67147 - DNA, 812 bp, Heterodera glycines
  Genomic contig location: Contig_ID=SeqID_38286; Location=5..816; Strand=-
  SCN-specific regions: Sequence locations=1-20,42-134,157-181,221 -276,303-812
atgaaattaatcactttgctcttatttataaatgttcttcaattcagcgttggcacagacaatcaaaaagggccacggattatttatctgcaagagccgactgttcaccaaatttctcctagtcaattccgcaattttgttatagaaaataccacagatcccgaatggaaaggtgaaaatgttttttttaatttatattttattttaatttgaaattttagcaacaaaaaatgcaaatgaagcatcatcatcttccataaacatcccaattaacattgatagtgacagcgatgatgatgattatgatggtttggacagaagagatgcattaaggacaggaggcccattgcttttggactttttcaccggaaaggcatatcagcaaaacttaagcaggcaaaatcttggagaatattcaaaaagcaatttacttgacttgtcaaatcaaccaaataattcgaatcaaatgattttaccggctgtgagaaatcagccaagcaattctgatcagaccaagcaacggagtataaacgatgattccaatatgcttatgcgagtaaatccagcgaataatttgccagaagtgatagcttcagtaaccaattctcagcagcttactgaccagaataatcatccgttgacggaaaatccaactgatcagtctgtaagatcaaatcaaaacaatcagcatgaaattcaagaaatattacatttaccaatgaaaaatcaacaaaacaataaaagagcagcagcaccaaattcacgacaagaatatggatttgatctggagaaagtgccaaaagcaaaaaagg

SEQ ID NO: 67148 - DNA, 634 bp, Heterodera glycines
  misc_feature (38)..(38): n is a, c, g, or t
  misc_feature (52)..(52): n is a, c, g, or t
  Genomic contig location: Contig_ID=SeqID_38287; Location=366..999; Strand=-
  SCN-specific regions: Sequence locations=1-160,182-634
  Gene Ontology: Mol. function=F-actin capping activity; Cellular component=actin filament; Biological process=cell organization and biogenesis
tgctcaaaaaggagacggacaattcgctgtcggggcgncagggcgtcaaggnttgttgggactctatccacgtgctcgaagtcaatgagaagacgaaggtacgagggatgggacgaaagcattggatatgtgtcactaactataagtttctctctctccgtccccctttccctccctaaaacagataaaaccgtaggaatttaaccattttgaaaagttggtaattcatcatatttttacgaaattaaggcggcgaaattcgccaagtacaaattgaccagcacggtaatgctttggctgcagacccaaaacccgacaaccaccggaaccattgacctcggcggttctctgacccggcagagcgagcaagactgtgcagtgaatgagcagaacccgcacttggcaaacatcggcaaaatgatcgaagttggccacaattgcagcgactctcctcaaaagggtgtttaaacaggaccaagagagcaaaatgagggcgacactgaacgaagtgtattttggaaaagctcgtcagatcgtcggcgacttgcgctcggtggagagcaccgcggaactgaagagcagaggcgaattgggtgggcgaattttgattattcgaattaatcacgggcattgt

SEQ ID NO: 67149 - DNA, 822 bp, Heterodera glycines
  Genomic contig location: Contig_ID=SeqID_38289; Location=199..1020; Strand=-
  SCN-specific regions: Sequence locations=1-395,417-645,667-822
atgaagccatttatgtctaaaaagagcacgcttgtgctgatcatcgttgtgctgctgctgatcatcggggttgcgctcgccatcgcgctgctggtcactgcttctgctgaaaaagaaaccagcaagagcccgcttgatgtgctggacccgacaccgttcggcacagtgcggtgtaaaggatgcacgtccacaacatcgacggcatcctcaacatcaaccacaccggcaccgacgacgacgacaacggcaaagccaaacgaagaacaccgatcggaggcgattccggattcgacgtcgctgttcaagctggctctggccctcgctgcagccattttctatgcactgctgagtcgccaaccatccaaagactattggctgcagccgacggcaaaagaggtgtgttttaaattttaaatgaattgattattgctgtaaatgtaaacattttttgacaaattctgttagcaaatctcactcaaaattttttccggcggcgcctatcggcaccgcggggacccgccctctcccaatgtttcaaaaaagttttttgaaaaaacattgccataaaaacagcgatttaaaagcaaaaaatttaaaatacagaattttgggactcagaaaattccaagaatcccccttgaaatgaaaatttttaaaaatttcctcgaattcgacttccaaaacgaaaatacaaaattttatgggtacatagtttttgcctttttcatatattgtcatttacagacactcatccgatttggagtgcaatcgacgacatttccgattccccattgtgttgaaaaggataaattctaccaatga

SEQ ID NO: 67150 - DNA, 934 bp, Heterodera glycines
  Genomic contig location: Contig_ID=SeqID_8152; Location=4..937; Strand=-
  SCN-specific regions: Sequence locations=1-175,323-934
atgacaaaaaacagtgctccaactcccgttccaccgatgggtcaacaacaattgcaaaattacaccgatcctaaggtgaaaatagctaattcttcatattactatgtacaaaaggagagtggcctgttttcactcatattttttctatgtaaattaaaaaatgaagaacttttagttttttaatttcttacaattatagaattttctaataaaaaaagtttgatttttgtttaaaatgaatttctttcaaaaaaatttatttaacttaaaaatacgaattttttttgtttttatttttttaatttaaaactaaaaaaaatttcggggaaactgatatggggaaggtgtgttttatttgttgcttataaaattaggcttatttaatggtcatgcatatgacagcaaagtctatgtattttaaaccaaatgattttcagcagaagcagccaaggaaacgcagcagtcccggctcattgtccacttcaagctcttcgtcaatcatcgcaatcacctcaacttctcctaccgctgttcctgattcagtttcaccacctttccgtcctctggaggtatgttatcttggccattttcaaaacagtacgtcaagtggtatgaccggcactaataaaattgtcaaattccaacgttttcacatttttatgttcaaaggttttttaaataacaaacgaaagtcaaatttgttggttgcattgtataaaccttgtcgcttttttgtccatttatatcgcatttcctttccacttttttgagttattttgcaaatttattgtcagagagggccaacacttcaaaaaaatcatttgtaagaaattccgaaattttttttttaagacaactgggcctactaacagcaaagccactaaattgcataatgctgaagaaatgctttgcaaggctgacaatgagcagaggc

SEQ ID NO: 67151 - DNA, 553 bp, Heterodera glycines
  Genomic contig location: Contig_ID=SeqID_8152; Location=1023..1575; Strand=+
  SCN-specific regions: Sequence locations=1-195,222-328,350-417,439-553
atgccaggaaacctgttgcttcagtttgggtgttttgcctttgtccgtcaactccattggtttgctgttctcgtcgggagttgtgctggttcgatttatgcccgccatgcgcgcttttgtccgctgctcgcggtcgcgctgaaggcgacgacgttcagcacttaattttacataaacagtaacatgttaagttcaagttttgttaaattaattattgtcataaacctagtttgtagctcttcagcaactgtaggccaaattaattttatttttcccataaatgtctaaaagctgagaattaaatcatttttaagatttgtgaacataaaaatatgcatgcagacaaaaaatgtaatttgttaaggatgtatatgaaaaccacgctatgtgaagcgtaaagaaaagcttcaaaaaaagtttcaaatatcaaaattatttgtagtttcaattatcttggcgtactgttattagttccaaagaatttttaattctgtataagcaacactaatttgtaaggctttcattctagacattttattgtgatttttgtgaa

SEQ ID NO: 67152 - DNA, 883 bp, Heterodera glycines
  Genomic contig location: Contig_ID=SeqID_8152; Location=1618..2500; Strand=-
  SCN-specific regions: Sequence locations=1-16,38-135,157-213,249 -263,287-434,474-651,677-684,707-786,808-853,875-883
atgaaggtgagaaacaattttaaatgatattgaaaattatttaattgtctataataaatcaggtgacggtccccaagattttcgatttgggttttaagggggcgggggggggtgggtattacaatggaaaaaatagatcggtctgctgtttagttttattgcatttggcatggttttttggaattccaaaaattagttatcaaactctttcccaaaataaaatttttttttctttatttttaatttatgatactcctaatgcctattataattaattttttaatttcagtccacctatgacaaagtgttagctttattggaagagaaagaaggcggaaatgaggagcggaaacagcgggcggaagagttgcgcaagcgcacaaccgaattgttggcaaagattaagcggagtcgggaagagaaaatttgtgagctattttttattaatttattttttgctttttaattttttagccctgattgaacgtgctgattcattagacgtggaactgaacaattttcacacctcaattgaggaactcagtgatcagattgatcaggtgaccagcgaaattgatcgacgcgttgagttccatgccacatgcgatgcctaattaagaattcccatcattttgtttccacaattttgcctttttaatttataattttaaaaaaacgaaaattaatgtttaattgtttgattcttcattctttcttaaaattgttgcttgtaaatgggtgaaatatgtcaagcaaaaagctatgtattgccagaccttgtatgcaatttttgtttgttttgtatttcgtatgtacttgtggtcgttaaatccaatgtattccaatcccttacttcaaactaatttttgattgactgaataaa

SEQ ID NO: 67153 - DNA, 1331 bp, Heterodera glycines
  Genomic contig location: Contig_ID=SeqID_8154; Location=50..1380; Strand=-
  SCN-specific regions: Sequence locations=1-172,251-832,854-955,979 -1093,1116-1331
  Gene Ontology: Mol. function=structural molecule activity; Cellular component=basement membrane; Biological process=electron transport
gcgtgcgacaaacaatcgggccaatgcgagtgccgtgaacgtggcatcactggacgccaatgcaaccaatgccaaccaggattttggtaggatcagcttgcttcccacacacgagaaaattaaaaaaaaactgaattttgtatttaaagttttttttcgatttgtcaataactttttttatttatctaatttttattagaaaaaaatcactatgaaaaatttttttcattttttataaaaaaaaatttaaggtaggaaaacgatgcgggggtggaaaaaaaagcaatttattgaatatttgtccaggaattttccggagtgtcgcacctgccaatgcaatgggcacgcgtccatttgtgatcaacgaacaggcgcatgcattgactgtcgcaaccttaccgatggcacacattgcgaacggtcggtctctctcttccgtcccgaatcaaaccattcccccccccccccccaaaaatacgctaatcaaattaattaattttaaattcaagttgcgtggacggttactacggcgaccctcggcttggcatcaacttgccttgcaagccatgcccctgtccgggtgggccgggctcgggcttccaacatgctgactcatgctatttgacgccaccgccgagtccgacagtcacatgcaattgccggttggcgtttgacaaactaactaattttcaaatggatttctctcgctctgtgtactgtactgtattgatcaattttgtaggtctggctatgctggcgagcgttgtgatcagtgtgccgtcaattattggggaaatccgcgcgaaatcgggtaaaattattggatttgattctttatcacattcctcagcatattataattcaatttgaacatgtttagcggctcctgtgaaaaatgtgactgcaatgggaacatcgatttgaatgtctgtgattttgcgatgctttggaaacgaaaaataatttatttatttgattctttcctgaaaggtgccggagagttgtgatgcgacgactggggactgcttgaaatgcttgtacaacacagacggagaccaatgtcagcattgtgtggacggattttttggcgatgcgcaagcacgcacatgcacacggtggggagggggtcggggcgggagtaatttggcgaaatgtttttaacggacatttttcaaatctctcttacagttgcgtttgcaataatttgggcaccaattcgagtgctggctcttgcgatcgtgtgtctggccaatgcccatgctttgccaatgtggtcgggccccagtgtgaccagtgcgcaccgctccactacgatttggccagcggcaaag

SEQ ID NO: 67154 - DNA, 805 bp, Heterodera glycines
  Genomic contig location: Contig_ID=SeqID_38293; Location=337..1141; Strand=-
  SCN-specific regions: Sequence locations=1-132,381-383,405-434,517 -671,722-776,802-805
atggttgcattgattggcgacaatgtgccgttttttacccggaagcgacatgttctggtgaaggaaagtgccattgtccggccggcatgcatccccagcatggcacgtgcgtcgagggcgaaattattggtgaaaaattaaaataaaaaatatatatattttttttattaattttaaacaaaaaatatttgaaaaaattaaggttaaattaaaaaaattattttttatttcaagaatttttttcaagaggaaaaaatcaaaatattttaacaattatttgattgatgacaaataataaaaatttaataattaaataaattaaagtatttttaatgaataataaatatttaaaaaaattattttatatgaaataaattattgaaaacaatcttaaaaacttatttattggtatcacatttttataagtaacacacatatttatttatatttacttgtattagtttaatttaattctaaaattaaaaaatatatttcaaaaatttcatttattataaacattgcaaattagatttttacaatttataacaataaaaaaaggtgtccaacatgaccaacccccacaattgtcgggccgcgtgccgttgctgccaccaagccaaattgaccccggaggcgacaccccgcccattgttgttggcattgccccaggcaaaaaaaaatcaaatttttatttttaattaccttttttattaaatttttagatggcgtttgcagctcagacagttcatgcgccggataccctcttgcattgtaaatattatttttgtacattttaggaaataaa

SEQ ID NO: 67155 - DNA, 1124 bp, Heterodera glycines; identical to SEQ ID NO: 38294
  Genomic contig location: Contig_ID=SeqID_38294; Location=1..1124; Strand=+
  SCN-specific regions: Sequence locations=1-429,451-482,504-509,532 -872,897-905,931-1124
  Gene Ontology: Mol. function=small monomeric GTPase activity; Cellular component=cytoplasm; Biological process=phosphate transport

SEQ ID NO: 67156 - DNA, 56 bp, Heterodera glycines; identical to SEQ ID NO: 52733
  Genomic contig location: Contig_ID=SeqID_38296; Location=105..160; Strand=+
  SCN-specific regions: Sequence locations=1-56

SEQ ID NO: 67157 - DNA, 893 bp, Heterodera glycines
  misc_feature (834)..(834): n is a, c, g, or t
  Genomic contig location: Contig_ID=SeqID_38297; Location=89..981; Strand=+
  SCN-specific regions: Sequence locations=1-170,237-308,332-561,651 -709,732-893
atggcattccaacagatgggccatgcactcaatgatgccgatatcaaagccatttataaacgtgttgacaaaaatcaggacggcaaaatcaacttcaagggcatgttcttgaagaaaaaatcaaatcaaattatttcagaacttaagtatcttgcttaatgagagagttttttaatttgatctaattttattaggtcttttatattaatttaattaattaatttcaatttgatttattattttgttcctaggatttattttgagtttttgcgcgttgtttggtagttttggctttatgtcaacacctctaaaatatttttttatattttttgggtaattttacgtactgaacaggaagctctaacaaaaattccgtaatattaaaaatttcattaattgcatttcgcattttgccgattcaatcttgggaccataaccacggaagaaagtttcttcacctagatcacttaaaatgcatgtgttagcttaaagaaagttcagaatcatgttcagtaattaaaattagcctagaaaattaaaaaatatttcagtggtaatggcaaaagccaaagacacccattcaataattaatttttaatttgccaattaatttatttttaaatttttggcatttttttaaaattaattttctataatcaaaacaacacatttcattttaagaattttgtgagatgatgacccgaggaagcactagcaacagtagcaacagcaattcatgatgataaatgaatgacggaagaaggaatacaccataaattgtccaattaacttaagccaattaatggttgcttaatttttccggaaaacacttanattggcctaaatgataaagattaattaatcggaattaaaatcaaacaaaaactcaaaga

SEQ ID NO: 67158 - DNA, 722 bp, Heterodera glycines
  Genomic contig location: Contig_ID=SeqID_38300; Location=166..887; Strand=-
  SCN-specific regions: Sequence locations=1-109,131-273,295-409,431 -562,589-671,714-722
agctattcccgaaggattcggtctccccataaatctggttgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaaaaattaattttgcaaaaaataaataaaaacgaaagact

SEQ ID NO: 67159 - DNA, 534 bp, Heterodera glycines
  Genomic contig location: Contig_ID=SeqID_38301; Location=33..566; Strand=-
  SCN-specific regions: Sequence locations=1-8,46-287,354-498,522-534
ctgtttctggccatcacttctctgttcctcaactccatctgctggtggttctttgagccctcgtctgaccactttcatggccactgtaaggcactaaagttcctaattaataagcaacaccctaattactagtggctagcgcgagagccttgattctcacttgagaaatttctcggatttttgcttctcgttctcagtctatgttttcagtttcggaacatgagaaatttttacaccgttaaggatgaccatagggggaggagtcgctggcgaagggggaaaagttgaaaaaattttattcacaaaattaattaaaaatcgcaaaaaaatatagaaaaaaataatttttttttgactgagcggcgcaaatgtcgcagcgaaaagtcgtaacacgactactaactgcctcccctaattacccactcttgatccgtcctttgatcagttgcgcctcgactggtccgcttcagtgatgtccggcattttgatcgctgtttttaatgccgcttacatgacatcggatcccatttgcgg

SEQ ID NO: 67160 - DNA, 972 bp, Heterodera glycines
  Genomic contig location: Contig_ID=SeqID_8156; Location=828..1799; Strand=-
  SCN-specific regions: Sequence locations=1-813,835-972
  Gene Ontology: Mol. function=pre-mRNA splicing factor activity; Cellular component=nucleus; Biological process=embryogenesis and morphogenesis
atgcctcctcctggcatgatgcgtccaccgcatggctctttcatgcttcctcctccgccccccggcgcctctgttggcgatgagccgccaaacaaacgcccgcgcgaagaaacgctggaaccggaagaacgttggcttcaaaaggtgagcgccggtctccaccgatatttgctaaaacgaggaaaaaatatatctttaattgcttacaggtccacggtcaaatcgctgtgcaaatcgctacgccgcaaaatgatgaatggaacctgaaggggaacacagtacaaattcagttggacatcagttcatcggtcagtcataagttaggatgatcaagcaatgcgttattagcagggctttttgcaagtattattttacgggttttaatttttcaaattttttatacgtgcttttaaaaactttttccacttttttaaaaattaaagctagttttttaacaaattaatgactattttggggcttgcacataaatcgatttgtattcaggtcactgcgttaaaatcgttaatccaagagcagatcggagttcctgcaaccaaacaaaaattagtctacgaggtgaacacaaatttaattcccattttaagtcatttgcattaattggctaacgttttgttttcccatttcaacagggcattttcatgaaggacagtcagagtttggcctactacaattttatgccgaatgcttcagtgcaacttcagttgaaagaacgcggaggacgaaaaaaatgaaatgtttttttgggaagtgatcacagaatgatgaatgaattggattactttattggcacatttatttgtttgaactttaaatttattggtaattagtaaaaatatggtacagatcacagaatattataaccaatccagaaaatatgatattatagccactctgaaaaataggccttttactacggtataattaagaaaacataaattcaaaaaaaataaa

SEQ ID NO: 67161 - DNA, 368 bp, Heterodera glycines
  Genomic contig location: Contig_ID=SeqID_8157; Location=3952..4319; Strand=+
  SCN-specific regions: Sequence locations=1-143,186-343,366-368
atgcgtgccgcgttagctttttacgaccgcaccgttcgccaccgcttcgccgatggttcgtcgggaggcgaagcacagcgcgaggaattgaaactttgtctcaatgtgctggtttttcctaaaattgttttagctgcgtgttcatttaaaaattccattgtttttatatattttattttgcagcaattttatcgtctctgttcatcaaattttaattttacgacagttttcagtcattggtcagcactttggagagcgctgacgcggagagagaggcgaaatgggaacggctgaagcaatttttgagggtgtgcggaacggccgcaatttttgccgttttggcatttctgttcactttgtattggccg

SEQ ID NO: 67162 - DNA, 83 bp, Heterodera glycines
  Genomic contig location: Contig_ID=SeqID_38303; Location=985..1067; Strand=+
  SCN-specific regions: Sequence locations=1-83
atggcacagtttgtgctgaagttgcaaattcgagagcgcgtcgacgacacggaagcagtgtttatggacattgaagaagcagg

SEQ ID NO: 67163 - DNA, 942 bp, Heterodera glycines
  Genomic contig location: Contig_ID=SeqID_38304; Location=312..1253; Strand=+
  SCN-specific regions: Sequence locations=1-277,348-546,568-842,864-942
atgggttatgcttataggttccggaacatttacagtaatttgatggttcataattttccatattacatcatattcagtacaatctctccggttagcaatgagcttttgttcgaagtgttctatgaggaagaggccaagctcgactcacaatcagcaaactgcgtaagggaacggaaattttgcgggacagccattcaaagtttggccgaacttcgccaagcagttcagcaacaacggcggaccattgaacttcaactacagggacgtccatatatggaagaaaaacaacagcaacaacgaaatcggaaaccatcacaacaacaactacagcagcaacaacatcagcaggaaatgtatggtgttctggtgatcaaggtaagaaaaattcttgcaattttgtcaattatagaactcagaaaattcggaattagcacttggaaagtgtctaaacctaaaaacatgacccacaatggcgttaatcaggttaattgtaatggcaatgcctccaaatacaatcgttttggtaaatcagaaatccgctttcaaaaatgaaaataggaatccactaacattctttattaaggccagcaagaaaaatggcacaaagtgatggaaaacataaatttataggcttcgctcagcaactgtcatggcaccaaccgagccttggtaaaacaacattcaacagaatttgtgggcacgttggaaaatggtcatcattatcatcagccaacgcagcccaccaaatcatgttcaccatttgcatatcctggtgacaatcaacagcatcatcccccgccattgtcaccatcaattaaaaagtactcaacgaccggttccgaatcatcatcaacaattaaacggtcattaacacgacaaaaacaacactatatatacaatgtgacagacgacgaaggccattcgccatcatatgatcgacag

SEQ ID NO: 67164 - DNA, 853 bp, Heterodera glycines
  Genomic contig location: Contig_ID=SeqID_38307; Location=162..1014; Strand=+
  SCN-specific regions: Sequence locations=1-580,602-853
gaattgatagaaaataagagatacctcacttcaaaatcgtataccgaagactatgttgagaaacggcaaaatactaactcaatggcactcaaacgaaattttaatgaaaaaatgccaaatgggagaggcggacgaatgaaagacaaaatgccaatggaaatgaattccccaaggccaaggcgtaggaatggcactggtagtcatcgtggtgaaacgagtcaaaatttgggtgaaaaattccgacatgaaagccgagcagaccaaacaaatggtggacaaaatgccaaaatggaaagaagcgcaagtcaaaaccgccagagacaggttagaacagtggttggatatcgtacacttgacaaaacattttcaagtttttggtactgtccctccccatccattttggcattccgtttatccttattttgaaaaattgggtttttaacactttttttcagcgtactgaaatgggcaggcaaaagtcacttaggaaaaaagatgaaatggataaactatggcaagagttgcaagacgatgaaggtacggtaaaaccgccaaatccaaaaaaaaagtcacgaattaagaaaggagcaaaagaccaccatcactaaatgagaaacaattcgacaaactatgggaagattttaatgataaagataaggaagaagcacttgctgtggaaaagaatgcaaaaagtgggaaaaagcatcgaaaatcggcggagaaaaagcgacaaaatgccgaggccagccgaagttccaacgaaggcaaaatgggggccatgaaagtgaacggagaaagtgccaagaaaggaaaaagcggcggagcgaaaacgaaacaaagtcattcatcctga

SEQ ID NO: 67165 - DNA, 3745 bp, Heterodera glycines
  Genomic contig location: Contig_ID=SeqID_8158; Location=319..4063; Strand=-
  SCN-specific regions: Sequence locations=1-90,113-196,218-403,425 -1045,1088-1115,1137-1218,1243-1283,1320-1685,1708-1722,1744 -1763,1823-2074,2293-2454,2485-2533,2560-2567,2617-2622,2676 -2683,2705-2963,2995-3076,3098-3180,3297-3354,3376-3745
ctatacaagtgcaaagaatgcacagatgcatttgctcgtcctttgtacctggcaagccattctcgcaatcatgggtacaatgggagatacaaatggtaaaaatattttgattcttattatctttttttatttgtataaatattcagccaacattgcaattatggctgtgacttgaaggacacatttgacaaacaccggtaataaattttccttatttcgctcagttcattctaaaatcactttttactgtgtatagcaatttgatttcagtggtaaattccatattcataaaaattccaaattaataaaggaaaaataaaaaataattcattagctgttgagatgatccaaactaatgacaatgggcattaaaatattagttgaaaaatctcataaaattaacgtatttttgcaagattctcatttgatcgattatttctgatcagttaggaggtcaagattaaaaatagctgaaaatttaggaatagcaaatccaattgctcttcatgataaaaagggtttaaagtgatctgaacagttaaaatttttggctgtttcctttaaaaacaaattctttatttgtttagtgcctgtcatgtcaatgtgacgccaatcagaattgactttgacgacgaggtgtttgctggctcgccggatccagacgaggtgggtgaaaaacgaaaagggaaaaatagcaaacgaaaaaataaacaaaattttatcctttttgtaaatgttcttatttttgaatattttcacaaaataaaacgattttcagtaatgaaaacattgtcgttcgtctttttaagcaaaaccttatcggttgtttggaattatcaccggctcccataaacatatgaccatgactatatgtgcataaacgaataattttttaatggacaaaaaacataaaaatttaataaaattgaattcggaattaatttgtataaaaaatatccgacactaaaattttcaaacggtaccgacaaaaaacttgggtcatgatgccgtataaaaatatattgtcttgactcaaattaatccgaaaaaattgaaatttttttgattttttaattaattttttttaggtttttgaaactttgatcacttttttctgatcagtttgttggtgagggccaaaaaaaggtcgagaatttatgatagaatacctccacaaaataaaagtggtttaaaagtgatttgaatatttactgtcagaaatgtttccttgttagaaataaattgattaaatgtttgctcaaaaaagttttgcaaataagtccaaaaaataaaattttaattttatcaatttttaaaaaggctcaatcatttaagcgatatgccccccccccccctccctccttgggatagttggcggtcttatcttggagtcaaaatttaagaattagagtcttttttatgctttacaacaaaaaaaatgcaatttttagtaaaaaaacaaaaaaatattttacactttttcagcccaaagcagccgagccgcccaccgaagtgcctcaagaacgatgggtggacccattgccagaaaagttgcaatttcagcagcaggagaataaatttgccgagctcaaatgcaaatactcgcgcgccaatgccaaaggtgattattaaaattaaatttgaaaaattgatcatttttcattatttaaacgactgataaaatcatttacttttttcaatttcaataaaacacgaaaaaaataaatgataaaattaaggatatcttcaaatctatttttaggataataaaaaatatattaatttttaaaaaaataaagtttaaaaatttcttaaatttaatgccaaaatatttcttttcagtgcgctggtataagggccgcaaggagctgttctcggacggtctcaagtacaaaattctgatcgacaagcagtccatcacgctgatcatcaacaacccggacccggacgacagcggcaagtacaaatgcgaagcgaacggagttccgaccaattcatttgtcactgtggagggtatgttttggacggggcggacaaaaaaaagcagttaaacattttccacggacatttttggtttttaatttaatttttaaaatttacttttttatcaaattaatactttcattttatttaaaatatatattttttaaaattgtgtatatttataatataaaatttataaaaatgttttaattttttaaaataattatttcatattaaagaaaataaattattgctttttttcattagataattttcacataattttatatagaatatgttttattaaaagaatgcattttgtttcagactcaccagaccaacaaccattgtcctccaccgcccgtcgcagcgagtcgcgcagaccaaaaagtgccagaaaggaagccgctgcattgaccctcttggacgccatgcagtggttggtttaacaaacaaaaaacgaaaaagaaagtttaattcattcattttattttttagttgcagcagccatttgacgccgccacgtcccaaaaacatggtgagcaaattcgggttttttaaaattatttattgggaattttgagaaaataaattttttatttttaacctgaacccaaaaccaatttttaaaagtgatgcaaaatttttgaatttttataaaatatttatacaaacattttttttgtttttttctcaataattcctcttctgttggtcttgttcctgacaaaagcatccacaggcaaaaaattttttctaaatgataattttttttctttgtaaaaattttggtttaaaattgtccccttattcgaaaaaaaactttaaatatttaatgcataaaaaatcatgaacaggagcggaccgcgtccagtagcggaaggcgacgcgttggcagcaccgcggcggaccggtcggcaaaggcggcagcagcggcttgcgctgcgggcgaagaggcaacagacgaggtggaagtggccgacagtgaggaggagcagcagctgctcgacatgacgacggttgaggtgggaataattttgaggcgggagggggtggggccaaattttgcttcttgccactttttttctctgtgtttttttttaaatttttttttggggatgggtggtgagatccaatggtgccaataggcagacgcgccgtggaaattttgctaaagtgaatgcaatttgctaattgattttatttaaaatttatttagtttttataattaaaatttttgtattttttttatttaaaaaatttattaaataagatttaattaatcaactttaattgatttaatattaataaaacatgcataattatcattaattaacgaatttatgataacaaatattattatttttatccgttttatttataaaatccaaagcttttttagactcaaattttttgtgtttaattttttattacaaaaaacccagaaattaaaatttttgctctttgttgaaataatgaattaatattttccaatttttaggtgcgctgtgcggacgaacggctgctggccaaggcgtcattgaatgtgccagtgcggcccggcccgccgaagccactgtacaccaccgacaaatcaatcatgctccaatggacacgaccgttgcgggacagaggcacgccgatcactgactacgagctggagatacgcgagcgtggcaccaagctgtgggggaaggccaccaccaacgcggagctgtgggagaaagacgcatttggcaatgtaccggacacacgaatcaag

SEQ ID NO: 67166 - DNA, 657 bp, Heterodera glycines
  Genomic contig location: Contig_ID=SeqID_38313; Location=45..701; Strand=-
  SCN-specific regions: Sequence locations=1-26,48-328,364-657
atgtctttaatgatagttttttatgtaaaaaagtaaatcctgagtctataaaaaattatttacactaattacgtcaaatttttttttgacgttcatacggtacaattgatctaccgtattgctagttccctttttgatatttaaatttttttttgtttatttgttttatgcttatgcaaaaatccattcaaatcccgtcccaaaataggccatcacatgtgcgaagccaggctcgggcacgctcacatgcattcttttccgcccgatcaaagtatgcgtaaaatgattaatgtttaaatcctacggatttttggcattctggtccaccaaaaatttattttcaaaaaatgatttttttttaaagaaaattggagggatttgaatggataaagcatgtctttaaaccgaatgttttttgttttagggcgcctcttcaacgccaagaccattcatcggttgaaatgtggttggacaagtttgaacggactcagggtgacctgttgatcatgaagtcggacgaattccgggacaaaacgttgaaggagatctctgatgtgagatttttaaagaacattattagctgatttataatttgatttattgggacattttggggtaaaaaatgtgccaattcttaatttttctatgaaaaataaa

SEQ ID NO: 67167 - DNA, 769 bp, Heterodera glycines
  Genomic contig location: Contig_ID=SeqID_38316; Location=308..1076; Strand=-
  SCN-specific regions: Sequence locations=1-373,396-477,499-558,597 -675,698-769
atgaccatgcttttccttttcctgatcactctgagccccttcctgctgatcagccagtggctccttcttgccaaacgtatgcagaatcactgctaacatcgcgacaatccatgatttgccttcgccggtggacacttgcaacatcaaaccgcgcatttccggacaaaatatcttcacaaacatccgcagaaagatggccaacaattgggtgttacgcggcttatgacctgttggaataatggaaaattcaaaattgcacaattttttttgttgatttttttgcctcattcactgccttaccaaggaataccagcaaaaataattaattgtcattattagtttggttggcacttctttattggggcggcccctttgtgttcttcccgctctcttaatttagttaataagctcttccccttggctttccattcaaaattctgtcggatatgaatccagactatccttccttctcccgttatgagttgaggaatttcacaatgttactttacattgtccttacggaataaaggcttttattccatcttttactatttatgctaaatttccatttgataatattgtagtaattttcatttcaaaatatgccattttgttaaaaacgttctcgattttttagggaattaggacaaacattggggcagtgccatgcccatgagagggttttggggcttgaaaatgactctcatacgtttaagaacattaggaagggtagaatgaggaatggaaaaaagatatttgactaaataaa

SEQ ID NO: 67168 - DNA, 103 bp, Heterodera glycines
  misc_feature (23)..(23): n is a, c, g, or t
  Genomic contig location: Contig_ID=SeqID_38317; Location=18..120; Strand=+
  SCN-specific regions: Sequence locations=1-103
tgtccgtttggggtactcaaacnattatgggagcaaaaatccaacgcagattaaagtacaggctatagggaagctactcccgaaggattcggtctccccataa

SEQ ID NO: 67169 - DNA, 430 bp, Heterodera glycines
  Genomic contig location: Contig_ID=SeqID_1068; Location=119..548; Strand=-
  SCN-specific regions: Sequence locations=1-113,135-150,172-430
atgtcggacaatgggaaagaagcgaaaaaagagatggcaaaagcaatgtaaaattaaattaaaatgccaattttcaatttttaattttgttttcccttttttcagttgccaacctaatcaaatggattttgattttacctaattgctttaattttgctgcaaatttttgtgtgcctttgtggaatatctgtttcctgtaaaaactttcaaccccaacaaaatccacgaatttctttaaatttaattttactgtttttccatttgtatgcttttgcattttgcaaaattttttcgcgattataaaagccattcatcctctcccacatttcctttcatttactcacttttcctttccttttattgccaacatcttttatgacattttatgcaaaaacattcattttttatgtgaatttttgaagaaaataaa

SEQ ID NO: 67170 - DNA, 1727 bp, Heterodera glycines
  Genomic contig location: Contig_ID=SeqID_1068; Location=2760..4486; Strand=-
  SCN-specific regions: Sequence locations=1-792,830-1053,1078 -1478,1513-1727
  Gene Ontology: Mol. function=protein serine/threonine phosphatase activity; Cellular component=cytoplasm; Biological process=mitosis
gagaattggctttcgaaaaagcaattgcatctgacccctattgcagaagtgtggccgagacattaaatttggaagattttggttagttcatgacatactttttgaatttattttaaagacttggtgtaaatttcattgaaaagtatttgctagcgatcgaaagtgactactcggggccccatttggacggggaaatcagcgttgagttcatggaggaaatgatcgccacgttcaaagatcagcggaagttacacacgcaatacgcgtacaaagtattcataattgactgacagggtgatgaagaatgatcactattttttttacagattttgcttgccatcaggaaatatctcattgaattgccctctttggttgacatttcggtgcctgacaaacagaaatttaccatttgcggtgacgtaagtcgtttcttaacatttgacaatgatccaagtacaaaattaaggttcatggtcaattctacgatttatgtaatatttttgaactcaatgggtttccatctgaaagcaatccttacctgttcaacggtgacttcgtagacaggtcttttcattttgttgttcccctcataattttgttcgtgttatttcaggggctccttttccgttgagaccattttcacgttgttcggcttcaaattgctgtttcccaatcactttttcatgtcccggggtaaccatgaaagcgatgtgatgaacaaaatgtacgggtttgagggcgaagtgaagagcaaatacactgcaaaggtctgtttcttctttcttggataccaaatttaaatatcattatttttttatcttatttaaatgacagaatttccaaagatttttttttcagatggctgagcttttcactgaaattttcaactttcttcctttgtgtcatgtcattaattcgaaaatttttgtgggtttttccctttgtatttacattcgtaataaatggcttctcaggtttgccatggcggtctgtttaaagaagacggcgtaacgttggagaaggtgccatttaattctcttatcggaacaacctttgcatttattttatttttaagatcagaaagaccaatcgaaaccgacagcccccggaggatggaataatgtgcgatttgctatggtaaatgctttgtttccgactttttacgctgtcattttttcaggtcggacccgcaagaattgtccggctattcgccctccaaacgcggcgtcggcattcagttcggacctgacgtaacagaacggtttttgaaagacaatgatttgctttatgttgtcaggtaaaagtgttttaaaaatttataattctttcatttgttatgccttttaggagtcacgaggttaagccggaaggatacgaaagccatcacgagggaaagtgctggacaatattcagcgcaccgaattagtgagtttccgttttaggttagggagaaggaaatgacaaattacaaagaaagcatttttatttttaaattaattattgtaattaattgcactttcaaaagttgtgacaccattggcaacaaaggtgcctttatcacattcactggcgaccaattgtacccgcccaaagtgcactccttcgaagccgtgccccacccgactgtccgagcaatgcaatagtaagttaaatggggcggtaattgtgggaaaagccttggcctctctctcccttccttcagtgcctcgtccatgttcagcttcctc

SEQ ID NO: 67171 - DNA, 3291 bp, Heterodera glycines
  misc_feature (2163)..(2163): n is a, c, g, or t
  Genomic contig location: Contig_ID=SeqID_1070; Location=49..3339; Strand=-
  SCN-specific regions: Sequence locations=1-139,161-788,818-909,935 -992,1015-1244,1266-1285,1308-1327,1350-1609,1632-1731,1754-2126,2148- 2319,2342-2812,2834-3291
atggccgaggagtgtgttgcctcgcaacagttttcaaaggctcttcaagtaaaagtttattcaaacactattttttatttattatttctccttagattctccatcgtttatgcattgaggacacaagtgtgttattttatccatttttacgtgaagcattggtttcatttgccaatgccgctttttgttcgctaagtctcaacgaatggacgtgggcattggtgtggttacattcagttcgcattctatattttaaatgcctctgttcagctccaacttctccacccgcaattggccaataaatccgtaactttgcgtgttttttctgtcggcgaaaatgaccaaagcatttggatggaaaatcttcggcgttttctattaggtgatctgaactttctaccgtttcccttaacgagttctgcaaacgatcatcgctcaattttctccatagaacaggtaatattgggagcagctcttccgcccccccccccccgattttcaaaaataccaaatttttcgagaaaatttcttactgattttttttcttgaaagatttcttttagtacctaatttttttaaattttacggggaaatcgatgcagcgtggtgcacccggtaagattaagttagtttatcgcagaattaaatttttcactgcatgaactttcacctttcttagctgaattcattccaaagtcaatggcgccaattggttgcccaatcgtcttcacctctgcagttccaattggaaatgtccaacctgaactactcgcccattaagttcaacgctcgttttctcgttataaattcgtctgctaacaataagcgacaaacaaatgaaaaatttgcttttgacgaagaaatagccgacgggtttcaaattgcaactgccgatgactctcttctgatagaagttagaaaacacaaaatttgtttaatcattttcgattaggttgtgctgtataatatttccaatgttccattgcgctttgaatattgttcattgactctggatgaaattttaaattcatccggtgccaaaaagtcgaaaacactgtccgaatggtctacggcgggaaattcgtcaaaaaattctacgttggtattggttcccaaaagaccaagccgcgttttctttatctacaaaactacatttgcaacatctcttaaacaattgatgcaattgccagcctcaaaggcaccgactagcagatgccaaagtccgttgatggatgaacagaatgccaaggaaattttaataacggtaggcatttattcaaatttgaaaaaccaattgtataattcatcgtggtaaataggagtttgggtggggtgaagtcaatttcgcattgtatacacggaaaaaataaaaagtttcgtctgaaatttttttgattttaccgtcttctgttctcgtaaaccccaattcgattgttagtctatgccgtgtatgcatattatttaaaggtccgacacttttcattgcgtacatcgtccggatcactcagctgggacatcgatcaccgatcgacgagtaatagacatcaccaaaattcaattgaggagatggacaagaacaactatgcagtgaagtaaacaatgttaacaatcagctaacaaaaattaatatgacaaatcatttttatggtgcgaccacaacggtgcaatgtgttactgacctgtccaattttggctgatagcaccgaattggaattatttgttgacgaatgcgttcaattgactttaaccctttgtaatgcggagcgcaacggaacactgctgaagaacatttggtgagcctggtacactttttccgatggcgcttaacttcacctaagataaattgatttcgttaaattttatgagaattgatcatttttttatcaaattgaaaaaaactattttcaaattgaactagtaattactctttacacttctataaagggtaatctgccacaaagtctgccgtgaggatgaagagttcgccaaccagcagcagaattcgcacacactaaactcattggcagcaacaaaatcaccaatccctggcgtcattcgacggacttttgttcttccgtcttgtaaaggccataagcaacagcagcaggtgtccataggcgacgaaaaggacggaaagacaacgacacttttggtgccaatgtntagccaggcaaattatgcataaatcgccacaataacttgtttcatcacacaaaataacttttaggagctcgcttcattgcttgcgcctgaacaatcggtaggttttgccacttcatcttattgttaacttttaaatttcttcagactgacttctccattcggcttcaatccaaatctaacaattgcatttcccttcgcgttcaagtttgggctaaaactggtcccataaaattaccttcttttccaggtttgttgtacccttccttcaaaatcagaaaatgaaggtcaaccgttggaagagcctgccgaattggtgcagcactttcccatccgttgcgttgatcctttcgaaccgaaaatcgcaattttttgtgaaaatgcgagaaatcgaatttcatcggttacgtttggtctttgcattttagggaggaaaggcacaatgtttggtctttgggcaaaagtttcgggtgcaattacaactcaaatgcaacggaagagtggcagtgcataatgtacattggaaattggtcagtcaatttgaatttggagtaaaggattaatgcgttaaatatttattgagaatgacgcatttgaacatttcgacgctattcctttggattctttgataaagcaacacttcgaaaaactcaaaatttcatctgttgactcaagcgaattcctcaacacgcattctgtttgggtgaaagtaacaaatggcgacggccaatcgccaatgagagagacgggacaaagcaatggaggggacgacgagcaccagacacagctcggagacgtggtggtggagtggagcaggttagggggaagagaccgcaccggatttcttaactaatttcgaacatctttagcactctttcctttgaacatgttcgttccgtgttggcattgcccacaatgccacccattttggtcattccgatgacactaaatgtggaattggccaacgagaacgacggggaagagactaatgaagcgattagtggatgttgtttcagaattctgaaaccattccgcatcagatattacttgaggaacacttctgggggaccattggctgtgcatttaaatttcgagcagtctgctggcacttctatagatggaattttggaa

SEQ ID NO: 67172 - DNA, 4543 bp, Heterodera glycines
  misc_feature (17)..(17): n is a, c, g, or t
  misc_feature (25)..(25): n is a, c, g, or t
  Genomic contig location: Contig_ID=SeqID_8160; Location=865..5407; Strand=+
  SCN-specific regions: Sequence locations=1-115,137-431,454-837,859 -871,897-1118,1140-1309,1331-1408,1431-1794,1816-1837,1859-2497,2519 -2691,2713-2890,2912-3585,3608-3879,3901-4116,4138-4165,4187 -4299,4321-4436,4458-4543
cttaaggaggaacattncaaggttntgatgctcttgacagctctaaagtcgccgaaagatgcaacttgagacaaagaattttgtcaagctcggcgccgaaggagataacgtcaaatatgatgaaattgtgcaagattgtgtcaatttcatgacgacaatcagcgaagtaaagctgattgaatcatctgcggccaaccgaagcataaatgcagtcaagccaaagtggcacaaaaccgaaaagggaggaaggccaaacaacaagcaaggccaatcatcatccgctccggcacaacaatgttggcgatgtggttggacaaatcacagccactgggagtgtaagcataagtcagcaaagtgccaaaaatgttcccaaaatggacatttggaaggccaatgcgacaaggtgcaggaatggagacggagaaacaaattgccaattccaaaaaggaaaattggaaatttacgaattggaacggccatgaaagtgaactccgcttcgcttttcaaaaccgacgtggcggcagatggcaaagacatcaaattcgtactcgacagcggggctgaaataattgtgatcgatgaactatcacatgaagtcatcggcagcccccgactccgcaaatgcaccgaaagtggatgcatgttcgatggaacacaagtcaaattcgtcggaaagggagtcgcaaatttcaaattccgcaatacaagggcgtagccaggaccttcgtttcggggggggggcaactcaaaaagtcggttcttaggggtgtattttttcgtttttgtaaacctctatttttagtggtgtattttcgtgttttttttaaattgaattgattgcattattttgtgtttcctttgcataaacgcgttatttaaattaaaataaaattattccggcgatgtttcaaaaaaattttttcaaaagaaagagcgcagatgtggggggggggggttgggcgggggctgagacggaatggagcattggatgtgcgaaaaactgaattgtttggccaattttctctccacacattatctgctcgcctgtaccttcaccaatcggctggaacaattttttctgcattgacttgggtcattgaacgccgaaataaacctaataaaattgttttttctaatttccgcctttgttagatgaaacgtaaaaatcctggtcgccaagacattagaaattttttcaatttgccttcgacgagcgtctcgcgtccactctcgacagcagaaaatatattcgagaacaatgctgaaagcgaaaacaacgattttgtcggatatttatcagaaaattcagaggatgaggaaatctcaaaaaagaagcattggaacggccgattcgtttgccaaaaaatttcgacgacaagcactttctccacgagacattggtctgactaatccttttcattttcaaatttaactcgcacgcctatgcatagactattcaaccggtctgaacaatgcccttcaagaccaccaacacccactgccgctacctgaggatattttcgcaaccttaaatggaggaaaatatttttcgcaaattgacctcagggatgcatatctccaaatcgaattggatgatgaatcgagaaaaatctgctcgatttcaacacaccgtggcaattatgaagttaagagacttccttttggcgtgaaatcagcgccagccatattccaatcggtaatggaccaaatcttggcagaatttgaattcgccacagcttacttggatgatgtgatcatcgtaagcaaaagcgtcaaagagcacgctgatcacttgaaaaatgttttggaaaaattccaagagtggggattccggatcaaattggaaaagtgttcgtttttccgagaagagatcaaatatctcggacaaatcatcgacagaaacggacggagaccggacccggagaaaatctcagcaattagtgaaatgcccgcacccacagatgtgccatcgctgcgttcatacctcggaatggtgaaccactaccagcaattcgtcaaaaacatgcgttttgtacgaaaaccgctagacgatctgctgaagcaggacagcgaatggaagtggagtgagaaatgcaaacaggcattcgacaaaattaaggaaattttgtcatccgatcttctgctgacgcattacgatccaacaaaagaaatcgtggttgcagcagatgcatccgaactcgggattggagcggtaatctcccacaaatttcccgacggaacaataaaggcaattgcacatgcttcatcagctctaacaccggctgagaaaaactattctcaaatcgagaaagaaggattggcactgattttcgccgtgcaaaaattccataaaatgatctatggacgaaaattcacgttgcaaaccgaccataagccacttcttgccattttcggaagcaaaaagggagtgcgccagtgcagtgccaaccgacttctccgatggtcgctgatcatcctcgcatacgatttcagcattgagtacatcagcaccaatgattttggtcaagccgatgtgctttcaaggctgatcgcaaagggaaaaagcgacgaagatcgactgattgcatctctccgatcagattcgaaaattgactacattttgatcggatcaattgaagcagtgccaattaaatttaaggaaattgtcgcagctgctgaagccgacaaaaccattcaaaaagtcaagaaatttttgacgaatggttggccaaggaacgtcggagacgaaagtgccgaaataaagctttttcatcggatcaaagaacagctttgcatcacgagaaattgcctgatgtacgccgaccgagttgtcatccccgaaaaacttcggcagaaaactcttcattcattccacaagggacacccgggaatcaaaagaatgaagcagttggcgagaaattatgcctattggccaaatatggacgccgacatccaacagatggtagaaaactgccaaccgtgccaaatggaagcaaaggcaccagttaaaagcaaccttcaaccgtggccaaaaccatcacttccatggcaaagagtccacatcgactatgccggaccatttttcggcaaggaatatttaatcatcgtcgatgccttttcgaaatacccggaggtattcgaaatggccacaaaatcgacagcggcaacaatagaaaagcttcgatatttgttcagccgacacggcatcccggaaattttggtgtccgacaatggcacccaatttacgagcaacgaatttgctaaatttatggccgtcaacggtgtcaatcacctgttttcagcgccgtataatccaatgtcaaacggccaggccgaacgtttcgtggacacgttcaaaagaacatttcgaaaattgaaaggggagggagccccaagcaaagaaatcattgaaactttcttggtaagctatcggacaaccccgaatgactcgttgccaaacagcaaaacacctgctgaaatgttcctggggagaaaaccccgcacaactttggatttgttgcggccgccaccttcacaaccgatcgacagagatgttgaaatggcgagacgcttcaataagcgatttggaaccaaattaagggaatttccgatcggaaacaaagtgtttgcccgccaccgaatttcccaaaattggcaacagggccaagtttcaaagcgaactggtgtgatttacgacgtggcattcgccgatggaagatcagggcgctaccacgccaaccagcttcgtccccgaaagacgtccgactccgatgatcagatctcggtgatgttcgaaaccttcgacatcccaagaccgattgctgttgaggatcagagggaaatcccagtggaaatgccattggaggacccgcatggcgaacaggaaaatttggaaggtcaaattgaccatggacagcaacaacggtaccctcagcgaaatcgccgtccgccgcagcgcttctcaccgtaacctcggaaccgcgcttaaggggggaggtgttcggggcactgccgccgaagtttgaatgatatgacataatgccaatcgatttctgttccatttcatgttccttccctcgcccataaatatgctcccattctcctctaagattgtcttcccttcattcattttgcatttatatttgttccccaaattattgtgactttcttttccttctccaataaataaatatttaattggacttaaacaaatccctcggaccgaacagttgagaattgagaatgaatgttatggaaaggcattgatcgattgatcagtgattgattgggtgggatcacctcttccaaagtgcgttctttgaagaaatcggcacgggcgggcagcaacggagtcaacggatcgccgttcaattccttcagtgagccgcgctgaacaccgccaattggctgaaaaggacaagtgagaaccaaatcaaattggcattggcattggcataccatccaaacggcggaagggaaagtgtgccctggggggaagggatagaaagtattaaggagtgaatgaatgaattcggctcattct

SEQ ID NO: 67173 - DNA, 542 bp, Heterodera glycines
  Genomic contig location: Contig_ID=SeqID_38323; Location=160..701; Strand=-
  SCN-specific regions: Sequence locations=1-265,306-517,539-542
atggatggtccaattgctttcactgacaattaccccaataatgaacaaaccgttattgagccaaatgataaattgaaatttcattgccccgagtgccattacgaaatgtgtcgcaaatacaatgcaaaatgggtggaagagcacaaaattttgacatgcgaacagtttgccaaacaacaaaatgagcaaattcaacgaaatctcaagtaatgtaaaaaataaataaaaatagcatttttaggttctggttgtgccgataggcgccgccgggaaaatttttggtatttttaatgaattttattacaacgtatcgccctttttagacttttctcggagacctctaaattcaggacaatctgaaaattcatgacattttttgatttttcagataggtaccctcaaattcaggacaaatctgaaaaatcagtagactttgtagccctgcagaaaaagcaaaaaaaattcctttaatctcccaacaatttaatataaatattaaagagcatttaatggtttattgcttttttgggaaaaagaataaa

SEQ ID NO: 67174 - DNA, 911 bp, Heterodera glycines
  Genomic contig location: Contig_ID=SeqID_38326; Location=1..911; Strand=+
  SCN-specific regions: Sequence locations=1-13,35-107,129-381,405 -527,549-594,617-911
  Gene Ontology: Mol. function=heat shock protein activity; Cellular component=mitochondrion; Biological process=mitochondrial translocation
aatggctatttttaatttgtttattctagggaagaccttggtcatcgaacaatcctggggcagtccgaagattaccattgacggtgtcactgttgcaaaggccattgacttcaaggacaaattccaaaacatgggcgccaaacttgttcaggtttttgttttgaatgcattgatttatagataaattggattgacagatttttcatgttattcggtgtaacaaatcattcatcgtttttaactcaggacgtggcaaacaagacaaatgaggaagctggtgacggaacgacttgtgccactgtgttggcacgtgccatcgcaaaggaaggcttcgagaacatctccaaaggttttgactctaagactatcattagaatcggaagaagaaaaaatagaaaccgattggtttctcgttcccgtttttcattgcaaaagtgttagtcgagtcaaatatggcccataaaagccactcaacacgtgtccataaacttcgttgctaaggtgctaatccggtggaggtgcgcaagggactgatgaacgcagtggacgaattggtcaaggaactgaaggcaatgagcaaaacagtgacaactcccgaagaaatcgctcaagtggccactattgcagcgaacggagacaaaaccatcggaaaactgatctcggatgcgatgaagaaggtcattgaaatagcacattgtctgatttaacaattttttgcttaggtcggaaacaagggtgtcatcacggtgaaggacggcaagacgttgttggacgagttggagttgattgaagggatgaagttcgaccggggttacatttcgccatacttcatcaactcggccaagggtgccaaagtggagtttgagaagtgcttgattctgttcagtgagaagaaaatcagccaaatccag

SEQ ID NO: 67175 - DNA, 1223 bp, Heterodera glycines
  misc_feature (668)..(668): n is a, c, g, or t
  Genomic contig location: Contig_ID=SeqID_38327; Location=127..1349; Strand=+
  SCN-specific regions: Sequence locations=1-202,224-260,431-671,883 -944,966-1052,1074-1077,1100-1223
gactcattataccaacaagttgctgatcaaaaatataaaggcctaacattccccggctttggagaaatatttaaacgaacacgctttttcttgatcaattcacaacctgacttggattttaatcaatttgacatagtcaacgatgttgaaaaagtcaaatttattggtggattcaatttgaaaccaattcctaacgcagaggttaatttttataattttaaaagtagtttttggcacaaaaaaatttaggcttaaaagtgaaaattaatattcttttaaaaatattttaatttatcttttcattttttgaaaaaaaaatatttaaaaaaatatttttataactattattttaaactgttccactaaaataaaacaataataaaatttttaataattttataattaaaatgataaatttttttcaatttaagttcaaatatccatacaatttggactcaaaaaaaggcgttgttttggtcagttttggcactgttgtcaacacaacaatggtacaatcttcgactataattgaagcaattgccgagacgatcaaaaaatttcccaattttctttttatttggaaattaagtcaagggcacccgaacaaaacatttgtaggattaaaaaatgtgattacagaactttgggttgatcagaagaacatattngggtaaaatattaagaaaaattaaacaaatttatttatataaatttatattgttttacatatctcttaaaaatttaaattctctaaattcatttttattaaactttaaaaagcttttatttaagaacttaaaaaaaactttatttaaaattcctattatattaatagaattgttttttatttaaatttattaattatttcaaaatttttaattagtttggaaatataacaaaatgatattgaaggaagtatttaaaactttttttaaaatattttcgaaatattaagattagttgaaaatatttgtggattttacaaaataatctataatttctttatggcaaatcaaaaaacttgaaccatgttacagaacattacactaaaaagattttgtatatattaaatggggcataaaaatgctttactcttttaaacaattttaattaattttagcaaatccaaaaacggtggcatttgtgtcttattgtgggatgaacagtgtgttggagggcatttacaatggtgtgccgatggtttgtgtgccattctttggtga

SEQ ID NO: 67176 - DNA, 1033 bp, Heterodera glycines
  Genomic contig location: Contig_ID=SeqID_38328; Location=238..1270; Strand=-
  SCN-specific regions: Sequence locations=1-901,923-1033
atgaaagaatcagttgggcaaatgatcatgaaagagatgaaaaatgagggagagaagtgcgaagaggaaacaaatacggacctcggtccgtctgtcatggatgttgttgagagtgaccagaggagccaaggagttaattatgtgttggaagtggaccaagatggaattgaagtgtttacggagaaaaaccccttaggcaagagacaccgaaatctgagtgaagacgaaaacggtaaagatattgaaaatgagggggatgacgaaggaagtggacggaaaatggttatttgtcaaataacggacaaaatggtcattgcaattcggtttggcggaaagatgaagggtccggatattatcggaattcctgagtcgttcgagctgggtgcacagctcagacttggtgacatcgtgtttgtcacaagttacgccccaatcgagcgcttttccgtttggctctctaatgcatttaggattaatgccgacgccgaggccatgacagtctcatctgttcttcaaaattctttggaaaagtgcatagggattgtcatgagcatggtgaaagaacagaaggatgtgccaaaggcggtggacgtggccttccccgagagtcaagttctccagcgactgtatcaacatcagctggacagcacaattgatttggccaaaattaagcctggagtacttataaatgtcacgttcgtgcgcatccatcgcccttccgacattgccattggtcctaagggcatttacatcacaccagccgattttgagggggtttctgaaagagaattggtcgttcaccaaccatgcattggcacggggattagtggtttggttattggttatgagttccccttttcgacaagcactgatttgaagctatgtgaacatggaattgcggcagctgtgtccggagcactgctaaaagcaaaagcagagatggaggagttcaccattcatacggcgttgttcgtcttggaaagcggaaaagacaatattgtggtgacttttgaacattttgtacaggaaaaac

SEQ ID NO: 67177 - DNA, 336 bp, Heterodera glycines
  Genomic contig location: Contig_ID=SeqID_38329; Location=139..474; Strand=-
  SCN-specific regions: Sequence locations=1-91,114-136,191-336
atgggtgaggcaaagtttctgatcggatttgcatcgctgtgctcaattggtgccatcattgcaacagttgtgatgatgcaaacattaaacatacaaataaatgaggtgaaaatgcgtgtgtttgacggagttcaggtaaattatttcaattatttttaaaataaatttaataaaattcattttattttaaggcttttcgtttgaacactgacacggcatggactgaactgatggaggtgcaaatcagtgttacgccaccatccagagcacgcgaaaatcccacaaagaacgacatctttttgcggcaaaagcgacaggactataacgcaatgccgg

SEQ ID NO: 67178 - DNA, 1282 bp, Heterodera glycines
  Genomic contig location: Contig_ID=SeqID_8162; Location=476..1757; Strand=-
  SCN-specific regions: Sequence locations=1-563,587-1282
atggatgagccccgtgtaataggaagaacggatgatgaagaggaggtgatgatcattcgagacgaagatttgcaaggacgaatggaccaatttcatgagaaaactggcgaaagtgacgaatctgatgaagaaaagccgaccggaacaatggcaccagtgcccgctcctcgacggtcgcttctcggcccaatcccaccaattacaacgacaggaggaaaacagctcaaaaaagttggaagaatgagtttaatggcacttttttgcaattaattggcccattggctttagcttccggcaccaccgccccctctgccaacggccgaagaatggtcaacgacgagaaaagcagtcgaatttgcggagccattgcactcgtcaattccgcgttagctaatttgtaaggccctgaaattggattaaactaaaatttcagccagcgaagtgtcctcaagctttgcagatgacatcacttttggcagtgaacggtcatcaattacatcagaagccaacggtgggtcgacagcttcaaatggaacaccaccaaatgcgaacgaccgacaaaagatggagggcgagggggaggaaaagcagcggaaagtgccaaggaaaaaaaggccgacaaaagcgccaattgaaatcgcaccggtgccaccaacgccggcgataagggtcagcagatcagacggagggcgaactgatcacaaattgacattaatcattcaaaactccaaccaatgggaaatagcacgcgtactaatccaaaactgaatcaatttactgaatattagtgatcggaccctgggtggaattattgaggtcgcattgtttgttagctatttgattattcggctgtttcagattcgccctgctgttcccgagtccgattggaacagtgaaagcggcctggagggatcgtcggttgatttagtgcagccaaaaagtgccaatgttcgaattcgaattgggaggctccaatttttggaccattcagcgtctctgcacttttcgcattttgaggagggcggaagagtttttgtcgaatggaactttttggacttttcgcgggaacaatgcgtgacgcgaaacgacgcggaaatgccgcaattgctcacagaatcctttgacttagaccatcagagcggtaatggcacggcaaattggcaattattcaaaataattagaaaaaacgatttcaactcgaaaaacctaaatcaaattcagactacgaattgaatcagaatcaaattgcacttttaactcaatggacgcagctgaacattcg

SEQ ID NO: 67179 - DNA, 646 bp, Heterodera glycines
  Genomic contig location: Contig_ID=SeqID_8162; Location=2517..3162; Strand=-
  SCN-specific regions: Sequence locations=1-74,98-120,144-269,291 -324,347-397,429-480,502-646
atgtcgccgaaggcgcgtgtgctcgcctccgttcgtttgccgctttttcctttggcacgaaatcacaaaattcgcggcacttttcctcttttagacagagtagaaaaaaggacaaaaaagtatttgtttttaaatatatcaaaattaggcagacgaatctgtcatttccgaggcgtccatcgatgtgtcgatttattggaaattcgcttatgcttttgatggattcgaaaatttaaaagtcgaagaaaaagtaagtcaaaagaattcatttaaattgaatttattttaaggttccgttgagaacattcgctcaattaactgaacaaaatgggccaaaggaaaacggacaaaggaaaacgcagcgaattgcgggggaaaatgccaaaaaagaggaggcaattaataaaataatgaaataaattaaaaaagtgatgatcagtctaatcagtaacccattaattaaacgtcattccgccgcagggagaagagaagaaaaagcccgaagaaatggcacaaaaaagggaaattagcaaagagcaaaaggcattggaaaggattggcataaagcaaagggaaaccgacaaaacaaaagggtaattaatactaaaatgataattatatgccggaattgccgaattaaaataaa

SEQ ID NO: 67180 - DNA, 1580 bp, Heterodera glycines
  Genomic contig location: Contig_ID=SeqID_8163; Location=214..1793; Strand=-
  SCN-specific regions: Sequence locations=1-6,28-186,211-746,769 -936,972-1071,1162-1223,1245-1580
atgccaacaaaaattaaaagattaaatggacggatgagcggaagaaattcgcaaaggaacacagtgccaaatgggccgaaaaaggatgaattggacgaattgcacagggccaatcagttgatggcacaaaaggcactaactgatgatattggtactcttctatttttggggccttttttgactttgacaattttaaataataaaaacatgttcccggatgtttccagggtaactctgaccatgaaaatggcacccatttcgaacaattcgaactccgtaacagtattaaacttatttttttatatcccgtatttacgagacaaaccgattcaaatattattctttgccatgggtttgatttcatttcgtttatgtatttaaacttggttttacatgtaaaaatagttttgaaaaattagaattttctgctaatatttaaaatgatgtcataaagtgatcagagagtatgaaaaccgccgggaatgttttgtgactttaaaaatgtcaaaataaactatgcctcaaaacagaaaagtgccgataattacatgctaattttaggcaaattgaataattctaaatttagttaaaagtgttgaagcatcaacttctcaactacacaaaagtcaactcatcaacgagtttaacgggtcgttatcggcccgaaacgcgccaacagcagcaaaaagtggtcattgaaaattaagaccataatttgcaatttctcatttttgttttctaatctcagcagaatcgccccagccaaagaccccaaagtgccttcgttggctccgtcgcgaaccaaacaaaatgcataattagtgaccaagaaaaaaggcctcagcaaatgatgtcgtcgcaattaggacgacaaattaataacagaaaaaggccaattagtcagccggagattgaagaaaagtaacggaaatggaaaagataattattatgaaaattaaaaattgaagggacgaatttgaagaaagcgagcaccaatttgaagttgtgagcagagaaatgacgcaaagagcagacaatgagcaaaacaaacacttgcgattgttggaggagagaaaagagtaaattcgaataaaataaatttaaatatttaaattaatttaaataattaaaattaatttgaataattaaaattaatttaaagaagtgaaataaaggaaaaactgcgggaaatgcaaaggcaaaacagaaaagtgacggacgacaacgaggagttgcacttggccctcgagaaaagtgaaaaggcacgtgaataaggcaattagagaatgttcagatggttaattggtttaatgttaattaagtgcaattgtttaatttcagcgtttgtccgcgcttcgcactgagttcgaccgcgtggcgcgggagctgtcacaagcgcagcgcgaactccgctcgcagtccgactcgctgaacagcgagcgggaggacgcgcaacgacgagcggacggaagcgcacggagtgccgaaatcgtggaccgcgagttggccatcgcgcgggaggagtgccgggcgctacgaaatgcgcacgagcgactggtggaaaagtgagcaaaaataaa

SEQ ID NO: 67181 - DNA, 500 bp, Heterodera glycines; identical to SEQ ID NO: 38332
  Genomic contig location: Contig_ID=SeqID_38332; Location=1..500; Strand=+
  SCN-specific regions: Sequence locations=1-13,36-500

SEQ ID NO: 67182 - DNA, 166 bp, Heterodera glycines
  Genomic contig location: Contig_ID=SeqID_38335; Location=447..612; Strand=-
  SCN-specific regions: Sequence locations=1-101,127-133,155-166
atgggcgcgccaacgattcgtcaacccagccaaaatgtgacgattcgtcaactcagccaaataagaatttcgagggatgcgaactcgtattcggcaagtagtttataaaaaaataaatatttattacgcatgcagtaatttattttaatttttagtctttatgtaa

SEQ ID NO: 67183 - DNA, 225 bp, Heterodera glycines
  Genomic contig location: Contig_ID=SeqID_38338; Location=312..536; Strand=-
  SCN-specific regions: Sequence locations=1-225
atgagccgagaattttcgctccttcaacctgaacttttcgactctagagaggaatacgaacttttcatggcaattcgcggtggccagaggactgccgatttgggacggcgtatccaacgaatgcgcgacgggcttccaccaccgtcgctgtttgaaaaagaccgagatttatggacggtgctggatgaagaagaaattatgtataaggaacgaatgacacttgag

SEQ ID NO: 67184 - DNA, 334 bp, Heterodera glycines
  Genomic contig location: Contig_ID=SeqID_38339; Location=462..795; Strand=-
  SCN-specific regions: Sequence locations=1-116,145-177,205-215,247-334
  Gene Ontology: Mol. function=transcription factor activity; Biological process=development
atgtcagggcaaatggaaatggtattcagctgttcccattacccggacatgttacagcgggacgaattggcacttaaaactgggctcgacgaagatcgaattcttgtaactcccacaaaattaatttagaaaattaaaattaatcggatataaattttacaaaatgctttttctttcagatttggttccaaaacagaagggcaaaatggtaacaattttttgcaaaagaaatatttttataaaataagtttttaggagaagagaaatgaaaagcgaagaaattaaaaatggggcaaaaaatggagaaaatatcacaaaatgaagcgaaaataaa

SEQ ID NO: 67185 - DNA, 637 bp, Heterodera glycines
  Genomic contig location: Contig_ID=SeqID_38340; Location=195..831; Strand=-
  SCN-specific regions: Sequence locations=1-193,222-244,270-303,329 -402,424-474,500-578,600-637
atgtattaccatatatacattattttctatatatttagacgtttgggcactttttcgtacataattcgcaattttggggtgattttgtaagaaaattattctacaaaatttcacaattttttagttttcttaacagttttaaagttttaaaatttaaccaaattttatttattaaaagatttacttctacaccataatttttaaaatattgattttttttacgtgtgtatgaaatatttgattcttcatttaaaaaatctaaaagaaaatataaatttatagtgtgtatgaaatatttgattcttcatttaaaaaatctaaaagaaaatataaatttatagagatcggtattttgaaaaaagcctggacctggacctggattccattttggacctggacctggacaaaaatccaggaaaatccaggtccaggaaaaatccaggctcctcgagacctggatccaggcctggacctggattttttgaaatttgttttaaaaggcaaacaaatgcttgaaaaaatcaattatttgctagaagcatctaaaaatatctaattaatagtaataatgtgtttttaaatttatttaatctgtttttgaaaacttgaaaaaacatcggtcacttgaaaaaataaa

SEQ ID NO: 67186 - DNA, 369 bp, Heterodera glycines
  Genomic contig location: Contig_ID=SeqID_38341; Location=896..1264; Strand=+
  SCN-specific regions: Sequence locations=1-152,230-251,288-369
atggcaaaaccgatggaactgcgccagctgcagcaccacacaacgccaatggcagaggaccaggaggaattggacatgacgagcacaaacccaatgccaaccacaacgatgacaaagacaacgacgatagagatggaagaggtggaggatgaagagggagggggagaggcacaggaagaggaagaggaggtgaaagagcagggcgagcgagagggcgacggggaggaagggacggaaaacatcacgcctgggacggagacagagacagagagagagacagagacggatggagagagggagagagaggacggcaagggaaaaggggacacgggcggagcagcagccgaacaatccgcagaatgggccgag

SEQ ID NO: 67187 - DNA, 1449 bp, Heterodera glycines
  Genomic contig location: Contig_ID=SeqID_8164; Location=437..1885; Strand=+
  SCN-specific regions: Sequence locations=1-802,824-984,1006-1449
atgtacggagagtgtatccgggcggcacttcgttgtagagtttgtgcacatgcacgaaaaccacgatcaaatgagcctcccctgaacatagtcgagacaaaagagcctttggaattggtctgtatcgatattttatcgattggacccgcagcatcttcaaatcggtacattttggtggcagtagatcatttctcgaaatacctcgtggcctgcgcgatcccaaacaaaaatgccgaaacgattgcgaaaaatgttgtaaaaaacttcatctgtgttttgggaacgccaaaaaagcttcatagcgacaaagggacggagtttgttaacgaaacattggaggaaatttcaaaaacactcaaaattgagagaacgacaacctcaggatatgatcctcaggcaaatggtgtaacagagcgcgttaatcagacgatactaggaatgctacgaaagtcgacttattcagcctgggaatgggacgaaagactgccttttgtagtgtttgcctataattcgacaccatcagaagtcacgggtatttccccacatcatttaatgttcggaaaaccagccaactttccgttggaacacgaattaaaattcgccgtaaatccgctctacacaatagaccaaaatacgtatattcaactttttcgtgagtccctaatgcaattagtggacgaagcgcgaaaaaattcccaaataagccgtgcaaaaatgaaagaacacttcgacgcacaagcaaaagtcacggagaacaaattccaaatcggcgacagggttatggtcatttttcccgggtcccacattcgatcaccacataaaaagattttgtggaaccattttggcccatttcgtattacggaattgaataaatcgacggcgaccgtaatcccgtccgataatccatacggtaatccaatgacagtccctcttgaacgattagtgcgcgtaccaaaggaattgccaaacatttgtacaatgccgaaagggaaaaacccctataagaatgttttaaatggactgataagtgtggccggattgatttgccaagaaaacttaaaatttgacggggaagaaaaattgaactctaaaccggacggaataattgggcaattgaggtcaattgcatttttaggcggtgaggaggagcaaatggaaactgaacagatggacgacaaagaggcgaagacgaacgagagcgaaaacgaggaaaatgtggaggaaaagacggacgacaatgaggttgacgcgaaccggagcgaaaaagaagcgaatctggaagaagaagaccaaatttcggtcaggaagaagaggagccgaaaacgctttcttggacattggcatgtgcaggagacgggcacaaatgctgttccgatgtggtcgtggccgacttggatgccgtccttgaccgatcaggcattgggctcacgaagatcgagaatccgctaa

SEQ ID NO: 67188 - DNA, 795 bp, Heterodera glycines
  misc_feature (795)..(795): n is a, c, g, or t
  Genomic contig location: Contig_ID=SeqID_38343; Location=46..840; Strand=+
  SCN-specific regions: Sequence locations=163-564,586-765,787-795
atgagcgaaattgcgtctggtgttttacgccagcaactggatttgattgccacgcgcactggggaaaataaatggctgacgcgtgagcaaacctctggcgtgcagcaacaaatccgccaggctttgtcggcgttgccgttgccggttaaccgactggaagaattcgataactgccgtgaggcgtggcgtaaatgtcaggcctggttgaaagatattgaaagcgctcggttgcagcataaccaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgcaggctggttgctggcgcgtggtgaagcgtcccctgagcaaattttattgctggcgtttggtcgcaaagccgctgaagagatggacgagcggattcgcgaacggctacataccgaagacattaccgcacgcacgtttcatgcgctggcgctgcatattattcagcagggcagcaaaaaagttccgatagtcagcaaactggaaaatgataccgctgcccgtcatgaactctttattgctgagtggcgcaagcaatgcagcgaaaagaaagcgcaggcgaagggctggcggcaatggctgacggaagaaattgcagtggtcagtgccagaaggtacttctgggatgatgaaaaattacagcgtcgccttgcctctcgcctcgatgcctgn

SEQ ID NO: 67189 - DNA, 824 bp, Heterodera glycines
  Genomic contig location: Contig_ID=SeqID_8167; Location=43..866; Strand=-
  SCN-specific regions: Sequence locations=1-165,201-601,624-737,759-824
atgtggacggtgagttgtgtttggcattgctgattttaatttgaacttcaattataccagtgtctgatatatccccttttttagattaacaacttttctttttgtcgcgaggaaatgggcgaagttttgaagagttcgacgttcaggtttttcccttttaaaacgtttttttaattaaaatttttaatagaatattttttgggttcgtgttcattcttaaacctttgggctgcatattatttgaaaatttgattggcaaaaatgatttaaattttcgatttttgggttgagtcggttcactcattgcccgtgggacttgaattttggattttgtcacatttccgccttcttacgccgtaaaatttgtccattggttcagtgccggcccgaacgacaagctgaagtggtgcctgcgcatcaatccgaaaggcctcgacgaagaatccaaggactacttgtccctgtatttgctgctcgtccaatgcaacaagacggaggtgcgcgccaaattcaagttttctattctgaacgccaaacgtgaggagaccaaagcgatgggtgagtgacgggcggagggaattgggacggcacagaaattgccatatttttaaaaaatttaatttccaactaaaaataagttaaattgggcatttattacgcgataaaaaggaccctaaatcagcgacggtcccattgcccccctaagataccccacactcgaaattttaaggaaaaatagtattttatagtttttatgttgaatttgcgatttccttgtcggtgtaccccctccaagacttcagtcacccaaattttcaaataaa

SEQ ID NO: 67190 - DNA, 538 bp, Heterodera glycines
  Genomic contig location: Contig_ID=SeqID_8167; Location=1141..1678; Strand=+
  SCN-specific regions: Sequence locations=1-30,60-109,131-180,234-538
atgcccaggccaatgtccagcggaatcactgaggaggaggacgacgaggaggaggaggacgtgctgctggtgccagaagctgaagaagcggccgccatgcccaggccgctcagcggcgacatggaccggtactgctggtgggaggagccgaccgcactgttccctccggcaccgttcccaccgccgctgctgctgcttgtactgctcccgccgccgttgttgctgctctgctgggccatgctgccggtcggacagttggcaatgtaaccgggaccatccgtaacctttacaagggggaaagataggcgatgcacacaaaacacacgaatgaactggcgagatttcgaggtccatcgggaaccgaccccatccccacgggtgcatttgacccaagaaatatgtcgagttaatttggccaactcgtcaagttttgcaaagtaatttggtgttcggtgtggtgaaaacccaactcgtactgcaccgaatcgtgttgttttccgacaaaaaatcgtcataacttttgtcaaaatcgaccaaa

SEQ ID NO: 67191 - DNA, 279 bp, Heterodera glycines
  Genomic contig location: Contig_ID=SeqID_38352; Location=203..481; Strand=+
  SCN-specific regions: Sequence locations=1-279
atgttaaatggaatagtgagaaaaaccatccgtaaaaaaccgatacggacccggcctctattcaatcagatttattaattttgttgttttttcagtcgagttcgacacgcgtttctcatgaaattgttttggatgacgatggcgtcgactgtccatccgttgttagagacgaattgccggcgaaaaagcagaagagaatttgaatgaatagaaatgaagaccttttatttcttttcgggtattcgttttgtttatcgttgctcttttttacggtgctca

SEQ ID NO: 67192 - DNA, 487 bp, Heterodera glycines
  Genomic contig location: Contig_ID=SeqID_38352; Location=586..1072; Strand=+
  SCN-specific regions: Sequence locations=1-205,241-439,462-487
atggcttccactcatgaaaaacggacagattctcggcttgtttttgtgccattcgtcaccttcgccgaccctcttttttggaatgagattaaccgactgaaagtggaccattggaaattggacgagtcacttaagccaatttatgccacaacaacttttcgtaagttttatttacctaaatactattcattgcaattttatttgcattttttagtaaaataatcaaatttatttaattttgtacataaaatggtttttcttaagagggtgcccagccttctgatgggctcctctccttcgaccaattttccatcgctgccgaaagtggccaaactttgccgcttcaatctgtccaaccgtttgtctctccattccatggcacttttcttttgctaaacacaaaaaaagcattttccgatggttttgatcgaaagaaatttttggaacagtcagctgattcggtaatttattgaattttcataatata

SEQ ID NO: 67193 - DNA, 1082 bp, Heterodera glycines
  misc_feature (1074)..(1074): n is a, c, g, or t
  Genomic contig location: Contig_ID=SeqID_38354; Location=116..1197; Strand=+
  SCN-specific regions: Sequence locations=1-299,321-1082
  Gene Ontology: Mol. function=structural constituent of muscle; Cellular component=secretory vesicle; Biological process=striated muscle contraction
atgcccgtttcccccgtcttaaatcagcagaagggagcgccaaatgcaaacgaaatcgcgggacgtggcaacgcaaaaggagagaattccgtcagaggtggagccgagcaacattcattttgacaaaaactttatttcctctttttcagtgaaccgttcagtgcaatcaaacggagacgaaggaatggaaatggttggaatggccggtgagaatgggcgaaacattgaaaccgttgaaaaacgattgacaattttcattttcagagattcgctacgaacagaagcaacaggtcgccggcgggggtctctgctgctgctgcataccgtgttgctttttcaacgaatcgtcgcacgaggaaccgccgaaaatcttcaaattcttcatgacaaaaaagaagactccacaacagcctccagcagaagtcgtgcaaccgcaaaactccgttccatcgccaaagacatcgacaaaccaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaccaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaccaacagcctccagcagaagtcgtgcaaccgcaaaactccgttccatcgccaaagacatcgacaaaacagctgcctccggtctccgtgcatcagctccgctccgttcatcgccaaaggcccttcctgtcgaaactacacactncacgcgac

SEQ ID NO: 67194 - DNA, 716 bp, Heterodera glycines
  Genomic contig location: Contig_ID=SeqID_8170; Location=2501..3216; Strand=+
  SCN-specific regions: Sequence locations=1-94,116-214,236-510,532 -641,665-716
atggatttaattcttgccaccgattggataaacaacgcttatcccgaaatggatttacaggacgccaacaaagagaacaaagagccaacgaaaaagcaagaggaggaggcggaggatccaagctggatcagcctgattgacgaggagatgaagcgcgagccgctcgctccaattggtgaggagacgccagcaacaagttgcttttgttttaaacgtatatttaaatttaaatttaggcactccaaaaaaatgtgcatgtgccgaacgccgtcgccccgttccgctcgtggaccatctctgcaagcggttcaaatgcagtgcccatgaactgcatgtgcttttcaaaagcttagagaaacgccgggacattgtggagcatttgcgctccgtccaactgcgcactgcccacctgcgcccgtccgtgcgcaattttccagtgcgttgtaatgacctgtccatcctggacacccactcggcccccgcgtaccgaggctacctcggcataacggtatttttatttgttttgtttgtccgtaacaaaaaaattaaaggtccggatgcactactacataaagcatggcatccgcttgcgccaccccaacttgccgtgcgtcgttgaatttggaggcggagatcacaaaacttttttccctcttgaaattttgtccattgttttgtagatgtgttcaatttccaattgtactgttgtttttaaa

SEQ ID NO: 67195 - DNA, 1386 bp, Heterodera glycines
  Genomic contig location: Contig_ID=SeqID_8170; Location=3732..5117; Strand=-
  SCN-specific regions: Sequence locations=1-331,361-1143,1166-1386
atgccgaactcaacaaggccctgcagctcggctatgtggtcactgacctttttgaggtagtcactctttaaaatttttttgcacaaaataccaattaggtttgggactacgacgagtgggacggcacactgttcagctcgtacgtcaacacatttgtcggtctcaaagtgcaggcgacgggctggcctgaaggatgtgtcacggacgagcagcgtcaggcatttgtggaggactttgagcgcaccgagggcatccagctggaccctgccaaaatggaattcaaccccggcctgcgcctcatcgccaaaactttggcaaactcactttggtcattaataataaaatttatttatttttaaacgaaaaatttacaggggaaagctcgcgcagcgggtgggccgaaccgaaattcgctacacgcggacgccggctgaattccacgagctgcttgaagacccgtcgctggacaagttggattttgtccacgtgtccgagcacatggaccgctgtgtcgtgcggaagcgccccgagtttgccaaggccccgctgaccaactgtcttccggtcgcttccttcgtcacttcatatgcccgcctgcatctgtacgactacattgagcaggtgttggcgattgacggagctgagctgctctactgcggtatgctgttttttcacaaaacatttggtgtacacgcttatgctttagacacggactccatctactacgtaaacaagatgggtggtccgtgtgttgctgagggcgaggcactgggccagatgaagcgagagcacactgatcgcagaatcgtcgagttcgttgcgggtggtccaaagaactacggcatccggcatactgcgcgggacggtacggatgagcgtgccaacctgaagatccgcagcttccgcctgtcgtacgcggcccaacagttgctcaactttgaggcgatgaaagagctcacgctggccacgtacaacattgacggaccaatgtgagttttgcaatttatcattaagtttgtaaataataaaatcttagcgacgacgtgctggacaatgacgacctctacgtgttcggaggcggtgagcatcgcgccattcgggtcaacttcccacatattgaccgcaacgcttacgccgacctttacacacacgaggcacacaaagactacaggcccttctacgcaaaggggcgtgtccgccccggaatgcagacgcgtccctttggctatgtggaggatgatggaccaccgaacgatggacaacggacggagcgacgaaagagaaattttgttgatcatgaccccgcccaaccagggcattccgggtggttttgatgttgtctttttattttttgttcatttcattcaaataattgtaaataataaa

SEQ ID NO: 67196 - DNA, 803 bp, Heterodera glycines
  Genomic contig location: Contig_ID=SeqID_38363; Location=148..950; Strand=-
  SCN-specific regions: Sequence locations=1-283,327-570,597-630,656 -742,790-803
atggcatcggcatttctgtttggttggtggtggcgcgggaacgtcgcccgactcgatgatgtccacccgacgtccgttgtggtatcaatagaccttcacccgctcggaacggtgttggacctggcagcacaaattatcataattaatctaatggtgctaggtcatttcttaaattacggcactaatgggcgtttcttaaaccggccaaggggtaggaaaacaaaaaagtaacaatatgttagtcatgaaattcaaaaaatttgcttcagaatttttggtgaggttttttttaaatcaataattttttttgaaaataatatttatttgaaattctaaaaaacatttagctaataatggttttgaaaaaatttaaaaagcattaaaaattaagtctcccatagttagtggttgttggtgtaccgtaccttgcaggacagtatgacagaggtagcgtcaaagtcgaattggtcggacagttccacctttggcggccctttcagcaacagcatgtggtgcaatgattttggcgggaagccgtacacttcagcgacacacttaaactagccaaatttgacaattttcaattttttaaacagcaaaaataaattaattttcaataattcttttgcgaaattttatatttaataaataatatgttatgaaatgcatgtctttatttccagccaaaaaatcaccatgtattcgccttctttccagtccaacacatcagtgattgttaagctaaaaatcattaaaaaaatattcaaaaaaaaaatttaatttaattttgtagttaaaataaa

SEQ ID NO: 67197 - DNA, 756 bp, Heterodera glycines
  Genomic contig location: Contig_ID=SeqID_38366; Location=441..1196; Strand=+
  SCN-specific regions: Sequence locations=1-756
atgggagcaggtgagtcagtccattcgtagcaaactgattgggaactgggaacaaattggcaaaattgtcctgtcaataatgataatcattgtttttacagactttttgatccggtttggattaatgattagagatgaatacgttggcagaggaacatgacttttggtggaaacaaaacgcagaaaattgtgaaatctccagcacgcctcaacatgatggatctgaatgcatctgtagaatttggtaacgaaattgagctcagtcccgttaagctcattgaacccgcccaaacccaggcatacaaaattgcaggaaaacgaaagagaccggtaaaaaggactcgcttcagttttcgggcgccaaaagtactcattgtgcttttagtaatttttcttcccaatgcttttgcaaatcctgatgtgaataaccaaatttcaattcaattcactcctccttcaatcgtttatctgcttattattccgtttctgatttttgtcactattacggtactgctctggtcaaaacggaattcagaccttccaatgctcccaaatctgaatgcgatttcgccgcatcacgccgtcgtacagacattgattaattccacacccgtccgctgcttaatggacactggcgccagtttgactgtcgcaccacgatcagttgcagatgaactcaattgtcggacattttcatccgatttggaggcaatgagtgcctcaggacatgtcattcgcctcaaagaatatgctcag

SEQ ID NO: 67198 - DNA, 243 bp, Heterodera glycines
  Genomic contig location: Contig_ID=SeqID_38367; Location=211..453; Strand=+
  SCN-specific regions: Sequence locations=1-56,223-243
  Gene Ontology: Biological process=N-linked glycosylation
atgatagaactaatgaagcagttgaagaagcatttacaaattgatgaagaaatcggagaaaacaaagaaaaagaaaaggtggaggaaatgggggaaaagaaaggcaaaaaggaaaaagaaaaaggaaagaaaagggaaaaggaggacaaacaagaaaaaggagagggaaagaaaaggaaaatggagggaaaggaagacaaaaaagaagagggaaaggaaaaggagggcaaaaaaggaaaatga

SEQ ID NO: 67199 - DNA, 141 bp, Heterodera glycines
  Genomic contig location: Contig_ID=SeqID_38368; Location=90..230; Strand=-
  SCN-specific regions: Sequence locations=1-141
atgcctttacttgggaagaaaattgagaaaaatgacgcggacccaaggcgacatttggtgggtggcgccgctgcgaaagcgaatgttaacagtgacaacggaaaccattgtggacagagcgacaagaatctgaagaaaacg

SEQ ID NO: 67200 - DNA, 991 bp, Heterodera glycines
  Genomic contig location: Contig_ID=SeqID_38369; Location=1..991; Strand=+
  SCN-specific regions: Sequence locations=1-991
aattttaaatggaggccaaaaagattgacccggaaattacgaccgatgacgttaataaattcctagaaaagcagagaacatacacgattcacaagcccatcaggaaaaaattcccgagactaaagacggtaccgagcggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatgattgaggtttttgatcgggtgttcgaaaagtcgaaaattatcccgatgaaaatatatagcgacagcggactcgagtttcaggctggaaaaatgaaaaaatattttgaggaaaaatttattatcaaaaatgtgatgtatagtcctgaccttcacgccggagtcgttgaaagggcaaatcggacaataaaggagcgcttgtacagatattttacaaagatggacactctacgatgggtcgatgtaatagacaaaataataataaacattaacaacagtgtgaataggacattgggggccaagccagtatccgtaacttttgaaaatgcccgggcgctctgggaaaaattatataaggcgaagaaatttaaaatttcgaaaaagaaaaaatttaaaattggcgatatcgttcgaattatcaaggaaaaaggaaaatttgcaaaggggtatctcccaaactttaccgaagaattatttaaaatcgttattgttaattcaacgacacccgattcatacaggatcgaagatttggaaggaaatttaataaaaggcatattttataaccaggaattagtgaaaacagatggatgatttttacattgtactaccgtcgaacacaccggggcaggagaacactacgtcaaaattcacagtacgcctccccgagactttggaattgggcacaaattggtcagtagctctctcat

SEQ ID NO: 67201 - DNA, 62 bp, Heterodera glycines
  Genomic contig location: Contig_ID=SeqID_8171; Location=297..358; Strand=-
  SCN-specific regions: Sequence locations=1-62
atgatcaacaaccacgtcaatggggcgaatgacgtcgacatggaaaggaccgaaaacgaaag

SEQ ID NO: 67202 - DNA, 2237 bp, Heterodera glycines
  Genomic contig location: Contig_ID=SeqID_8171; Location=913..3149; Strand=-
  SCN-specific regions: Sequence locations=1-318,340-406,435-591,613 -692,714-727,749-879,901-1063,1085-1183,1205-1941,1981-2237
atggaatttgtcggcactttttcggacggacagtcgcccgaattggtgcactctttggacaaattgatggagcgaatttgcgctgcccaacaaatgaattggtttcggcactttatttccaggtggattttccccaattcttccattgctttaatttttttcattcagaggccccgtcgaccaaacttccatcaaaatttctgcattggacggtgccgaacgctacgagctgtttgtggtcgatgaccaacagttgaaaacaatgtgcagttatggcgcgtttatagtgccattaggcaggttggcattccgtcccaattttgggagccacaaaattttgtgaattaaatatccaaacagtctattggcggagcgaacggctcattgaaattccgttgttttaattccatttaatttttattttagggaaaatgattggcttttcgcaactcaaaatggccgcacagttctcagaaagaattgcgaacttcatcgactcgtcgtcgtacggtaacacaatttttagataattttttgcatttttttactctttcgtcagcctttttcgtggtcagagatacggcacggttgaggacattcagagggaattgaacgtgttcattttggactttatgcccaaggcgtgtgccggccaaaaagtaagcgacgatttgtcacggaagcaatggcaaattaaaatttaaatcagcagaatcgcctaccaacggttttccatggctttgtctcccgcttcagatcaatttgctgtcgcttggctctgccgatgtcactgatcaaattgggcacggcttttcaaaaatcagtggcaaatggtccgttgaacaggtcgaagtcgaggggggcgccacgcggcggcgtttggtgttcctggacagtgccaatttgatccaatccgaggtggaggtggtgcgaagtgagtgccgtagcaaaaaggggggatttgctgagaaaaattacttatattgtgactgacacttttgcattatttttaagagtcaaaaaatggcaaccgttggcacattgtgtggtccgatttgtcatgccaacaccacaaaatgatgctctctgcgtttgcacttttgccgtcgttgtcctctgccggtttggcggatgcgttggaggcgccgcttcgcattgcactgctcggccttggcggtattggaaaaataggcttttgcaaaaataacttaaaaatgccattatcaggtggaattttggccaagtttatgcacgacaagttcaagcaggtgtgtgttttagtttgtctttttgtttcgctgtgttattttctgtatattaattgggcattattttcattaaactttttttggccaaattataaattttaaatctccccccccctcctaaaaaatagtctttccttttcagtcccaaattgttgcggtcgaaattgaccccgaggtgttggcaattgcacgaaaacttttcgactttccgacagaatccgaccgattggaagtggtcatttgcgatgcgatggattttttgcgcgaaaattctgcgcaaggtgagttttttttgctccacaaaatggaaaatttctgctctttttacatactcttcggcaatttaaaaggccaattaaataattatgccccattttgtacagattgtccaaaatttgatgtgcttttggtcgatttgtccggcggcagtgtcggaaagggcggcctttactgtccaccggcccaatttgtcacggaggacacgctgaagcaaatgcgcagttgtcttgtcgaaaaaggcacataattaactaattacctaacgcccttcgtctgctctttcccaatgcattaaattccccctcaggcggcgttctttcgcttaatttggtcactcgagacgaagaagcatctcaaagtgtgaagagagtgctttccaccattttcccatgcgtttattcaataaaagtttgttttgcttttttaaatccattaattttgctcaaattttagggggacgaagacatcaacgaagtgttgctctgttgtggcacggccaacgaggaaattgtgccggacatttccgcgttgggacttaaaggggagaagccggtgaagaggaagaaagtgcagaaaaggagcagcaatcaaatgccaaaaacgaaaagcgacagcgcaaaacggtcggaagagccgtggatgaaagaatgtgcggaatatttggcgaacaaaaagcaatttgtcacataa

SEQ ID NO: 67203 - DNA, 805 bp, Heterodera glycines
  Genomic contig location: Contig_ID=SeqID_38372; Location=197..1001; Strand=-
  SCN-specific regions: Sequence locations=1-312,334-374,396-585,623-805
atgggatttagtcggaataaaattcaagaatggaagaaggaacttggtaaacaaaatattttgattatactaatttaattaacttttgggggttttccggaaatcctgaaaataggcacatcaatcacaaaaaccccgaaataggcattataagcatcgtagccttcccaacccaaacgaaaaactcgtttttcgtgcttatctgagcgtattaagtgcgcagaaatttttggcatttgcctaaaaacgaatcccttaaaaaagggaaaaagcaatgcgataaaaaagaaaattaaaattcaaattaaaggcttcaatttgatcttaatttaataaattctcttttaattgtttaattaacaacaacaaaaaaatcttcaatttttctttttcagttggcacaaagaatttttccaaccaacaaaggcatgaaattattgagaaatttgaaaaagtgaaagatgaatttgctaagaaattcaatttaaagccgagctacgaaattgaaagaaaaattgtgggaaaaattggtgttggattaagcacagtttaccaatggatgagaaaatttggcttaatcggaagtaattttttaattcataaataacaataaaataataaagttaatcggttttatcctttagtaaggcacaaaacctacacggatgccgaacgatcggaattgtttgaaaagattgacaaaaggaaaaaacgaaacccatgggaaagcgagcgaaaaattgccaaagaattgggagtgtcaagagtaagcataatgcgatggagaaagaagtctcaaaattag

SEQ ID NO: 67204 - DNA, 840 bp, Heterodera glycines
  Genomic contig location: Contig_ID=SeqID_38373; Location=182..1021; Strand=-
  SCN-specific regions: Sequence locations=1-840
atgttgtctgatctgcttttaacccacttcgacccctcgcttccaataatcatcgcagctgatgcttcaaaagatcgaattagagcgaccataagtcacattttcccagacaaaacggagaaggtcattgagcacgcgtcaagtgttctttctgaagaacagcggaactacagccaagtcgaaaaagaagctttggctcttgtcttcgctgtccaaaaatttcaccgaatgatttttggaagaaagttcacacttctgaccgatcacaagccgttgatttccatttttgggtccaagaaagggatcccaatttatgccgccagtcgactccaaagatgggcacttattttgtcaaattacgaatttgacattcgctacatcaataccactgcgtttggtcaagtcgacatgctttcacgacttatcgcgaattatccgcgacccgaagaagatattttgatagcgaaaatttgcaccgaaacagaatgtttcatcggcacaattttgcaggcacgaattgatcaacttcccgtcactgcaaccgaaatagcagaaatgactcaaaaagatgaaattctacaaaaagtggcaaaattctccaaggaaggatggtcacaaaagtgtaatgaccccgacctcgcaccattctttccaaaacggaacgaaattttgcaaatcgagaattgtctgctttatcaaaaccgagtcatcattccaacagtgttacgagacagaacgttgaaagcgcttcacatggcacacccaggaatagtgcgcatgaaagctctcgcacgccaacacgtatactggcctggaatggactcagctatcgagaaattg

SEQ ID NO: 67205 - DNA, 609 bp, Heterodera glycines
  Genomic contig location: Contig_ID=SeqID_38374; Location=619..1227; Strand=-
  SCN-specific regions: Sequence locations=1-78,100-394,442-609
atggttgggagtttaaaagtcgagactcttgtgggatcgaagttggaaattgaattaacgatattgatgaattattcgagtatgaatatttttaaaaaccgagatttaggcgatcgaagttggaaattcgaaaagaatatttgtaaaagtcgagatttaggggataaagttgaaaatatgaatatatttcataacggttagtaaaattgcctatttaatgaaatgtggtggtacggtggcccgtttaattgtttatcattctctgagtacggtatttaattttttggtggatatttggctaattaaaaatgatgtcaattaaaaaggtaaataaagatcatagtttaaaactttgtggcggtctctgagtcataagacgaattttgtcctttacaaaattagtaaatttaaaatataataactttataaaagtataaatttggagagcaaacggaggtaaaagaaaggggacgagaaaatttgtgtgatgatttgtcactaattattacacacattttatcagtgaaaccatcgaagaaccaaccatcccaatccatcatcatttgttaacactcgcagcaaattattgaaatgggaacagtcaataaa

SEQ ID NO: 67206 - DNA, 327 bp, Heterodera glycines
  Genomic contig location: Contig_ID=SeqID_38375; Location=498..824; Strand=+
  SCN-specific regions: Sequence locations=1-167,192-327
atgaaaatacagccaaatcatatggccgactttaaatcagattgtatcgaacgaggacacttttgggctgagacacccgttgtgaatgtaagaaagtgttatataggcacaaaattgcagaaaaatgacttaaattggtttagaataatcttttaacactttaaaaatgatattttttgtatttttaggggtgcattaaaaaaaagttttttattttctcgcaagaaaaatatgtaagaaaaagtccaaaatatgtaccaatatatgtataaaaatatgtacatatgtaatatatagaaaaatcccgaaatatgtaaaaatatgtaa

SEQ ID NO: 67207 - DNA, 388 bp, Heterodera glycines; identical to SEQ ID NO: 51536
  Genomic contig location: Contig_ID=SeqID_38377; Location=86..473; Strand=-
  SCN-specific regions: Sequence locations=1-20,42-275,297-388

SEQ ID NO: 67208 - DNA, 222 bp, Heterodera glycines
  Genomic contig location: Contig_ID=SeqID_38378; Location=716..937; Strand=+
  SCN-specific regions: Sequence locations=1-124,146-222
atgacggaagaccaaattgagcagagagagtcctttctgtgcaatttggaggacgccaatttgaggacgaaggcgcagtccgagctgttgttgtccgacatgcaagcattcaaagtaagccatgtttttgtctaagtttttggttctgtttaaggccgcaaatccgggctgtgaattggtggattttttgagatggcattcgccaagaggatctgacggaag

SEQ ID NO: 67209 - DNA, 698 bp, Heterodera glycines
  Genomic contig location: Contig_ID=SeqID_38379; Location=192..889; Strand=-
  SCN-specific regions: Sequence locations=1-185,207-593,615-698
atattttttgaatttccttgccaagagcaattttccgaccacccgacggggagtattgagcaccatcgcctctttgtttgatcccctgggattgtgcagcccttgtctcgtcaaggcaaaaatgttttttcagtcactctgggattcagccaaggggtgggatgagtcaatcggaccaaaattagagaaggattgggttgccattatttctgagtgggactgccccccagtaacgtttgctcggtataccccgtgtggccaggcaagccttcagctccatgtattttctgatgctggtcccaattcatttgcctccgcagtctacctgcgctcagagcttaacggctccgttcgggtctcgctacttttcgctaagtcgcgactgagacccaaaaagttcaaaaacgatgggttcaccataccccggctggaattactgggacttattacggcaattcgtgccaaaaattttgtcgtttctaatttggatttttcgttcgaaaacatttatttttgggcggattctcagataatcttatcctggttggccagcacggcctctcagcccattttcatcgccaatcgattggctgaaataagaaaggaaaggggcgccttttttaagttcgtgaggtctacggataaccctgccgacttgggaacccgggggctctcccagaaagggaatggccaaacga

SEQ ID NO: 67210 - DNA, 2140 bp, Heterodera glycines
  Genomic contig location: Contig_ID=SeqID_8174; Location=560..2699; Strand=+
  SCN-specific regions: Sequence locations=1-771,900-1070,1092 -1440,1490-1601,1623-1876,1898-2140
  Gene Ontology: Biological process=body morphogenesis (sensu Nematoda)
atggcatgggttgcggacggaatcgaagaggaggatgagcccaccaaaagctacgaacacgccgaacaggtggccaccgattggaagagagggcattgatcgatcgatcgctcgatcacctaatcaagcaatttattaaccattcattctttgtgctattctcacccagggcacttcgagatcgtgcagtcaagaggggatcgactcggcacagaaaaggctctccacaattgctgaatcgagcagcagtgcgccggaagaagcgagcagcgaattcgcgtcgggaaatgacataatggtgtgattagctgatcgccaattcggaatcgatgcgcaagtgcctttgacttatctctgatcactttactttttgaccaataaacgaaaattcggagagacttaatgattggtggtcgtcatcctccgaaatatgctgaacaagaaatggtaagccatcgaatccgttaattagcgaatgtctcctccctctcggcgtcaccacccatcccgcttcgtctgctttatcgtcccgtttctttctcacaagtcaataaaaagtgatcagtcctttccttctgatcgaaaatccgccccaggcattttcatcttccaattatgttcccgcgccccctcagttgtcctcctaatcacttctcctcacttagtcctcctaatcacttctttttaattagtcttccgaatcacttcttaattagtctcctaattattatcctcaattattcttcaaaatcacttttctccatcactgtgcctcccttcccaatgctatcactttgcttgtctcctttccttctcctttccctccgcctccttctcatcactcgccgattcgtctcttctcatccgctccgttctctttccgaatttcccgtccctccaactgacgacaattggcaagaaacgaccaaatctccttttgaggagttgcgggagcattttggcaaaataagtggaggaaaatttttgaatctggaggaaaagttggcaaatgccaaagaatatgtgcaccgaatggaatttggggacagaacattcacccacgacgtaagtgaaatttcaaggggaagaaatgccaaattggtgttgcacagaatgaggcggacaaaaggaggcccatttcgatcagtccgtcacagccaaacgtaagtgccgtaatggcaccggtgctttttgaaggtcagtgattgtgcaaagggaagtgccattccctgcccccttcaggcgacattatcctaaacgaacgacaaattgacgccatcctaaggcgccttaaaaaactgcaaaacaaaaatcgcagaaagccatcgcctcaacggacaatgtgccaacacagttcatcctcaaagcgtagcataaatgctgacccggacaccttttggcatcaaatgccaatcaaattccatctgcacgattcgctcggtgtttgcttctttctgttgttttctctaattttcccattttcatcttcagatttgacggccattcaacaaattgcgagtgccattgccttttgggagaacaacacttgcgtcacttttgaacatttggaccgggagccatcggcggcggaagaaaaggaagaggattttgtggacttttttaagggccatgggtcggtcggatttaattttgccactgatggcggattttctctccgactctttcagttgctattcgatgatcggccgttccggggggcggcagggagtgtccattggcagcggatgcgaaagggtgccattggcagtgccaacatttattttccgagagagcattcccaatttcagcttggcattgtggagcatgaaattggccacgtgtggggtgagttgcagtgttaagcaccaaaaaatccaccttatttgtccccccttttaggcctttggcacgaacagtcgcgcccccgacgcgtggaaatatatcaaagtggaaaaggtcgagcacagaagcacaccaattaacactaattagtcacccagcactgattaatacatgttttcaggaatttgttctgccttcctatttgtctgactttcaactccgcgacgatgacgaaattatgacgctcggactgccttatgattacggctcagtgatgtgggtgaatgcgattatctaa

SEQ ID NO: 67211 - DNA, 84 bp, Heterodera glycines
  Genomic contig location: Contig_ID=SeqID_8175; Location=591..674; Strand=-
  SCN-specific regions: Sequence locations=1-84
atgtctctcctcccttctgatcattcaattgtcaccgtttctgatcagtcaccgatttctgtgtctgatcactcattggtttcc

SEQ ID NO: 67212 - DNA, 320 bp, Heterodera glycines
  Genomic contig location: Contig_ID=SeqID_8175; Location=1047..1366; Strand=-
  SCN-specific regions: Sequence locations=1-116,139-320
agaagtgtccttcgtgccaacttccgagtcgttctcggttccgccgcgttggctttgcttggctccgtccttttggtgttcggcagttgtgtaatgcttttccccaacgacatgggttctgtctgctcctcttttttcttgctcatttcgcttttctccactttagatgtccacggatggattttcctcgtcgtcggagtgctcttcgccattcccggcttttaccacgtttggtacatcggctgcactctctgcggacggcccggctacagtttcgagaatttgccaactttcacaaagcccaactttccctactaaca

SEQ ID NO: 67213 - DNA, 495 bp, Heterodera glycines
  Genomic contig location: Contig_ID=SeqID_38382; Location=7..501; Strand=+
  SCN-specific regions: Sequence locations=1-7,31-132,177-324,367 -406,428-495
acattcctcaattttcactaaatacaaattctcatatttgcttagtcatctgttaatttgtgtaatttacggtgcatttacactgaattatgtgctcgcatttgcattcgaaaatgcgggaaagtatggcgcaattaaatcaaaaattaaaattaattaataattttaaatttattcagtccaaccaccggtgttgtggccgaaactttgctgggccccgttggttataaattcttcgccggcacattcattatttcattgggtagcacttgctgttatgtgtccatttttgtgatcatcagatgcaaaaatgccggtaaatcttggcattcatttctttggcattttaaaattcaaaatattttttacagtaacccaacagacgaacacacgagttttacggtcattgatcatcattttgtccattaacattggcggatatctgaccaatttggccatatatcagttgctgtatgcatttggttcaattttggg

SEQ ID NO: 67214 - DNA, 199 bp, Heterodera glycines
  Genomic contig location: Contig_ID=SeqID_38383; Location=355..553; Strand=-
  SCN-specific regions: Sequence locations=1-23,65-199
aaccgttgtaatttcggcaacttaaaagcattggcaaagaaagaagaaacaaacaatggcaaattgatgtacaaaaaataaattttcgaaaggaggcggattaaaattcaagaaaatgggatggagaaaaagaaagtgcaattaacagatgaataaattcattcagtgattgaattaattgataaaagataatttaata

SEQ ID NO: 67215 - DNA, 742 bp, Heterodera glycines
  Genomic contig location: Contig_ID=SeqID_38388; Location=158..899; Strand=+
  SCN-specific regions: Sequence locations=1-43,65-198,250-444,476-742
atgaaaatgccaaatgtctcacaattattttgtgttttaattgttttttcaacatttattgaaaagtcaattggtgcccccaaaaaaggaactgcttctccactagaaaaagcagagcaaaaagacgacgaaccaaaattgggaaaagaagacaaaaaattggtgaacaacaaaaaagaattgctaaaaaaagaggtgaattttaaaaatatattttaattgaaattgaaatttaattttaatatttttgattgaaaaattgcaaatgcaaatggaccaacagttgaacacaattttggaagaaaaaattcctacttttatacttgaagtgaatgaaattgcccaaatgattgacaatgaacaaaagccattggaacgcaaatttattcaacaattgatagacaaaatgcgaccattgtacggtaagtgaaggaaaaagtactgtaattttaaataaaaataaaatattaaaaaagtagttgatgcgaagaaggaccatcttcacttgtggtccaaagtgcgcattttaaagcatgacaaacagataaaagatgacgtgcccaccatggaagtgttggtaagaaagttttatgcagccaatttaaaaatacccaaacatagttaatcatttatcacaaatttttttagttcaaataattaaaaatctaaaaaattgaaaaagaaatcgattcgttttttggcaaagaaattaagtttttaattttctcatgatttattaaca

SEQ ID NO: 67216 - DNA, 215 bp, Heterodera glycines
  Genomic contig location: Contig_ID=SeqID_38389; Location=39..253; Strand=-
  SCN-specific regions: Sequence locations=1-215
atggtttataccaacaaaagatgaataaatgtgttgccccaaacaacaattaactctgttggctgagaaccaatattcaaaagatagtttttcatcgtaaatttttcctgctgtttttttcagttttcactaatgttttgcagataaaacaaaaattcattacagtaaattgccttttgatatccggtcaactttcggaaatgaaaaacccgtaa

SEQ ID NO: 67217 - DNA, 443 bp, Heterodera glycines
  Genomic contig location: Contig_ID=SeqID_8176; Location=1043..1485; Strand=+
  SCN-specific regions: Sequence locations=1-18,42-151,182-443
atggaacagcccaatcaggaaataaagacaaagcgaaacaaggagaagctggaacatgagggttcactttatgttcttcacaaactcagtgacgatggacttcggaagtattggcgatgcgagtttttcggagctaacgacaaatgcaaaggtaaatgcataaaataaaataaaaactatttttcaaattcagggcgccttcacactgacattaatggtaatgtcctcaaaataattggaagccacacatgcgacatgagcgccgcacatgtggagtgtcagcgacgtataacccagctcaagcggcgtgcagttgagacgtgcggagcgccggctacaatccgtgcgcaggtattgcggaacactacaacccccgtgttggctgcttttccgaccaaagctgcgactaaaaaggtcaacgtttgcaaatttttatgccaaag

SEQ ID NO: 67218 - DNA, 2275 bp, Heterodera glycines
  Genomic contig location: Contig_ID=SeqID_8177; Location=112..2386; Strand=+
  SCN-specific regions: Sequence locations=1-308,337-455,477-720,742 -1367,1390-1494,1529-1560,1583-2008,2030-2275
atgggcgcgaagttgttggccccactttccacggggatgaagtgtgttgacttggcaattgtcaaattattatttgtaataatttggttccgatagttttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggtcacatttcgtcgtacattttctttggcattagcattatttcgattcgatagattattattattttttctgtttaggccgagtttgaggcattgacgccttatggctatctcacagtcactttgttcttttctatgcttgggcttactattctgtacgcttcgtttgttaggacttacggtattcagttataggtactttgactcttatttatattttttgaacagtgacaaaattcaatgaccgattgcctgacactttcgatgatgaatataaagtttgttttgaagttttaagtaattttcaaagcaaacaaaagtattttaggaaagtcaggccgagcgccgtgtggtactggaaagggtaagaaaattgcgatgccatttgagaattattcgcaaaaaaatttagggcaatccttatggaccggcctactactacgattacgagaaaaatcgttggaaggactgaagtggacggaaaagtcctactcgaaattcgttggagtgttttttaattttaggggatttttaatggacatttcaaatttgcacattttttcgtaaatttcttattcagtttttacgattgataaagttgggtttcagtttttaattgttgttaattttttgtaattaaaaaaatgttttttattcgtataaaatactgccatttgctctttttttaataattctttttagctttccaagttaagccccttaacttttatttgtcatcgtcaccagtccaattaaaatctcgtccttatgcctgcttcgcactcgaacaaagaaggggctcacaatcagtcatccgaaggcgcacggcgccatttgcaacttccgtcgcctccacccgatgattttcaggtcatttggaaagcaaacatttgaattcattgatcagtcaaagagttcgatttgttcacaggttagtcgtcgggttgtgcttttgtcatcggacgaagaggacgaagacagcgacgaatctccgtcaaaggtggacaactcatatttagtctaagtgtgccacttttttttataacaaatagccttttttagccgtccagttcagcagcagcaccaagggagaaccgtggcagggcaattttattgtccgaggaggaggaagagccgcagggggaggagacggaatggttggggaagaagagtgccgccagtgctggcccatcaaatacggaaaggaaacgcgaaaaaaaggtgaccgaccgtaaggcgggagtaattttgaaattaaaaacaaataaattaaagaagcccgaagcccatgggatgctgaagtcgttgaagctgaaggcgaagaagttgagggagaagcagaagaaacggcggagaaaggatcggatgcgaagtgacgaagaggagggcgaggcgatggactcggacgggtccaacgacggagacgtcgatatgcgcgcagacagttacgacagtgaggacagcgatgttagtgcacacattgtgttggggaaacattttcaaagcatatagcaatgattacgccatttttcaaacaggcgaacgaacaaatttccgcccgtcaattgaaattgatgcgcgaattggagcagaaatgtgtggaatttctgaatgagtctgatgtgacagaactgaacgcttgcgagaaattcaacgacaaattcgttgcttttgtgctcgccaatcgcccattcgaaaacttcagagatttggtgatttgtagcaatttggaattcaaatcataattaaatttttggtttaatcactttagaaatccaagcttaccgtcgcaccgggaagaaaggctggcgcgggagcatttgttcgtttgttggacaactatttggaatggttggagaacagaggcattttggataaagtgttggacgactgtcgcaagcacagcaaagtgatcgaaaaggcgctgaacgaaagcgaaggaagtgcgccggtggagagaccagccggactgaacccgaagtgaacgacggattcgaatggatttaacccattttttacaa

SEQ ID NO: 67219 - DNA, 447 bp, Heterodera glycines
  Genomic contig location: Contig_ID=SeqID_38398; Location=366..812; Strand=+
  SCN-specific regions: Sequence locations=1-20,42-115,148-285,315-447
atgctttccaaagagtcgctccaaggctcaattgggttcagtgaacaaagtgtggatgaggacagatcaaacattttgaacacaacaattgcaggtaaagctgcatttatgatacattttaaaatattttatattaaatttaaatttcaggaggcttcaaattggtcggaatgaatgtgcagcgtttttacgcttatggagagtttttcacagtcaatgagagtgtgtaagtaaaaaaacatgccaaattgcgaattaattatacactaatccttattataatttacaaaagtttcttttttagggctgcacttttctcgagcatcgccaacaccgttctgcgttatgaaatatgcctacagcgagaagtcggcggagtttacgccgccacagtgtccattcccatcttttgcatcacagcgtaaaaaacaaacaaacgaaagctaa

SEQ ID NO: 67220 - DNA, 128 bp, Heterodera glycines
  Genomic contig location: Contig_ID=SeqID_38399; Location=1019..1146; Strand=-
  SCN-specific regions: Sequence locations=1-128
caggagaagtccccggatcagagcgcctacatgtgagaagatgcaacaacgaccggcggatggatggacgaaacctgaagagcgagcgacctgtcagaagatgcaaagctaaagaagatgtcccataa

SEQ ID NO: 67221 - DNA, 531 bp, Heterodera glycines
  Genomic contig location: Contig_ID=SeqID_38401; Location=298..828; Strand=+
  SCN-specific regions: Sequence locations=1-187,222-409,431-495,518-531
cattcttaaaaaccagcagtatcagcagtcccttttgggccattcccccccccccacaaatcagcacagtcaattcatcaattctttcgttccttcgttcatttccattctttgctgctctctttttctatcatttctcaatgctgcgcatgctcaacttttcgtttgcacagtattaaatcgaatgaaagaataatgaatttttcctttttatattctcccgccgatcaaatgggcccggaaattgtcactcgcgcacaacacaacaacaattgagtggtgtgtattgtgtttggtgaatgagcaatggcttaagaaagcacacattgtctgtgcaagatgagaaaggatgggagacggcgaaactttttattctcctcaataaaatggcataatttatttaccaacgaaaaagtaataataataagaaaatttcccatagggacggacaatcgtcattttctcacattcttgattttacattttgattcccattgtgctgagctgatgaaaagagaatcgaattgcttt

SEQ ID NO: 67222 - DNA, 246 bp, Heterodera glycines
  Genomic contig location: Contig_ID=SeqID_38403; Location=555..800; Strand=-
  SCN-specific regions: Sequence locations=1-145,169-246
aacgttcatttgacgtttcaatggatcaattcaaaaatggataggcattttgtcatccctttgaattcaaccttagacgatagctgtggatttgagctgttaagaagcggtacaaccagtattagggccacatttgattcaccaattccaaagggaggagtggaaatgattgttctcggagaatttgaccaaatgattatgattgattataatcgacacattgtctccgactcaaagcttgggtaa

SEQ ID NO: 67223 - DNA, 341 bp, Heterodera glycines
  Genomic contig location: Contig_ID=SeqID_38404; Location=224..564; Strand=-
  SCN-specific regions: Sequence locations=1-341
atgggcattatgacaatcgccaccttgtgtttggcgttgttcggtttgggtgtggccattgctgcgtttttcaccaatgtgcacattctgcaagttattttcgccgcaattggcacaattctgatcatgatttggtttgccattcacattcaggtaattttataagatggaaaaattgaagcgatgaatagccaaccatttatttatttattttttagttggtcatgggcggtcgtacctacgaaatttcctcggaagaatacgtttatgcgtcgattattctgtttctggacgtcattcagattttgtggttcctcctcagcctttttggtgaaaaatga

SEQ ID NO: 67224 - DNA, 1138 bp, Heterodera glycines
  Genomic contig location: Contig_ID=SeqID_38407; Location=73..1210; Strand=-
  SCN-specific regions: Sequence locations=1-58,81-246,268-470,493 -562,585-1138
gtccaaatgttgcaccatatctgggcctcaataaccaatccaaaccacaggagaccgaagaaccacggaaaataattattcctaggaaaagacttaaagagcaaactcctgatcctgaatcagataatgatacacttgaggagttaagtccggaaccccaaacaacatccacactcaaaacacccgttccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagtgaagaaacccttcaaaccactaatatgggcaagactgtagagaaaattttatcgaaaatttattttaatttaaaatctccggcaagttttgctggaattcaaaaaattttaaatgcggccaaaaagattgacccgaaaattacgaccgatgacgttaataaattcctagaaaagcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatgtatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgaggggtcgac

SEQ ID NO: 67225 - DNA, 1215 bp, Heterodera glycines
  Genomic contig location: Contig_ID=SeqID_8181; Location=332..1546; Strand=+
  SCN-specific regions: Sequence locations=1-101,124-242,264-326,348 -501,523-694,716-749,772-871,893-1056,1080-1164,1186-1215
atgaccaattttgtcaaggtttttgctaaaataagtacaaaagaggtaaaagctatgaagtttcctaaaagatttttaataacatttcttctaggttaaccttttttcttctttatccatttaatttctcatcacgcctctttcaaaaaatttctggttggggacggaatggcgataattcttagcagatttcgtcaaaaaatacaagggattagccctgaaaaattcccaaaaaatcttgcaaatcccgtattttccaaaaataccgggattgcggaccgcaaaagttccgcgcgggattacgactggcgccggtctctaatagtgaatatttttaaaaatcaatttgtttagtgcgccgatgccattatacaatttgccaaattggtattgggcaatgaaaagatggaaccaatttgcattttgtctgaacaatttgacaggaatttaattgttggcgaattaaattgtgaaatgtacgaaaggcaaaaatgcacggattcatcactgtattgcatcatttgcaaggttaaattagttgaaatttggaaaatttgagactgtaaaaaggcgtttgataaattaactggccaaaacacttggattttcggcaaattttcagaaaaaaacttccattaccagggccagatctcactctaagatatcgatgagctcgtttctgaatgtcgtcgctattctgcaaaaaactcaaaattgttagggacagagacgctttgactatgactggcaaataaaacacacaaaaatttatttgtaacaatatgatgacaaatttacggaataattcagaaattctgtcgatcctttgttatatctaggaaatcattaaatatgacttttctcgagcaataagaattaataaattaattattgtgtttattccataattagtaattaaatatttgtaagcattccgctgtgaaatcactgacaaatgcaaattcgtcggcacttccaaagttgaaattcttttttatggacgtgtcaatcgaaatgaaatttatttttgtaccaaattacaaattgtcaattccaaaagaacagaacaacttgagaaattatgaaaaattcgccaattattttgctgaaaacattgagaaattggcatttaatgacaatttcgatgataaaatcaataagtatgaaatagacctactggaagactttttagaaaaaccgacttttcgcagttaa

SEQ ID NO: 67226 - DNA, 934 bp, Heterodera glycines
  Genomic contig location: Contig_ID=SeqID_8182; Location=166..1099; Strand=-
  SCN-specific regions: Sequence locations=1-398,434-759,781-934
atgcacattttgattatgttttggactttggagctctatgtgggccattttgtcggccaccgaattgcggtgccgcttgatttggatgccattatgtaccaaatttgtgccatggcggttgctgttgcttataatttgttagcattaaataggatcatcgcaataatggccccaattttctattgccatctctttaccatacggtgtgggttgcctaattagtgcctttgtcccttaaataccaaagcaatttgttaatagctttacgagactgtgccttgccatgtgctggttttgtggcattgtcttttcagtggtcgtcaattggaagccgaatttgcgtatttattcatgcatttacacattagtctccatatatcctccagctataataaaggtataaaaaacaatttatataattatttatttatttggaatacatttttatgacgcctattaaggagaacaatttgcattttaaattaattgatgcagtcaacttaataaatctcacaacgacttcatacattccaaccgcattatacgcaatttgttttatttggctaattgtcaaaaaagtgctgaaaggtattggaaatcgaaagacagaaaaagtttcgaattatgaatttgaaaaggaatattcgaaaccaggaaatggttttactataatctctcgatcaaaaaaacctgggtttgaatccaggttaatctctagaaatatcagtttggaggcaaaaaaaagataaattggctaagaatgaacaagttttttatttgaccttatccgtcaaatttgacagtgtttggccgtacaactgctactgtatctgtaaatggtcatcaacatgatacacctcatcaacaaaatcagcaagaaaacgatcagcttcgggtggtaccaccatcattttctccgtcattggacaattaa

SEQ ID NO: 67227 - DNA, 1114 bp, Heterodera glycines
  Genomic contig location: Contig_ID=SeqID_8182; Location=1315..2428; Strand=+
  SCN-specific regions: Sequence locations=1-168,198-787,811-1075
atgcagtccgcttttttgcgagttttgccgtggccggcagaacaagcaaatgcggcaacaatccaagcaaatgtaagccaagataaaagccggcttggaaatgttgggcagtcgaagaattcggatgggcacattttgccgcaatttgtgtcaggagaatttcgttggaataattcatttaattataaataataattgctttaattctgctaattttaacaattagttatttgagtgataattagggctccaatttttagattttttacttattttttgtcctgagttccctatggcctgaaacgcacgaaaaacatgttttttcggttgttgttaagctagttttctagtattagcaactattttctagttttttatttttaacgccaaaaaacctaaaaattttattttcaactactttggcgtttgcccaaaattattaacaaaatgcaataaaaacgaaaatacactccctaagaaaacggcccaaaaaatttcagaaaaatacaccctaagaatagcccgaaaatttcaaaaatgcacaccaaagaaacgaagaatttctcaaaaattcatgtccaaaattttttatttattttcttgacaagaatttttgtttttaaaaattatttatctcaatacgggtttggcttaattttttgctttttggataaatttttacgattttacaccagtaaatttgaaagttattagcaactattttccattttttgcacctatttggagttttttagaacctaaaaactaactattttgacagtttttaaaaataatgtttttaaattttgaaaaacgaagtttcctgagccttaaagtatgacaaaaaatcgataatttctccagataactctctcgagcacttcaaatggcgacgaacaattgtttggtgtattttaagaacaaatgaatgtgcaacatgccttaggctcaccaattagtagtaataagggaatttaattattttttttgagagtcagcttacaatgagcccgaaataagtgagtccagaggcaactacttccttatcttaatgaaaattgcccaagaaaaacgcaaaattaatacaaaattaattaaataattatttttttaa

SEQ ID NO: 67228 - DNA, 80 bp, Heterodera glycines; identical to SEQ ID NO: 51817
  Genomic contig location: Contig_ID=SeqID_38412; Location=231..310; Strand=-
  SCN-specific regions: Sequence locations=69-80

SEQ ID NO: 67229 - DNA, 80 bp, Heterodera glycines; identical to SEQ ID NO: 51817
  Genomic contig location: Contig_ID=SeqID_38412; Location=846..925; Strand=-
  SCN-specific regions: Sequence locations=69-80

SEQ ID NO: 67230 - DNA, 678 bp, Heterodera glycines
  Genomic contig location: Contig_ID=SeqID_38413; Location=14..691; Strand=-
  SCN-specific regions: Sequence locations=1-196,236-287,309-678
atgtcctttttcactttgctgagtttggttctgtttgcgtggattttcgttcttttctccgacttttatttgcgctatttgaattcacaacggtaaaaaatgtgattttttatgttactttttccatttttaaatttcgcttttagttatctcaattttttggaaaggcatcgaatttctgtcacacctttccaagtaatttttatctttttaatttaaattttagtaaaaaaaagaatcaaattcattgtatgattgattaattttaggttcgtttctatctgtccaatttcgaatctcatcctcgtccaactcttgctctgctcaaggccgttgaccgatgcattctcggccttcgcagatcacgatttttggtccgaattggcaactcaattatttttttaccgtttttatatggttgtgggattttttaaattttcattcgttttctgcactttatttttgttttcctaaggccctttggttcggtgccggtgccgttgttgcgcttttcttttttctgctcacacccatttacctcctccgcctgctgcttgacgagttcactttcggcgtctttttccgtttttcttcgccttccgcccattttcggcactttcacactcaccagaaactgaccacatccgtaaatttttattcacatcagtgcgaaataaa

SEQ ID NO: 67231 - DNA, 45 bp, Heterodera glycines
  Genomic contig location: Contig_ID=SeqID_38414; Location=14..58; Strand=+
  SCN-specific regions: Sequence locations=1-45
atgaccacgtgcatcgtcgcggggctttgttctgtcggacgggca

SEQ ID NO: 67232 - DNA, 401 bp, Heterodera glycines
  Genomic contig location: Contig_ID=SeqID_38417; Location=97..497; Strand=-
  SCN-specific regions: Sequence locations=1-39,103-292,314-362,386-401
atgtcttcagcaaatgaggagaaccaacactgtaagcagattaaataaatttttaaaaagtttaatattttaaaaattaatttttatttttttaatttttaagatggcaaaaatgtgtcaatgcttcaacagaatggcagtgtgaaattcaagaggagagcagaaaagccgaagatggcctcaacttttccagaaatggtaattattgtataatcattttattcactttaattgtttgtccaatttaactgcaggtcaaagcatggccatactcaacctttttgatcatcctcaatgaattctgtcaccactttgcaaatttatcgagtaaattaattttacttactaatttaagcactgtgattaattttaaaaaaaaaaataagaatttagtgaataaa

SEQ ID NO: 67233 - DNA, 713 bp, Heterodera glycines
  misc_feature (658)..(658): n is a, c, g, or t
  misc_feature (691)..(691): n is a, c, g, or t
  Genomic contig location: Contig_ID=SeqID_38418; Location=45..757; Strand=-
  SCN-specific regions: Sequence locations=1-149,171-201,236-258,298-713
cattctgatcaatgaaccgttgggcactgaccgtcccgaaattgtgcactgctgtgacgaactgttggctcgtcatccgccgtgcaactcgtcccatctgttccaatttctcatcgacaaaattgcggacaaaatgcgcgaaaatgcggttgcaaatgagcaacaattgacggaaatggcacaaaaaagtggcgaagttggaattttattaataaattattattttgttatttttcgtgccataagggcgttaatcgcaaaaaaaaaaaaaatttttttttaaattaattttaaatacacataaaatctactcattttggagtggagaattgagtagatagtagagatattcattcattgaaataccaacaatacgaatgcatataaaaacaatttctagaacatggatttttgcggacctatcaaaaatttttgaattcaaaaaattcctcccctaaaaatatccgattttcacttacatccctagttttttttcaaattaaaccggaattaagtttggctccccgttttcctgctgcttatcattttttttttgttcatgtattaccattgttttagtatttggatgtgttggaggggattgacccgattcggcacaatttctggaagtacaggcgggcacagctgcaaacattgnccgactcggtgaagggggacagcactaacagtnccaatgaagagcaggatgcggg

SEQ ID NO: 67234 - DNA, 101 bp, Heterodera glycines
  Genomic contig location: Contig_ID=SeqID_38420; Location=20..120; Strand=+
  SCN-specific regions: Sequence locations=1-101
aaaattccctcaaaaataaaaggtctattgcgcaccgccctccctatcatgctcgagagcatttgtatgtgtataaaatttatcaaaaaaagagatagaca

SEQ ID NO: 67235 - DNA, 304 bp, Heterodera glycines
  Genomic contig location: Contig_ID=SeqID_38420; Location=527..830; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcaaacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 67236 - DNA, 746 bp, Heterodera glycines
  Genomic contig location: Contig_ID=SeqID_38421; Location=1..746; Strand=+
  SCN-specific regions: Sequence locations=1-207,230-255,277-286,311 -323,345-355,377-518,541-746
  Gene Ontology: Mol. function=general RNA polymerase II transcription factor activity; Cellular component=SWI/SNF complex; Biological process=embryogenesis and morphogenesis
attcaaaaaagcaattattaaaagataaattgttttcccgacacagttaaactgcgggactgcttttgctacaacaaaaatgacaaactgatcacgccagaaatggttgcagaagtgttgtgtgaaggtaattcaatttataaaaattatttgccttttttaaattgcattgttttctaggtaattcaaaattttctttatttgctatttaagaaaattttaaaaaataggggggggagtattttttaaggagtaggaaaccttcctcaccgattttaaatatcattggcttttggtttctttaaaagctccagaaactttttgccttaatctttacaatatttgaatttgtggcttttaaaaattacgatttttatatttttggaattcccctgtagatttggatttgcctctcaacacttttttgcccgctattgcccagaacatccagcaacaaattgaggcccattctgaaccaatgccggacgatgtgcaggccaccgaccaacgcgcattgctcaagctgaacatccatgttggcaaccaatctctggtaatttacacaccgacggtattttcaattctgtccattgaaatgacttttcccatcccccacaggtggaccaattcgagtgggacatgagcaacccgaacaacagtcctgaacagtttgcacagaagctatgcgcagagttgggcttgggcggcgaatttgtcggtgccattgcctactcaataagaggtgg

SEQ ID NO: 67237 - DNA, 282 bp, Heterodera glycines
  misc_feature (72)..(72): n is a, c, g, or t
  Genomic contig location: Contig_ID=SeqID_1072; Location=961..1242; Strand=-
  SCN-specific regions: Sequence locations=1-282
tatagccatgcgaccgcaaattcaccattaaaatcaaggacggttatgtgtcaagtggcaaaaacccgtccnaaattgtacgacattgggcgcattgaactcgagggcggattttcgggcgaatcacgcgattgcctgaactgaaagcatcaaattcatgctttaacatcggataaaaaaggctctggcccaacgatttttaaaatttgaaaacattcttttggttattaatataattttatatgttgttttacaattaaaagcaatgatgggctgaaaaat

SEQ ID NO: 67238 - DNA, 948 bp, Heterodera glycines
  Genomic contig location: Contig_ID=SeqID_1073; Location=249..1196; Strand=-
  SCN-specific regions: Sequence locations=1-114,137-167,195-346,368 -645,668-885,908-948
atgaaactgatcggatggggtgaagaaaccacgggaaatggcgaactgatcaagttttggctgggcgtcaattcgtggggcaataggtaaaaatgtgttgttaggtttatctggccctaaattagaaaaaaaatttactggcttaggaagggggggggcatctaagttttcaagtcaagtttcattttagaaaaatatttcatttcacagcataccttttttcaacaaaaagataatccgtcagtaaattgttttatcaaaatttctataaaaattgtttactatatttttaacagtcaatataaattagtttcaacgagttataatgccgtaaaaacctgtataattttttcagtattttaaaatttttaccgatggtttgtgtccattactaatggattttccatgatggatttttattgtcctgacgccggttacaggcttgaaatttcatagcaatttcatcatctatccatttaaatcttttagctgggaactgaacggacttttcaaattgcgccgtgggacagatgaatgccgcattgaatcttatgatattgaaatatatgaacgagcggggaagcctttgagggaaaaactatggggcgggccggctttgaaccggcgtctctggctttccggaccagtgttctaccagctgaactaccgaccctgccctctccagctccccactttgctcgatcatataggatcaatgttgcctcaattgatccattaatcttcctctcggggaagcttcttcttctctatctcaactttgttccaaagcaacaaactttttaattgattattcggtcgatagtcttaaatgttctctatgtatcagtctgcaaaatataaaaaaattagtttagtttcagaaaaggtatgagcaaaattgtcttttgaacatttttggtcataataacttatttatgagttaataaa

SEQ ID NO: 67239 - DNA, 4175 bp, Heterodera glycines
  Genomic contig location: Contig_ID=SeqID_1073; Location=2312..6486; Strand=-
  SCN-specific regions: Sequence locations=1-332,363-451,499-759,781 -877,899-1263,1285-1356,1409-1420,1442-1591,1613-2075,2097-2101,2136 -2197,2226-2564,2591-2988,3011-3374,3396-3537,3584-3972,3994 -4142,4164-4175
atgctttttccattaatttttctaatttcattcccaacaataacagacgcaaagcaattggtaagaattagagtcgctcaagtttctgagttgggaaatcctcgggtttttctgtatcggttgggattctcgcatttcgtcttgattaaatggcattttttaaccccctaaaaattgtgttaagaaaaaaagtaaaactaatttattgagttagaattaatgttttttgatatttgaacataataagatttattttgagtgatagaattagggcgcgcttgtcccttttcaggccaaaaagcgccaggatttgagtgccaaatcctaagcagtaaaaaattataaaaattattctattttttcaacccatttcaaaccttttatatcgattcagaccgtttttaatatgaccgatatttatcctcttttttttgtaatttgataaaattccaaaaattaaaattttcgtattttaaaatgaattttataattttttatctgttctgtctggaaaataaatgttttaaaaaaattcgctatttttaacagtttgacgatgacaatgtgctgcttgcatttgtgagaggacagtcaaattttgagcaatttttggtggaggaagagctcaatgatttggaaataaaatatccgccaccgcagacaatgaaggaatatttgatgcttcaatatgagagccaacttggcattgtgtgtttgatgcgacggcattggcactgtgccaaaattgggagcgaatttgcagacaatgagcagagaaaatgccaaaaattccgcaattatttggacattttgtacgaatatttgttcactgaatttatggggctgccagcagtgaaaccgcagttttattttgccgaaatcttcacattctgcacattgtccaatgtgatgcttagtcttagctggcttttcaaattctttttcgattcgaaattcagcaaaatgaaagggcacaaattggacagatattttttggaatattacgaacccaaattggccaatgaggacaaattggactacaaagttgaattggacaacccaaacgaaacatttgaggatatcattgtacaaacggcacttgagacgggaaatgaaagtcttcgcaaattaatgaggcatatatttggcaaaaatttggagaaaatatttagaaaaatggagcaaacaacaatggaatcactaatcggacaacaaattacagttgggacacaattctcagaatggaatttgtggccaaatgatggggaaaatttgaacaaaattttgttttatttgtacgaaataggaatccgcagagaaagaatgaaggtaacagtgaaacattattcgaaaaacaaataataaaataaagcattttaaattcaattttataatttctaaaatttttggagccataacatttttaaagttaaattttatagtcggttaaattatgtcattcagatcgaaaaaagccttttcatccaatttttgactccacccaaattttatcaatattgtcaagaaacacaaaggggtgaacaaaccacaaaagaattagaaaaacgttttgagtattttttagtcgatttgtatttaatgagacagaattggcaatgtgccaaaatggtcgaagaaattatgggggatgaagagatggtgaaggaatgcgagaagatccagaaatatttgcacattctttatgagtatctgttcatggtatatgcgaaaagtaatgattgatttataatgggtagggctcgaaattatatggactaaaaaaatggacataaaataaggactaaaaatgcccgaaatatggaccaaaaagctcaaaaatggccaaatatggaccaaaatatggactaaaaactgccaaaatattcaatatttggttaacaaaatatggactaaatacgcaaaaatggcgaaatatggatttatttccgaaaacccacaaaatatggatttatatggactaaaaaccttcacctaatcaaaaaattttaacgcagaaatgctatttttaagccccttccttcatagcatatgcgcagaaaaaatatgttaatccatacaatttcgagccttaataatggggtttttcaaatttcataattttagtgccaaatttcggtattttaagaaatttctttccaaaattcaactccttaatctatttttttacagaatctggtttttaaatttaattatcatttttaattgcagatgaagaaccgctcttggctcaacaaattcccataattgagccaaaatttcaacgccaaaatgatcaagtgtcacaaacttttatcatgaatgaactgtttgattattcaagaattttttttgattcagaatacagaaagagtgacgaatataaagcttatatgagtgccaataagttgccatggttgactctgttaaatgagagcaaactgggcaattacacagcaaattttggcaattcaactgaaacacttcgcaacaaatttgatcaaaaattgaaaagcattcttaaaaagtggagggaccatgaaaagggtaacaaattggaaggttacaacccatttttaaaaaagccattttatgacataatttcaagggtaagtatcaccaattataattaaactaggcatgacgagagattgtaaactcaaagcccacaaaatttagatcagctgttgatctctgacgacgagagcttggtctctcgcgcctagacttcaataaattgaataatattcgaaaaaattgtctactaaaagttttggcggtaatttaaaagtggaaattttgaattttattaaaaccaaaaaggggcctttttaatttgtaatatttttttttgttgtaaaatattgtctaatcataaactcatccatgttggagtccctgatcacgaatctacatctattttgaccaattcctaagccttttcacaaaaactggcgccaaaacttttatatgtataggaattatgagttcatttgaaaatataaggctttttcacattttctgagggtttttgagcttttaatgccaaataatggttttcaaatttcgaaatggctttaaacatttcccacaaatgcaattttagactgaagacaaagcatttaatgcatttgtgaagggtttgtccaattttgaacatttttgcttgcaatatgctgatgaattggcgaacatttgcaatggaatggcagcagaggcaaatgctgagcagagaaaaatacatttgcaggaaaaatatgcggcttatcttggcattttgtctttgatgatggacaattggcactgtgccaaaattgggaatgaatttgcggagaacgaacggagagaatgccaaaaataccgaaattatttggacattttttatgaatatttgttgcacgtattccgtgaaggtatacggtgttttttaaatagtactgtaaaaggtgaaaaggataagaaagtatcgagaaaatagtgttctaattaaggatataccaaagtagttttgtttaattcccaagagaacaatttgctatgaaaattttctaaatttttatacaaaaaaataaatttactttttttagatgaagaccccgtgattgctataaattctcagattataattcgaagaattgaacttttcgggactttaattgaggtcataaaagtgctgaacatggtgaccaaattctattttgacacgaaatttagcaaaagcaaagaatacaaatttgaaaatgttttcgaaaattcgtcaatttcaattggaaaacttgagcaaatatttaaaggcgcgtttaatgaggcaggagaagcagcaattaaggggaaaagccaatcggacaaaaaagagcaatttgacaaaacgctaaaggaaatgctgaaagtggcacaacaaatagcaacgagagaaagaggaaagctaaaagtgatggaggataaaatggaagagcattcagcagaagagaacagcgaggcagaaaaggagttgatcagtgccaaaagtgccgcattcgacgacaaatttggcacactttttgactcgccattttgcggcacgacaattcacaactgatgggtgaccaaaccaatatgatgtgtcaagcgatataccgaattagacttttagaatattgttcatgattattatagtgatgaggaattgtttaaataaa

SEQ ID NO: 67240 - DNA, 740 bp, Heterodera glycines
  Genomic contig location: Contig_ID=SeqID_8184; Location=1466..2205; Strand=-
  SCN-specific regions: Sequence locations=1-34,56-484,506-553,576-740
atggatgagtcgaaacgggaaaatttttcccctcaaaatgatgatgacgtcatcacaattggagacaacaacaacactcaaacactgcttgacctgcaaccggggccctcaaaaaggggacgcaagcctcgcttggacaaaatccatgaggaaattgcttccgcaatgaagaaagcaaaagccatggaagctgaaggtttggctttttctgcaaatttctttgaattagccaaattttagtagatgaatcgcccaaaaaacaaccgaccaatgtgtttgagtacccgaccatattttggaaattggcccgcccaaaggttttggctaatattaatttgaaaaaatagtaaaatttcttaagtacggagtgttcacgttcatctgcaaagagtgtcgtgatgacaatttccggcaggggaacagccgattcaaactcatcaatcagaatggcgagcagcaacgccttgagttcacccaatcgttttgccaagactgtgcaaagctgaactttgactgcaccgatctgatcatgaagcacataaagaaggatgaaccggcaacgacgacgacgacgatggcaaagagtttccgctggatcaaagatgggggaaagtgaaccgagatgccacaccacgatataagaacgatctcattttgaagaatttatacttgttgatcaaatgacaaactctttctttgtaattttgccgagcaacacgcctggctttgttggaaataaa

SEQ ID NO: 67241 - DNA, 1187 bp, Heterodera glycines
  Genomic contig location: Contig_ID=SeqID_8185; Location=390..1576; Strand=+
  SCN-specific regions: Sequence locations=1-1143
atggacaagaaaataaacaaaatatacaccgacccggccaatccgggcgggtatgcgggtgcgagtgccctgtacgcggcggtgaagaagaagcacccaaagttgaagcgtaccgagtttgaagactttttgcagaggaacaccacctacacgctgttcaagccaaagagggagaagttccgacgcctacgcactgtgcctgcgggtttcatgaccggtaagttgtactggggcttatttcgcacaattcagggttcagatgttcaggctgacttggccgatttccaagccctttcgcgcaagaacagcggctaccgttacttgctgttggctgtggatgtgttgtcgaggcgaatgttcggcgcgcccgtaaagagtaagcgcccagtggacatgaaaaaggcgtttgaggagctatttgagcaaatgccaagggtgccggacacactgtacaccgatcgcgggctggagtttgtggcaaaaccgttgaaggagttttacacggagaagggcattcaaaagtttgagaccagttcaaagaaaaaggccgccgtggcggagcgtgccatccgcaccctaaagactcggctgtacaaatatttttccgccaacaacacatcggtgtgggtggatgtgctgccaaagtttttgagtgccatcaacaactcggtgtgccgcgcgaccggacttagacccaacgaaatcagcgacaccaatgcgagggaggtgtggaagagggtgtacggcgaagggctcgcacaattggacaagacaccaaagatcagagccggggaaacggtcagaattcccaagcctaagcacattttcgaaaagggtactgtaatacacacattttccgatcaatttattttaatttttaaggctatatccccaattactctgatcacgtgtacaccgtggatgaggcccgctcaaccaacccccagcactatttgctcaaagactattatggcacaaagttgaagagaaaattttatttgcccgaattaacaaaagtacaagtggatgaaaacacaatgtatcgaattgaaaagaaatacaaagaacgagtgagagatggtaaaagagaaatgttggtgaaattcattggatttccggaaaaatattgggtcacaaatgaagaaataaatgaataaaaatattacaaatttaatgaaaattaaaaa

SEQ ID NO: 67242 - DNA, 752 bp, Heterodera glycines
  Genomic contig location: Contig_ID=SeqID_8185; Location=1587..2338; Strand=-
  SCN-specific regions: Sequence locations=1-109,152-286,309-752
atggaccacctctgctgcgcgaatccatctgctggaatcgttgaaaaaggtgtatggccctgctcctggtgtagagcgctacgacacccgcattctctacatggtaaaactctggaaataaaatgaaaataggaaataattttttataattaggacactgacagcatcttctacgactacctgacgcggctgggggacccgcttccgggtggtgagcagctcggggaactcgctgacgagtacccgaatcacacgattatggagtttatttgtggtaagattgattaaacattaaacaaaataaatggaatgtttgtttagccggacccaaggcgtacggattgtggctgcacaacaacgcaacgggggaggacgagtacaagctgaaggtgcgcggcatcaccctggactcggatgcctgcgagcgcataactttcgagaagatgaaggacatggtgcagaacaagctgggacagccggacaacaacgtccgccttaactacccaacgaagaactttcggatcaccaagaagggagagattttcaccgtccccttggtcaagcagttcaacccgaccgtgaataagggggtggtcagggatcacggcttgaaggtggtgccctttgggtacagcgacgaagagtggtgtaagtggaactgccctggcgcttgtacctgtctgttcaacccagacctcaatgtgaacatgttcacagaagaggagctgaacgaccccgacattatgccataa

SEQ ID NO: 67243 - DNA, 652 bp, Heterodera glycines
  Genomic contig location: Contig_ID=SeqID_38423; Location=240..891; Strand=+
  SCN-specific regions: Sequence locations=1-20,42-137,159-397,454-652
atggtcaatggaatacaaagaggaaattttgaccaagaattaacaactaaatttgataatgaaagctcttttggcattttgttttgtactgccaattttgcatttgaaatgaacgacaattttggaaaatttctgagcaatttttgccatgaatttaaaactggaaaaaatctggaagaagcaattgaaactgtgaagaattctttgataatactaacaagaagcatcacaattgagcaaattatcattaaggaaaatatatttcaaaaaattgccaaaaacgaattttttggtgccaaaaatgcggaaaatattgcaaaattttttgaacatgccaattcttcgtttcgcctaagcttatcggcacagttggtaagaataaaaatttaaacgcaagtttttaatttattaaaaaaaattctatctttttttagtttgtaatattttaaaaatgttttagcatcattttaacaatttaatgagtgcatccgaaaatgtgccatcgacaaagaaacgaattcgtcgtatgatacgccgaggttttagcagagcaatggaccaatttcaaaatagcctggacaactcacgatatcgccttcgaaatgatcggaaaaaatgtgctttctttttggcacttagtgtcgttgtgctg

SEQ ID NO: 67244 - DNA, 514 bp, Heterodera glycines
  Genomic contig location: Contig_ID=SeqID_38430; Location=142..655; Strand=+
  SCN-specific regions: Sequence locations=1-119,152-467,499-514
atgacaaaagatgggcataaatttttcaaaattgagggtgtaatttctccaaatttcttcaaattcgctaaatgtaaggtaaacaaaaagcgaaaatttcgcttttttgcttatttttgacataaaattacaaatttaaaattaaattcaatattctcgagaaaattttgcaaaaaatgatctttcgggaatttttccgatctttgggggttaaaaaggccaatttagctgatagggccgttctaatagatgtttttggaaaaatgccgaaatatggacaaaataccaaaatatggacataaatggcgaaatatggaaatatatggatatagaaatccactctagaagcttcaaaccaagctaaaaacatgtttttcatacatcccaggcgcctcccagagtctaggaaaaaatatggatttccatataattctatgccctatttatgatcacgagataaaactgagatttatattttttaaattataattatttttactttttgtgaattaaa

SEQ ID NO: 67245 - DNA, 700 bp, Heterodera glycines; identical to SEQ ID NO: 38431
  Genomic contig location: Contig_ID=SeqID_38431; Location=1..700; Strand=+
  SCN-specific regions: Sequence locations=1-482,506-547,576-700

SEQ ID NO: 67246 - DNA, 1397 bp, Heterodera glycines
  Genomic contig location: Contig_ID=SeqID_8187; Location=148..1544; Strand=+
  SCN-specific regions: Sequence locations=1-134,181-197,219-862,886 -1000,1034-1191,1227-1235,1257-1270,1323-1397
atgggactgttcgccttcgcatgccaacgggacaattcggggtaccaaggagtgacaacgtacgacaacaccaactacaacagtcagtacggtgggtatggcatcggcaactacggtaatggcaacaatcagttgcaacagcaacaacaacagcagcagtatccgcagcaacagcagcagggaatgtcagtgccaagaaaaataatttaaaccatttttggctcgtttcagctacacaacggggtatcccgcttttggccaacaaagtgccaacaacggcttcggccaggccggctacaatggcttaatgggacaacaacaaatggcacagaatggacagtacggcgcgagtggaacgggcgcgacaatgaacaccgccacaggcacacgctacgtggacatgtgcatggactggtggaacgtacgacgggccgatggcgaggcgtaaccgcagccccctccctcccaaaaaaaaaaaagattttagggatttcttgtcccatacataccgggattgggcttcggttaacccctggcaggtagcagggaaaaggcacccattggcctcgtttcagaatcagcccgtgtgggagaaggcggtcgtttgccttatgctaattgccttggcatccgccgctttgtccttggtttgggacttgctcactttctgcgcctgcttctgtcccggctccatcatgaagccgttgccgggcttggcaagcaccgcttttgtcgctcttctgatcgctgtcatcgtttattacgtcaacaaccaatcgtccatcggttggcttattttttcatttgcgtttttcttccccaagtcaatttcacacgatttttcttccttttttgtcgcaccattaaaaaaggacaaacttattttttcgagtaaaaaagggtcgacataataggaaagtgccgtcatttatgggaaaaatgaaaatggcatcccaaaagaatggaaaatcggtcctttaaattgccaatgttttgactttttgcttttcatttatttgttctttcccaaaaagacattatgcgcgcgacgtcgcaactgcagcaattggacaaccaaagcaacgtcagctacagtttttacttggcggtgggcgccaccgtagcctcactgataaatatcgtagtcggcactttgactctgtttttggcggacaaatgtttatgagaaggaaacagacatacaaaagaaacaaacaaacaaacaattgttgccatgtttccccattaaaatttcattccgtgtgatcagttatatttttaaatttatttaccgattgaaattttaaaaaattttaatttttcgaaaagggggcgaagtaccgtcggtagttttttatccatattttaagattagccattgaatatattccgtggaa

SEQ ID NO: 67247 - DNA, 162 bp, Heterodera glycines
  Genomic contig location: Contig_ID=SeqID_8187; Location=2616..2777; Strand=-
  SCN-specific regions: Sequence locations=1-162
ggagcaaaaagaagaaaagagaaaagggacggggaaaatggtaaaagggggaaaaagtaagaggggaaaatgacgagcaaatcccagcaaaagcaggggagcagtgaggacgaagagccaaacgaatgggacaaactcagcggagcatcggcgaatgggggg

SEQ ID NO: 67248 - DNA, 677 bp, Heterodera glycines
  Genomic contig location: Contig_ID=SeqID_38432; Location=131..807; Strand=-
  SCN-specific regions: Sequence locations=1-375,398-576,598-677
atgaacactgactttcccactgcttctaccattttcgcacttcttgccactctcattgtcatgctcattatgccagacaaatgtcgtggtaaaattggatcaaaaaaaaagaaaataacttttcttaatccatgacgtccacaaaaatggggtgtttgttttccgacaaaaaaaatttgtttttttttgtcttatttaatgatttaatacattagtcagcaactaagtgttttctttattaacctacaaaatttttttctgttaactttattaaaattacttaaaaaaggcgctgattttggaatttacgattttttcttgttgtagcatttgattgcgttcatggagactaccgtcctattcagctggatgatcaaatgaaaagagagaaattgagcgatggtgcgctaagtatcaggggatataagccatgtgacttgtctaattgcttcaacaccaagtgcatttcgtcaccaggtcatcaaattaattatcaatattgttcttgcctttttcatttggtctcgaaaaaagtgtccttttttttttgttgaactgcgaatttaagagaataattgaccattttggtgggaaattcagccaatttaaacagttccaaagcattaaaaatttagggggccacaaaccatttttggacaaaatttgaaaataataaa

SEQ ID NO: 67249 - DNA, 690 bp, Heterodera glycines
  Genomic contig location: Contig_ID=SeqID_38433; Location=382..1071; Strand=-
  SCN-specific regions: Sequence locations=1-690
atggaaaaggctagcgaagatagcaatagtcaaaataatgaaattgctgatcaaagtcgtgagaatcgaattagtgcacgaagtcgagacaaacagaaaagagagccgaaagaaaacgcggaaggagatgacaatgtcaggggacaaaggaacaacgaagaccaacggacaaagcagcgacaggtttggcataattttttaaacattctttgtgtcaagacacaatttttaatctaagggcccaacaagacaatggacaaggcaaaggccgcaacaccaacaaaaccatttggacaccaccgatgattcgtccgcgaacatttcctcccgaagaggcgaaggcagtggacgaaacacaccgactaatgttcagcagcagcacagaggacggggctttgctgaggtctctttgttttcaaaaaatattggcctacgttgactataaatttttgggtatttggttgattcgcttaattcgaatatgcgtaaatattcgacacaaatgtctgggaccgatgactcatttatcattttaattctgtgcttaattaatctctctcttagcatcggggcggaccgcgtcaaaattatggtcagtggagcacacgacaaatgagtgaaggtggacaaatgggaggaacgtacaaacgaattgctaaggtttctcaacatagagtttttatgggttaa

SEQ ID NO: 67250 - DNA, 950 bp, Heterodera glycines
  Genomic contig location: Contig_ID=SeqID_38434; Location=170..1119; Strand=-
  SCN-specific regions: Sequence locations=1-81,151-675,729-737,797 -904,944-950
atgtcttttaaacgcgtgaactccttccaacccgccgtgccaatggccaaaaaatgggatttccgatcaatcgggtaagacatttttaataaattaaataaaaaaataatttcttaaacaattataaatacaattataagataataaataccctttaagaattatttcaaaaaatttttttgttcagaaataattttgctgaagaaatggaaaattataaattgatggattaccaatcgacaacttgcgaaaaatttggatttacgaaaaatattacggaatttcgtgtcaacccggatgtggagcgccccgatgaagcgatgaaggattcaatcgacaacatgataaaggtggctttaaaaactacggaagaaaaaatgaagcgaaaagtgcggatgtttggagtggcaattacgggtgctgggcttgcttccccggtttgggtgccgtatcgggcgtacccgcaaaacaatgcggatgttatcatgcaggagattaataagttggggcagagcggggacggagatgaaaataagaaaatgcttttattatctgagccagttactatgaaaattacttgcgtgaccatgcccagtggagaggggccgaggaatgtccacaaatttgactttggattcaaggaacaccagcggatagggtaagatttttccaattaataaaaataaaataaaaaatagaaaaaatcaaataaaaatttaaaaaataaataaacaaagaaatttaaaataattatttctagaaaatttaatgaagcaaaaaaaaaaaatttttttttcaagaaaaaaattggaaaacagctacaatgaaccggacaaataaatcatgataataagacaatactagttgattgagacaattttcgaggtacagattaattcttaacttatttatattttgcaaatttaatttattaatatttttacagatag

SEQ ID NO: 67251 - DNA, 388 bp, Heterodera glycines
  Genomic contig location: Contig_ID=SeqID_38435; Location=327..714; Strand=-
  SCN-specific regions: Sequence locations=1-30,52-257,286-388
caaaagttttttacaaccacatattgccatctaatttcttgcagattgaaagccatccattgcctgccggttctcgtcacagcaaagcactaatagggtgtttgattcacttcaaaaaataattccttacccacaagttttttacaaccacttattgccaatttaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataatt

SEQ ID NO: 67252 - DNA, 642 bp, Heterodera glycines
  Genomic contig location: Contig_ID=SeqID_38439; Location=1..642; Strand=-
  SCN-specific regions: Sequence locations=1-81,127-233,256-581,604-642
  Gene Ontology: Biological process=reproduction
ttaatttgcgtttttgtccttttcgccattaatttgctcaattacatggaccgttttaccattgcgggtaaattttacttcaaataaataaataaaaataaataatttaaaaaagtaaataattaataatttttaggagttttaaatgacgtccaaaaattttatcacattgatgataaaagtgcgggttttctgcagacagtttttatcattttcttcatgacaattgccccaatttgcggctttttgggggatcggtaaatgcacaaattaatttattgtcccatacattggcaaatgcccattttgttgtcccatttaagtttcaatcggaagcgcattttgctcgtcggtctctccgtttgggtcggcgccgttttcgcttcttcgtttatcagtgaaaatgtaaaacaacaaaatatattaatttgaaaataaacagttaattatttttaagcatttttgggcttttttgctcctccgtggcgtcgtcggaattggcgaggcttcttacgcagtgattgcacccacaataatcgccgatttattcgtcggtcaaatgcgcagccgaattttgatgttcttttactttggcatccccgtgggaaaggtaaaggcaataaacaatccaatcattaatta

SEQ ID NO: 67253 - DNA, 1213 bp, Heterodera glycines
  Genomic contig location: Contig_ID=SeqID_38440; Location=18..1230; Strand=-
  SCN-specific regions: Sequence locations=1-76,101-311,414-449,471 -814,836-1126,1160-1213
atggagcagtgcactgttgaacacattcgttatcagctgcgaacaggacgtgcccgggaacaggacaaagtcaactatggtggtagtggtggcggtggcacgcataggaatgatcaaagtgccgccgtatggatgagagaccgacggtgcaatcggtcggtttgggggactaatttagaaaaatattacagacattttttaaatcaaaaatgtttttttataaactcacataagacattttttatttgttttgtaatgcaacaaatgagatttcgtaattttttggtcaagattctcgttcagtatgaaactaaataaatcaaatcaaaaatattaaaatattttaccatttgaatatacaaaaattaaaaacaatttaaatttacatatttttaaattctataataaatttaggaatctaactgcatcaaaaaaagagctaaacttaatcatatacaaaaaataattttaaggaatttctcgtttgatttaaactttgaactgaatgacgataccctcaggcgctaacagaaaattatgaagaatattgtgcccatttttaataacaacaataaaattgaaaaaacccattaaaaattggtattgtttgtttgttcagcaccattggactgcttccatttgctcgttcgcatttgtttctgttgctgatcgacggcatttgtcatgaatcggcggcagagaagaaggaatcggcaaaaacgcagcagcagcgaaacggagccgaggacaaacatggcacttcaacagcagcaccgtctttgctattcccaaaatttatgtcgcaaaaacagggtaattaataattaattaattacatgtgtgaaaaaaaaccgttgcattaatgatatcgctattcaatgctcatcggtgtaatagtttttagtattcatgttgtgttttcagtgccgaattgtgaattgacacgttcttcgatggatttggagcggacattgcgtcccgatttggattatacactttcacatccaaaggcgggttttcattggtgctgctcgaaagtgttgaatcgtaaaaaagagattattcgaatcaattttgggtttctagagaatatcgtagggttcaatttttaaatcgacaaataggcattatttaattattattttttaaatataattttcaaatttccaggaattcaatccgatctgggaagggtattcggcacaacaactga

SEQ ID NO: 67254 - DNA, 2700 bp, Heterodera glycines
  Genomic contig location: Contig_ID=SeqID_8188; Location=1168..3867; Strand=-
  SCN-specific regions: Sequence locations=1-244,266-320,342-623,787 -804,826-921,1003-1320,1358-1609,1731-1755,1984-2020,2042-2199,2221 -2700
  Gene Ontology: Mol. function=structural constituent of cuticle; Cellular component=collagen type IV; Biological process=cuticle biosynthesis (sensu Nematoda)
atgccgcacaaatcatggtggaaatcatttggcgaagtgttttttgggcgaccgtcccaaattgggcgtgccggcgaagaaaacgcaatggcatcggcagcggatgacattgacgacaagcagctttaccgggccccatcgatgactgagatgatgcgggtgggaattgcttaaccaacggcggggagggaagaagcatggcatgaaatttggattggatgatttgagttaatggttctaccgtatttttaaaccaattcaaaaatttcaaattctctttcggaagcaataggcaacactgaaactcttcgatttcaatcaaaaattacattcccacttttttatactcatttttaaactcccattttggacttttggcatcccactgataattgataattgtcatgtcgccgtattctgaccaataatttactgcaatttccacactaagaaaaaagcataattattctctttaattattatcttgagaatgctaaaaccccacctttaattgctatcaacattaaataaatgggtttttttttacagttttgttgccgctttggctgttctctgcgcgatttgttgccatattgtgacccatttggcgagtgggacagctgaagaaagacggaacagaaaaagcagagggatgaagaaaagaagaatggaaaaaaaacaaaaaaaagaatgttagaataataaagttatttattcaaataaaaatatataaaaaaagaaaaagtgaaagaaaaggcgaataaatgagaaacaaagggaaagaaatggtgtcagcaataaagttaattatgtaattacttggtaattaatttactattccaccaaaggaaagaatcaacttgcttgtggacatagacataataaaatagtgctcaatcaaatgaaaaacggtcgaatacaagttttatataacttaatccaagaattggtatattttattttaatttatttattaattttgctctatttaatttatttaataatctatttgcctaaatgtctctgcgcggcgcggtttcactttgcatgagtgttgtgtaattattctgtgtatttgcgcgttcctgtttcaactttgtacggaatgatcttctttttatagagcagacatggcttatgccttttaataatttcccaattatataattacttccgaaaattacattttgagagtgtataaaatggcaataaaaattagttaaattaaaatgaaagagaataatttctttttgttttttaccatttttggtgccattttcaccgtcgcgtcattagccataattggcattctttttcaagtaaatttaattaatcaatttagtaaattaaaaaaaaagtgttaaggaactcagtttacttcaagaacaaattgagaatggaatttgggaattcaatgcgtatgctaatgaaagttggaccaaaatgcagcaaattaaggcaaccaaaaaaaacccataaaataatcttcgtaataattaattagatatttaaggagaatattcggcttacaattccgcgctttgtccgtggtcgtcgctggacaaattgctgcggtcaaaattcgatgaattattaccagggaagcggtcaacaacaacagcaaatgggcaacaacaacaacaacaacaacaacaacaacaacaacaacaacaacaacaacaacaacaacaacaacaacaacaacaacaacaacaacaacaacaacaacaggttgatttgctagaggaattgaacattaaaattaattgtttaaataaaagtgataaactcttttaaatagattattataacaaaaatatattgtattatatttgaattacattgaaattttaacaaattactactaattaaaaaacaatatgcgataaaaatttttgtttttaaaattggtaaaattctcgattaaaaaataatattcaattaaacatttaataataaagaataatcttttcatatttttttcagatattcttctccaaatttcaatcaccatttggctgggggaatccctcctcccccaccgcattttgcacccattcgctgcccaatgggcccgcccggtccgccggggcatcgcggcctcgccggtgagcccggcctcccaggcgagccgggacggcctggcatttccggaagcgaactattcaactattttcatgcgcattccacccattgtgcgccctgtccagccgggccgcccggcactgcgggctcgagaggaccgtccgggccgcaagggccggacggactggcgggaccgcccggaacactcggcatcgaagcctatgtaatgagggagcgaatgtggcatgccataaccaatataaattgttagcctggtccgtttgggcctccgggcgaccccggccaaccgggcccacttggccatgtcggactgcccgggctgccgggacagtcgtgcgagtcgggcggcattggacacgtaacgcgggaacattatttatcttaatagatttttcaaatttagccaggtcctcgtgggaatcctggccatgtcggaccggcagggccgcaaggacccaccggagagccggccacggaagggcggcccggcctgcctgggccagtcggaccgatgggcgagtccgggacgccgggcaatcgtggccaacccggcattccgggcccacccggactgaacggaaaggacggcgaata

SEQ ID NO: 67255 - DNA, 1094 bp, Heterodera glycines
  misc_feature (978)..(978): n is a, c, g, or t
  Genomic contig location: Contig_ID=SeqID_38443; Location=65..1158; Strand=-
  SCN-specific regions: Sequence locations=1-120,142-260,282-287,315 -473,498-694,716-828,877-923,946-954
atgcgcaaaattcgcgaaattgaaaatgagaaggaggaacgcatgaacgaggcacgggacccgaagcattggaaaatgagccacaacgacttcaagcgggtcatcggcgaatcgcgttggttttttggtgaaatataatttggcactaattcaaattgtcaaaatggaaagtcatggcaaatttatttaaaaaaaagagtgaatccaaccaaaagcgcttaggaaaatccttggaaattctgcataaacagcgcattaaaatgaaaagaagcctttaattggcgttgaaattttaattttaaaaattttttaaacataaagtcaaaaaagtaagccccctccccttaagaaacgacttaacaaatttcagaaaacccagccacccctgtaaaaattgccttttttgttggtagtttttcagtcctaaaaaataaaacccgtttaaaaagtttgtctgccatttcaaatcatagtttttcaaaattttatctatttatgcactcgaaaatagattccattggctaattgccaataaaattccaattaaaaaaacaaaacaataactttttcccccgtctacagtatcgcttattgttcaaacgctacaaaatgatcttattgtgccggcgtgggctcatttcggttcgatcatcaaagaaatttacacggaggttttgaaaataaatttttgtgactaaaaacaaattaattattttagtgcattccaattactgacggaaatgtggccaattatattccacaattagccagaatgtcaccaaattattggggagtgtcaatttgcacggttgatggccaggtaaaaagaataattaaaaaataaatgcaaattttattttattttttcaatttttagcgcatttcattcggcgacagcaaagtgccattttgtgttcaaagtgtttcgaaggcattaaattacagtataggtacaataaaattatttacattaattanataatttattttccaatttttgttttcatttttaaagataatttaattattttaatttgttattgtttttgaatgataattaaaattagcattttaatttagataaaaataataaa

SEQ ID NO: 67256 - DNA, 668 bp, Heterodera glycines
  Genomic contig location: Contig_ID=SeqID_38446; Location=601..1268; Strand=+
  SCN-specific regions: Sequence locations=1-283,327-347,369-668
atggtccacgcggttgacgaggacgggcaaaaagtgagtggactgtccaagagggccatggccatggagcaacagacgagctaattaggtgataattaattaattgattgtaaaaatggacaattttacacaattgtttttgtgatcgtgggctgaaacttttgcgcatatgcttaaaaatgattcaagtctgttagttttttttaattttaaatgtcaaaaataacattaaacaggtgggatgataggggagcagttcgttttcccaccacatatcctttcgtataaaaataatactttttattatgtataaaattttttaaaatccgtttttttttaaaaagcaaaatattctgaattaacagtttgaaaagtaatttttttcaaaaagaagcaaagtgtatgtagttgtccaaattgatgaataaaatcatttgatagccctgtgtattttttagagtgccacgggaccgggacctggtagcggacaactgagtacaactgagtaccaaggtcccggttttgaccgggaccgggactagtcccggttttcccagcaaaaaattcccgggttttcaacccgaaaaggtcccggtcccggttaagccaaaaattcccgatctcgctcaactctagtttaaaattcattcattttacaaacatgatga

SEQ ID NO: 67257 - DNA, 65 bp, Heterodera glycines; identical to SEQ ID NO: 56492
  Genomic contig location: Contig_ID=SeqID_38448; Location=245..309; Strand=+
  SCN-specific regions: Sequence locations=1-65

SEQ ID NO: 67258 - DNA, 59 bp, Heterodera glycines; identical to SEQ ID NO: 52421
  Genomic contig location: Contig_ID=SeqID_38448; Location=33..91; Strand=+
  SCN-specific regions: Sequence locations=1-59

SEQ ID NO: 67259 - DNA, 877 bp, Heterodera glycines
  Genomic contig location: Contig_ID=SeqID_8189; Location=1467..2343; Strand=+
  SCN-specific regions: Sequence locations=1-135,156-218,240-322,344 -795,817-830,862-877
atgtcccccctccgtttcttcgtcgccctttttctgatcactttggcaattttggccgggacccacggcactgttgagaactcagtggatggtgggccaaacatggcatcgccgattatccgtgaacgccgtaagttttattttattttattttaattgttgaatttaattaaaggttggggccatggcggcggaggccattggggctgaagaaaatggtgggagagataatggaaaatggagaacggaagaagcgataaacgatgaaaacaagaaaaaataatttgtggtagaagaaaaaatgctgaactcttaggtcgaataaagtttcaatgaatttcttattttttactcaaaatcgtcaaaaatttgggctttgcaaaaaacgcaattttaaaattaaatagcaaaaaatgttcttagatacgacctaaaaagctttggtcctttttaagtcggctttttaagtcgctgatttctaataaatccggaaaaattcgaaaattataaaaatatctatccccttattatcaatcattatgatcatcatttttagacaaaagttgttgaatcaaaaggaaattagttcgttaatgagtgtttcaatcattctgatcattactgacagatgcttaaaaggaaatgattcattgaaaataatgagacactctgtgagcaggatcccaattttaataagcagatggatgatcaccagcagaagtaatgtaatgagtcttgagcggtgctatgacgttagtcaaaaaccatcaaatgctgaactcttagttcgaataaagattcactctaattatccaattcaaattgattagtttatttattaaaataattgaattaaattttgtcacaaaagggaata

SEQ ID NO: 67260 - DNA, 647 bp, Heterodera glycines
  Genomic contig location: Contig_ID=SeqID_8190; Location=36..682; Strand=-
  SCN-specific regions: Sequence locations=1-34,56-81,104-139,161 -599,621-647
atggcggcggaggccattggggctgaagaaaatggtgggagagataatggaaaatggagaacggaagaagcgataaacgatgaaaaacaagaaaaaataatttgtggtagaagaaaaaatgctgaactcttaggtcgaataaagtttcaatgaatttcttattttttactcaaaatcgtcaaaaatttgggctttgcaaaaaacgcaattttaaaattaaatagcaaaaaatgttcttagatacgacctaaaaagctttggtcctttttaagtcgctgatttctaataaatccggaaaaattcgaaaattataaaaatatctatccccttattatcaatcattatgatcatcatttttagacaaaagttgttgaatcaaaaggaaattagttcgttaatgagtgtttcaatcattctgatcattactgacagatgcttaaaaggaaatgattcattgaaaataatgagacactctgtgagcaggatcccaattttaataagcagatggatgatcaccagcagaagtaatgtaatgagtcttgagcggtgctatgacgttagtcaaaaaccatcaaatgctgaactcttagttcgaataaagattcactctaattatccaattcaaattgattagtttatttattaaa

SEQ ID NO: 67261 - DNA, 977 bp, Heterodera glycines; identical to SEQ ID NO: 38452
  misc_feature (747)..(747): n is a, c, g, or t
  misc_feature (784)..(784): n is a, c, g, or t
  Genomic contig location: Contig_ID=SeqID_38452; Location=1..977; Strand=+
  SCN-specific regions: Sequence locations=1-424,457-715,738-826,851 -870,893-977
  Gene Ontology: Mol. function=alpha-methylacyl-CoA racemase activity; Biological process=isoprenoid catabolism

SEQ ID NO: 67262 - DNA, 104 bp, Heterodera glycines
  Genomic contig location: Contig_ID=SeqID_38457; Location=1..104; Strand=-
  SCN-specific regions: Sequence locations=1-104
gtcaaattggccaccgcttccgacgatgcgaccgcgcgcgtttgggacttcgcgcggtgtgcggagagcgcgtcatgcggggccacggagcagacgtccgatcg

SEQ ID NO: 67263 - DNA, 505 bp, Heterodera glycines
  Genomic contig location: Contig_ID=SeqID_38458; Location=258..762; Strand=-
  SCN-specific regions: Sequence locations=1-1,23-133,155-163,185 -258,287-427,449-505
caaaagttttttacaaccacttattgccaatctaatttcttgcagatttaaagccatccattgcctgccggttctcggcacagcaaagcactaatagggtgtttgactcacttcaaaaaataattccttacccaaaagttttttacaaccacttattgccaatctaatttcttgcagattgaaagccatccattgcctgccggttctcggcacagcaaatcactaatagggtgtttgactcacttcaaaaaataattcattacccaaaagttttttacaaccacttattgccaatctaatttcttgcagatttaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgaccc

SEQ ID NO: 67264 - DNA, 2737 bp, Heterodera glycines
  Genomic contig location: Contig_ID=SeqID_8192; Location=272..3008; Strand=-
  SCN-specific regions: Sequence locations=1-30,52-281,303-319,341 -370,392-744,866-912,935-1002,1025-1030,1052-1444,1485-1676,1698 -1860,1883-2604,2626-2737
  Gene Ontology: Biological process=axon guidance
atggaatttttcttgggggatttcgaatcggatgaagatgaagttgatgaaatttcgcaagttcttttacgggaacaaatttcacaaatgcaaacggaggatttctttcttcctgcgcacataaaattcacaactgatgctttcgaagaggagaacaacgattttctgtcggctgctgattttcctgatgactaccattactttgacaatttttcggatgagcaggaggaaatcaaacttatggaatcgccaatgttggtggaaatccccgacgaaatggacactccctcacattcatttggtccgttaagttgacaaaaagcagtaatattgaaggtgcttttttgagattattccatcaaattgagtggcaatgaaattgaaattttggatcgaattccggttatatccaaacccgggcagacaaagtctgttccggcatcgcatcgtcctgttgctgaggtattcgtaaggcaatcacagttcagcatttaagaggactttttagaaaattcagaacgaaaatttgctaccgggcgcacatcagcaaaaacaacggcaacaaattgagaaaacgcaacgaccatctctggcgatagattcggctgatataaaaaggcgaagacgcccgacaatgaacgcggatgactttgtttacactccgctgaaaaaagtgcgactgacagtcagaaagatggaggaaaacgttgtggtaaagagagaggaggaaactttggtcgcgaaaaaaaagaagaaaccaaaggaaaggagcgaaaaaccgaaggaagtgaaggaaaagcaaagggaaaggagcgaaaaaccaaaggaaatgagagaaaagccaaaggaaatgaaggaaaaagaattccaaggggttgaaatgaccaaaaaaacagcggaaacagtggtagcaaaaaaggaaacaaagccaaaagaactgaacgaaatgcaactgcaaaggctcaatctgatcaaaaagatcaaagagaagaaagcggtggcaaaagagaagagggagagggagcggaacgaaaaacaaatgcaaagactcgaatttattcgacgaatgaccgaactgcgccatttgaatccgttggcttccccatcgcgtgggcctttcctctacgaaggcgactatttctaccgcgaaattttagtcgggtaattatcgctccgctgacacttatctgaatgcgttttcagtcgatcagattcaaatgccaacaatggtgaagcggaggtcgattgtgtcagtgttagtgcccccggaggttttgatgaattattcgtcacaaacccagccgaaaatagtgccatttcgataagcaaaatgatttgtggaagaaagaaggctttgaacaacaaggaagaggatggagggacttattcagaagaaaggtgggcgtattaaactggtttttcgtgaggggtgagaaattaaatttttaaatgtttcagtttcaaaaaccttggtgttgaagcccgcgaatttcttggcagtttcctcaaattcatcgatgaccagcgtctcgttgacttggcaacccaaggagtcactggtggtgcgtcaatgtttcacagtttgacgatgaaaaacgccaactgtctgcgagagtctttacggctttattgtaaagtaagtttttgcatatcaggggagaggatgtgtccatgatgggatggagagggagggtgctttggttcatcagagatgaaagtgcacattttattttgttaaatttcagtccggccaagcgcttcttgtgcaagttcatttttggctgttaaagcatttgagtcaaactcgactgacttcgtacttaaatctgttacgcttccttaaaaacgcggtttgtttagttttaaaaagcaaagacaaaactacaaattaaagggcagcaatctcagcgattacattgcctcttctccaaccgctgaagccgaactcgaaaaggcgaacaaaaccatttcggaattcattgcgcaaaaactgtacgaacctccgttgagttcgtcttccaaatttatcgaagttaattctcggattcgttcaaacaaaaatctgtttcaaaaaataaacctgtaattaagtgcgatccgatcaaaaacgtgagtttggtgctcgtctatccgcaaatcaatgccaagatgagtcaacatacaatccgtgcccacgagaccctatttaggtcactgctctttcgtcgctttccctttgcaaaagctaatcgtccgatgggtcaaatgctttcaggaatctcttgccgcttgctgtttgctgtgtcgagaaggttgagcttaacttgaacgtcgaccggcccatcagtgtggaggagtgcgcttggatgtgcattcggatgattcggcagagggtcaaagaaatagcgaaaaggcggcaaaacgatcacatttttcttgcgggatggggcacaacctgttggctcaaccacaaagtgatgcttttgatgctattgacgacaattttttctaactttcaggccgtgagcaaagtttccaacgtttccggcattttggactttgcctttcccacagagagtccttgcggctccaggggggttggtcatttcatttgaatcttccaccgatgcaaatgatttgtttcagtcagtcgacgaccaaatttgtttgacttacccatcaactctttttgttgttggcgaagatgcacacaatgttcgaatgcaggccttacgtcaacttcgtaaaaatatgattg

SEQ ID NO: 67265 - DNA, 468 bp, Heterodera glycines
  Genomic contig location: Contig_ID=SeqID_8192; Location=3136..3603; Strand=-
  SCN-specific regions: Sequence locations=1-397,419-468
atgacactgcttttctgtctggcactttgtcctccaatcagcgaattgagtggggcactcaacaaatcggttatgaaaaaggtgttcgtactgctctgtccttctctcgtggtaaaagcaatgcctccgtcaccgatgctttctgtgccaaggaaaattcgttgagtactcgtacttttgctgctccgtcttgcctcactcccttccgctcaaaatacgcattcgattatgtcaatactccttcagggtcccgcattccccgactcattcgagtcgaacctaaaaaatgacatttattcgtccattctcattgacaaaaataacgattgtgcattattctcctgttgatctcacttactcattgtcagttgtaaggaaaagtcactttgatatcggatacatatgtttatgtctcttacaattagcgttgttttcatcacattatgaattaaaaattcctataataaa

SEQ ID NO: 67266 - DNA, 518 bp, Heterodera glycines
  Genomic contig location: Contig_ID=SeqID_38463; Location=99..616; Strand=+
  SCN-specific regions: Sequence locations=1-118,141-181,209-259,292 -330,369-394,416-416,438-518
atgtattttctccaacttgattcatttccaattataaaaatagtgttagtcagctttttggagaagcatttttcgactcaagtgcaggtgatggatcaactttattgtttgtgggcgcaaaaacaatttttatttcaaatccggatttgtggccttccaaataattaagtaagagcaagagaaaaataaagctaataaaaaatattttcattttttatgtcaatatatgacaagaatgattttaacactgaaggggacgatattttataaattgaaaatttttattaatatggcaaataatattgacagcattgattatcgtttctgatgtaataataatatttcatgtttaaaataatttttattatctgcttaaatattattccattgaattataattaatctaattattcattatcattgatacttttttaggatcgacctagcacccattctcatcctctgaggatcaaaacattttgcctaagggataaaaagagatcactgcaatagttgaa

SEQ ID NO: 67267 - DNA, 62 bp, Heterodera glycines
  Genomic contig location: Contig_ID=SeqID_38465; Location=261..322; Strand=-
  SCN-specific regions: Sequence locations=1-62
ttatatatatgttatataggttttgagtttcgtttcaaaaaacaaaatctcccggccgaagg

SEQ ID NO: 67268 - DNA, 1411 bp, Heterodera glycines
  Genomic contig location: Contig_ID=SeqID_38466; Location=58..1468; Strand=-
  SCN-specific regions: Sequence locations=1-26,107-224,249-371,432 -533,555-696,750-813,836-1411
atgaatgcagaatacgttgagacatgtaattaattaattatatgtattaaataaatattttaaatttgtattaattaatttaaattgcaaaattataataattaatgtttcaatttgaagtgataatttgtccatttgtttggctgttcattgcgaattcagcagtgtgcttgctcctattatttgttaatggatggccgaaaagtaaacatttatcaacaaacaaaaaaatttttttttaattatttcgattagattttttgtttttgattatttttgggcttcatctaaaatctttcagctatttatttggaaaatttttttttaattttcgattatgcataaatttatactttccatttgtttaattcagttgaaaaatttgggacaaccaacaattggggcaacattttttgtcaattggacagtgcgatggcaattttgattggatttggctgggcatttgcgccgttatggcttctgcggaatcaagtaaattttaaaaaaatagaattgataaggaataccatcaaaataaaagtgattatttgttattttttttttattaatcattgaaaattaactgacaattttaagtgcttatacaattggacccatcacatcaattttgtggccaaattattggggtcaattttttgagttcgtacattatcagcaactatgcagtaagaatacaatataaataaaaaaatattttaataattttaaatatttttaagtttaattatggttgtcgagaagggttcaaattggcagcagaaacacgagcattgatgattgtgtgcatcaatttggcacaattttggtcccaatttatttaccatgctcactggtccaataaagtaaataaattacatagaaattattaataattttaggccctcgattttcattatgatgaaattactcgatgaaaaattttttaattttcaacgatggtttatcaaactccgaaaatgattttgttttactaaaaaatttgcgaaaactcaaaattttccatttaaaatttcgtggatcccacaaattggactaaaacgttatttgcaattctaattacaatcgctttttaattttctaaatggttttttttatttgtgtttttcaatagcatttttgagacttttttcaaaaaatgaacctaataaaaaaacataaaataatttgcctaaataaatttagcatatggccgggatttctgtgttcatcacttgggccagcatttcgatcatttatcgtatttatttgttgtttgccgatgaaaatgagaatgtgccaaacatggaaatgcctgctgctcgggttgcccaaaatggcaccactgtattgaccaatggaaatgcgacacattattacaagaaacggacataatcattgtcaatccattaaa

SEQ ID NO: 67269 - DNA, 630 bp, Heterodera glycines
  Genomic contig location: Contig_ID=SeqID_38469; Location=457..1086; Strand=-
  SCN-specific regions: Sequence locations=1-547,592-630
atgtcacgtgctgatgaaataaaagaaaatgcagagagattcgccgtcttcgtcttgtgggtacgcagcgtggtggatgttggcactgcggggatgaccatcttgttaaatgctgtccgaaacttgtgggtccggacggcacaaaacgtatgaagtgtcaccgctgtcgtacgtggagtcatgacgctagagagtgtactaattgccatccgtacactttcattggtttgtgttaagaaaaatacgtttttaatttattttcttagagggttcgaaagcatgctggaattgcggcaagcaaggacacctagaaactagctgtcgctacccgccgtttcggtttaatagaatattaaaccaaatcatattgtttgtttagttatgtccctgtgggttcgtatccaaaatgggagggccaggacggctggcaaactttctggtaataagacaattgctcgaaacaattcagtttgtttatgtacaacccgaagaatctaaacgcatacattcattcatgcccagggcatcggttttcaatttcaaaccgtaaaaatagttatttgaatatttatttattcataatatatttaagtggatccgcaacccagtcatggacaatgggctaataaa

SEQ ID NO: 67270 - DNA, 708 bp, Heterodera glycines
  Genomic contig location: Contig_ID=SeqID_38470; Location=81..788; Strand=+
  SCN-specific regions: Sequence locations=1-286,396-594,616-664,704-708
atgagaagaggtacaaaagtgattagaagaggtacaaaagtgattagaagaggtacaatggtgattagaagaggtacaaaagtgattaaaagtggtacaacagtgattagaagaggtacaatggtgattagaagaggtacaacaatgattagaagaggtacaacaatgattagaagaggcacaacagtgattagaagaggcacaacagtgattagaagaggtacaaatttgataaaagaggtacaaaagtgattaaaaaggtacaacagatacatgaaattctatcaattaaaaaataattaatttaaacttataaaatttatttatcaaaaaaaattaattaaatataattttttatttattaactcaacaaaatattttaaattaattaaaatcattgaaaataacgtaaaaatgcacaaaaaaataatgttacaccgtccggattcgaacctgccccccccccctcaaaatgatgcctcagaatccccaatcacacagggattctgaggtcttgacgatgtcaaaagtaaaatctgatcacgtattcgtgatcagcggcccaaataacccctaaggacatatttttggaagatttttgtgagaaaaatttttccactcaaaaatcctgtccaccccctttggacccgaatcacaaaatcacttttatttttatatcttattttaaaaatttgataaaaatgtaaa

SEQ ID NO: 67271 - DNA, 951 bp, Heterodera glycines
  Genomic contig location: Contig_ID=SeqID_8194; Location=375..1325; Strand=-
  SCN-specific regions: Sequence locations=1-48,70-175,197-338,387 -412,457-734,757-951
atgccggatgttatttgcagctgcagttttggccagatgaatgtcgaatttgggaacaaaaatttgcgtcccgagccaaagaaagtgatccccaccagcaccagcaccacagcaacaacgaatacggtagcgtcaaagccaaagactatggtaaaaggttattaataatacatggaaaaattatatattaaaaaatgttattctaatgaatagaggatgttttttaaattttacatgtggttttattgtttcgatgaacatagcgttacaccattaagaggggttataatttaaatggatatatgaaatcccaaaagatgggctcaaaaaaattgcagtaaaattttttaatataaataataaaataaggttttaataaaaataaacgtatttgttattctttatgagtttattaaaaaatttcccttttaggaataaattttaaaatataaatatgattttcttagtttttcttttttgattttctttttgatttttgttgtgggtttattaaaaagagataaaattataagttttattgaatcctttcaaaaatttggggctgaatttcatttttcataataaatttctaacaaaaaattgttcagacttcttcaatccatcccagtattactgctgaagttgtcaaaattggaagcacattgcagtgttttgcctggcaaatttgcaatctgttggttttttttattcaattttcttggcaaaatgtttgggcaaaatttgaatttgctttctaaaggaatgcgaaatgggaggcgaaagtttcgcgacgctttaaactcggcaaaaaatgtgacgaagtgaacgaaaaatgggaccatttgaacgaagaaagcagcaacaccgaatacgtgaacaatgtaaacaacacaaatggtcagctgtttttggcggaattcatcggagcggccattaaatcggagaaataaa

SEQ ID NO: 67272 - DNA, 603 bp, Heterodera glycines
  Genomic contig location: Contig_ID=SeqID_8194; Location=105..707; Strand=+
  SCN-specific regions: Sequence locations=1-70,92-143,166-259,281 -465,488-603
atttactattaacaataatctcaaaaaatcaaaaatagtgggcctttttaaatggagttttttaaaatccaaaaattaaaggaaaattaaatgactttataacgtaaaaatattcaaatagaaagttataaatgctaaaatctttataagaaataatttataaatggatatatataaaagtgatcagaattgggttggatttccccaatttcagtcaaaatcccgataattgataaattaaaagcatcatttaatcttgatgaaaatgaatttatttctccgatttaatggccgctccgatgaattccgccaaaaacagctgaccatttgtgttgtttacattgttcacgtattcggtgttgctgctttcttcgttcaaatggtcccatttttcgttcacttcgtcacattttttgccgagtttaaagcgtcgcgaaactttcgcctcccatttcgcattcctttagaaagcaaattcaaattttgcccaaacattttgccaagaaaattgaataaaaaaaaccaacagattgcaaatttgccaggcaaaacactgcaatgtgcttccaattttgacaacttcagcagtaatactgggatgga

SEQ ID NO: 67273 - DNA, 1208 bp, Heterodera glycines
  Genomic contig location: Contig_ID=SeqID_8194; Location=1706..2913; Strand=-
  SCN-specific regions: Sequence locations=1-75,108-244,277-743,777 -782,804-865,890-991,1014-1208
atgaaggcaaatacagtgttcgtttttttcttctttttattcgggcttttgcagttttgtttcggtaatttttaattgctataattaattaaattttgatgtgttttcaataaaaaggattgttctgcaaacaaggaagagcagaaagtttgccaaaccaggaatacactattgtgaaaaatggaaaatgcttacctgataaggagctgtgttttgcggccacctgctcagcatgtacaatgacaaaatttaattattattaaaattaaatttattgcatttttcctttgctgtgatattctataaatcaatcacttttggcaataattggttaattaattatttttttcatttttatctcgctctcgggatcataagcacatttctgaggtacccaactgttcgagaccaaaaatttcccgagactcgagacagagactgaaaacccgagacccaaaataccgagcccgaataatcttttttcaacatttcgttgtagatacatttaaaatacagtttttattttggaaattttttccattttacaggggatcagccgggaaatgtgttcctttattggggctgtgctcaatcggtttggagcgatgaatgtatcctaagggcaaacgtaatgcaaacggtcgttgggtctgccaatgtttcatgtgaatgctttcgtggtgagacgggagtcgactggtcaaattcgaaaattgctcttcctcctcaaagcggaaaaagtgaaattattaatattattacttatataattatttcattcaattcataatttacttttacaaaattccaaaatattcaaaattaatattttcgagttatttattttgacaatttttgggtcgagaaaatatattttttaaatatttttggcggattagctacaatttgaaagctctaagcttatggctaaatgtcatacaaaaagagtagtgatatgataattagatacgtaaaacgtgtgataagaaagtatatttttatttaaattaattcataaatcaggactgaaatgcgttggaggatcgctcgatgagaaaagaaatggaaaaacatctgttcagtactgttttgatggttatgaattttgctataaggcggtctgtgtgaaagttaagttttgcgtgtatgtaattaagcggctaatgatcttttgtatcaggaatcaatttttccgaggccccaaataa

SEQ ID NO: 67274 - DNA, 343 bp, Heterodera glycines
  Genomic contig location: Contig_ID=SeqID_38473; Location=161..503; Strand=+
  SCN-specific regions: Sequence locations=1-343
  Gene Ontology: Mol. function=enzyme activator activity; Cellular component=nucleus; Biological process=deadenylation-dependent decapping
atgctcgacccgacacttaattatgtgctgctcgtccaaggatattacgcctcgaaaaactcgtggggttttccgaagggaaaggtgggaaagtgtttcacaaaatatctaattccaattgacatttccttttcagattaatgaggacgaagtgcctttgaattgtgcgttgcgcgaggccttcgaagaagttggctttgacgccaccgaacacataaaaaaccccgagaaatgccgcccactgcagcacttttttggcgaaacattggtccgtctttttcttgccacggatgtgccgatggatttcccttttaaaccgcacttgcgaaaggaaatcaggtga

SEQ ID NO: 67275 - DNA, 259 bp, Heterodera glycines
  Genomic contig location: Contig_ID=SeqID_38479; Location=108..366; Strand=-
  SCN-specific regions: Sequence locations=1-186,246-259
atgtgccaactcgtcaaaattgatggcaccgaaaatggtgtcacgatactccacaaatggttccaccgatgtcacattgttgcaccggtcccgatccgcacaaatgcatgtgttcacggatgggccaacctttgggcaaaatttaataattcaattaagtaattaatagttaaacatagttgaatgtataaaaatttaattgtttttagtgtttcttaaataattacataattaatttaaaaaatcattgttaaataaa

SEQ ID NO: 67276 - DNA, 312 bp, Heterodera glycines
  Genomic contig location: Contig_ID=SeqID_38481; Location=379..690; Strand=-
  SCN-specific regions: Sequence locations=1-175,198-269,291-312
  Gene Ontology: Mol. function=thioredoxin reductase (NADPH) activity; Cellular component=mitochondrion; Biological process=thioredoxin pathway
atggattacgaaaacgtggcccctacagtattcagccccctagagtatggttgtgtcggcttgagcgaagaaacagcccttgaacgattcggtgaagacaacatcgaagttttccccggatatttcaagccccctgagttctttattccccagaaaagtattgccaattgttacttaaaggtagtcgcccatagagagggtaatcaaaaagttgtaggattgcccttccttgggccaaacgctggggagattattcaaggatttgccccagcaatcaaattaaatttacccgtaaaggatttaatggaaact

SEQ ID NO: 67277 - DNA, 823 bp, Heterodera glycines
  Genomic contig location: Contig_ID=SeqID_8195; Location=763..1585; Strand=+
  SCN-specific regions: Sequence locations=1-208,230-680,706-748,799-823
atgccacggcatggccagcaaatgaacgggcaacaaaacgaagcgcacttagtggccacggaacaattggccgacctcgcaaagaaaagtgcgtattttcagggggagtgactcttttaagggcattgtcttagatttataacaattaggcatttcatagcggaggcttctgtttatctgatgaatccatgccataaatatgcaaggagtgtttctattctcttccccatagtgtaaaagaagtctaattgtaagcttgttaactttttaaaaatttcacgcggtgccttttccaactgccggtccattttcaacaattttgcaaattatctcgaaaaaaaatatcaaacgaaggcgtaatgttttacgaaatacggataccctttctttgccacccaaacatttactcttcttttcagcgctcatcctttttcgggatgccaacgaatcgttcagcgaccaaaatgccgtctccgattggctccgccgttccttcgatttgcctgctaattcgatttgcgaactctcctccccctcattggtcactaactcccaagtctttttcattgttttcgacgaaattgggacagccgaaaggattttggaaatgagcaaatccgaggagagggctcagaaaagtgagacaaagcgcaacgcaaaaaggggcatggaaaaaacgcaaaaaaaaaataaaataaaaaataaccgaaaatttctaaatgaattttcaacaattccattctttcagttttttaattttaaaatgttacttaaaagaatacttaaaaaattatttttgaactttaaattcggttaattaaaa

SEQ ID NO: 67278 - DNA, 724 bp, Heterodera glycines
  Genomic contig location: Contig_ID=SeqID_38484; Location=98..821; Strand=-
  SCN-specific regions: Sequence locations=1-336,358-724
atgtcagtagggttagtttatgacgctgatcacgaatacgtgatgccatagcgtaggattcctacactcgcctttcctacatctaggctaatggagttatcatactcgagctcaaagtatataaaagggagtggaaaatcgcttcctcggatcatttgtgaaaatctagcgtaggaatcctgcgctggctaatgacctagcgtaggattcctacgctagcctttcctacactaggctaatgtagttatcctgctcgagctcaaagtctataaaagggagtggaaaatcgcttcctcagatcatttttgagaaacctacagaaggattcctacgcagaataatgacctagagtagtattcatacgataaccacagggattgtggcgatccaagcaatccacagcacgatagggcatcgtggtatgaccatgactgtagcttctcgcattttatttttgatctcgtaacatccctctgctggtggcaatattgcgacgaaatcaacccatcaattagaccattgtaaaaaaagtatcaaattcagacatctttctgatacaacccctattgtcgaaataaaataataatccgaatatcagtccctttttaagtttagtaattaatataatcatttattttgtttcagtccgtcaacattctatccaatccgttcacagtgcgcagctgcgacaattgaattcattggcatgccaagaactgtttga

SEQ ID NO: 67279 - DNA, 483 bp, Heterodera glycines
  Genomic contig location: Contig_ID=SeqID_38485; Location=815..1297; Strand=+
  SCN-specific regions: Sequence locations=1-483
attttttgcctatcaaatatttgcaataaatgcccatctatttaaaaaatattctattctattaaaatgttctgtattttgctatatattaagaatagccgtacatctaaaggagtcagtaattgaacaaatttctcaaatttcaagaaaggttcaggcagtcgccgtaaaaattgtctatataaaaacaatggcgttacgcatttctgcactaggtcctttttcaaaattgatgtgcttttattgaaaaacatgtttaacgggccacaaattaatagacaaattcaggcacattcttaaaaaattctgcttttaattagttcatttaatagattatgcttttgctttgtttttttaaattctacgcctgcgattatctgataggacaatgatatcaataaattttcttctgaagaagcgaagagttagcccaaacgttttccttcctttctatttaatgatctatcatttcagatataacag

SEQ ID NO: 67280 - DNA, 176 bp, Heterodera glycines
  misc_feature (29)..(29): n is a, c, g, or t
  Genomic contig location: Contig_ID=SeqID_38487; Location=381..556; Strand=+
  SCN-specific regions: Sequence locations=1-49,71-100,127-176
gtccaggcctggatccaggtcccgatgancctggatttttcctggacctggattttcctggatttttgtccaggaaatcaaggtccaggtccaacatggaatccaggtccaggtccaggtccaggcttttttcaaaatgtcgatctctagtttaaacagctgtgagaattggcaaa

SEQ ID NO: 67281 - DNA, 237 bp, Heterodera glycines
  Genomic contig location: Contig_ID=SeqID_38491; Location=243..479; Strand=-
  SCN-specific regions: Sequence locations=1-97,123-237
atgatagcctccgagttggccgatcagattccgtcaaagatctccgatgagatggaggtcacgctcccgcacacgcgggcatccttcaaaattcaggcatttaaaattttggaaatttttcatgaaatttcacgccctccaggacatcatccccaaagggcatttgtccgactttcaaattgcgcccaaggacatgcagctgatccgtgccaatgagctggccaatgccatgatgga

SEQ ID NO: 67282 - DNA, 605 bp, Heterodera glycines
  Genomic contig location: Contig_ID=SeqID_8197; Location=1224..1828; Strand=+
  SCN-specific regions: Sequence locations=1-605
atggtttctgcaaaagttgtaaatattcactgtaacaaatcggtaatgctttcggagataaattctatcgggtttgacatggattacaccctggcgggtgaaacatttaaaaccagttttttccgaggaaaatcaaaaattaattttccacttattcaggctatttatcaccaaacacggaagaactcatcttcaaattatgcattgactatctgctgaaacataaagggttttggattgaagcaatatttttgtgtaatttttttttaggtatccgcaaaaaattgattctttggtgtacaatagcaagtttgctattcgcggcctttggtacgacaaaaaaagagcgaatggtgttgaaggtgcaaaacagtggcaacattctcagagcaacgcatggcggaaaattcttgacttggttttttgtttatttgagaatgaatttgtgcaaccaaaacttcttttaggaaaaaaattgctcaattgtatcccagaaacattgtcaaattgaaccgagaagtgaaagtgatgaacactttctacgacttgcccgaaaccgatctgttgtcccaacttgttcatctcttcgacaaagactttggagt

SEQ ID NO: 67283 - DNA, 3638 bp, Heterodera glycines
  Genomic contig location: Contig_ID=SeqID_8198; Location=19..3656; Strand=+
  SCN-specific regions: Sequence locations=1-265,315-874,899-1045,1067 -1122,1144-1219,1259-1373,1397-1474,1496-1529,1551-1587,1631 -1720,1742-1877,1907-2159,2183-2229,2251-2447,2469-2633,2655 -3604,3626-3638
  Gene Ontology: Mol. function=5'-nucleotidase activity; Cellular component=cytosol
gacgttcaagctgccatgaaacatgtgcactgtggtgatggagcaatgaaggctcaaattttgctcaatccgaaccaatacgtggaaaaggagactcgaattggcactttgttggaacgaattcgacgttcagggaaaaagtgttttttgctgaccaacagtgcgtacgcgtatacgaaggttcgttgagggataggatcaatttctgcattttctgtcgggtacgccccattcacctcccaatattttaatccacgagaaaaccaaaaaataaaaaaaagacaaaaattttctaataataaatgaaaatttttggccaaattcgtattacgacaattttctgtacataaactttcggaattggaaaaggaaactgggcgacagcacggtttttttaattaaaacttcttttatagtgtctgaatgtaataaatttgaaacgatttaactaactctgatttgttctttactagcttgcaaaattaaacaattggttctaaacagttaagcgaataaaacacttaaaacctgatttttttgtattacaaatctcatagtgctagcgaatgatgataaattgtttcatttggacaaattgaaaggagttttacacaaaaaaccgggttgtcgctcagttggccatcgctcagttgttcacccacagtgtggaaccgatcctgttcaaaatattatgttgacttatccaacccaatttaagggaattatgcgatttttactgggcaatgactggtcatcgttcttcgaccttgtgattgttgacgcggaaaaacctttgtggtttactggtgatgctgacttcaggacggtagtacgaaaacaatggttccatggtttataaccatctcattttttaggttaacacgcaaacgggcgaaactgaaacggtcccggacaatatttattcaggaggttcgttttgcaatgaatggtctccacttcctgggctgaaaattgccaaaaatagaaattgggtgaaattatttgattactatcaacgcacacaagttaagcgacaaaatcgcgtttcatttgaactgaaattttgaattctgttcaatgtctccaaaatgcacaagaaaccgatttttataacctttaaaatttaaaagaatttctaaaaggtggagtaccatcggtatatttacaaaatttccaacaattctttgtataatcaatgaattgcaaccataataggggcttggaaaattttaaaaattaacttcttttccatattccaacaggttcctgcggaggattacgcggtttgctttttgatgctcagtcggaaaatacgaagaatgttctctacattggggaccacatttacggcgatattttgcgttcgaaggtctggggaggggaagaggagggagtggtgtactccatttcttccacgccgttttccatttcctaccccccagtcagtcgtttaccccgaaaaaattcttaatttttctaaaaaattgtaatttttacaagaaaaattcaaaaaaaggcattgaacattatttaatgataatttttattgaaaaaattgtaattcagattataccttgtaaaatagtgaaatttttcaaaaaatttttttaactatttttttaaaatttttgttctttagaaaacaaaagggtggcatacatttttggtggttccggagctcaaccacgaaggggctgtgtggactcgaaacaaaaaactgctcttggaaaagaaacgattggagaacgccttggagaatttgtacaggtttggaattgggagcatttccccgccactctctgaaattaataaattatgcaatggcatagtttttctttttgatttttactttctagaattgggcaggcttgaagttcaaaaaaataaataaaaataaacaatttttgtagagggttcagttcctcctgggtcattacttttcgaattttttaacattgtaacgaaattttcaaaaatttgaatttttaataagaaaatttcgcggataaaaatttgacaatttttcagcgtttttttaaattttatgaaagataaagggaggggggggcgttaggcaggcacggtccaagaatttcggcttatgcggggtaccccccccccccctcggacgacgatctttttttgatttatcaattactattttttcaaaaacaaatttgggtatggaggggtcttgagagtggttgtgacaggacctgctcagatcccggagtggaggggaaactaggacgacttatcaattttttttgttcatgatgtatatttgcatctctgtcagaaacgccgaagaagatgtggtgccgcccggtgttcaggctctgtgtgatcaaatacaggcaagtgctgttggtgttttattgtaaaaatgtttcaccagtggcaccctttcgataccgcctgaatttaatatataaccttttaaaaagttgattttcctttttgattgaattttaacatttttttgcaggatgtttcgaaagcaatggaccaggcctatggcaattacggctcacttttccgaaccggcacgcgtaaaacctttttttcataccaggtgtgtgttattgtggcatttacattttttgttgctctttgtgcaaataatatttattttgcgaaaatttctcattttcgcagggcgacttaaaagaaatttgaaaatacaatatattttaaattccaattcatttgcagcttgaaaattatgccgacttgtatggaagttcgtgctttcatcttctcgactaccacccctcatatcatttccgcgccaaattcaaattgatgccgcacgagtcgccggtggaccaaagcgaagcggacaatcagcagggccaagtggaggatcagcatggccaagcggcggacggtcagtcaacactctcgaaaaatcatataaaaaaaattgtctcaaccgcaaagcttttgtactttattcccagcctcggaagaccctacctagcccctcctttcgtcaaaattttttttgacccagcgaaatttttttttgaaattttgcggccgaattatgcttgctaaccagggaagggcgcgaactgtaagtcgagaaatgcagttgtgttatataccattggatagggaatggtcgacttatattgtagatttcttaatttatacctccatatgaagaaatcaaaagttatgtggccacagaaatgaaacattttagtgcctgaggcatttccggttttattgattttttattaattccccatccttgtacttgatttaacctaggacctccaaaattcaaatttgaccagcttagccacgaattttgctcattttcttcacttgtgcaccagtggtggggggatgatcctccgctttctccttggttatttttgcggaaaacaatattagggttttcatgtgcgctggtctcgaaatttcgttcaatttatagctccgccgaaactccctaaaatttgtattttttcacaaaataatggagtcccattctacacgagttcctgaatttttttgaaatttcttaaaccattttttttctttcaggtcctccatttgaagtgccgaatgttagtcccaatcagagtagtagtgaggacgaggaggagcagaatacggataattga

SEQ ID NO: 67284 - DNA, 595 bp, Heterodera glycines
  Genomic contig location: Contig_ID=SeqID_38494; Location=12..606; Strand=+
  SCN-specific regions: Sequence locations=1-347,370-421,451-595
atgccatccgccgcggtcgccgatgcgctccacggcatttgcccagccgaccctcgccggcacgggccactcgcgactgttcgaaagtgtcagtgccctgaagtacagcgtcagcttcacctttgtacgaagcgaatggcattttgccaaaaacacacagaaattgtgggtgttgtaatgcaattttagcaaatcaaagagctttgcgacatacttccccatccgttggctgtccaaatttactcggcattggcatcgaacacgctgaacattgatgcgcgcaattaacaacaattcaatttaaaaatcaagagcgtacaggggggggggggctaagcgggctaaagccaccccccaaaaagaaaaatacatccctaaaaattgaattttgaattgagcccccccccttggctacgccctgattaaaatatttaaaaataaaaaatttttctagcaaaagttggccaccgttgagagtgtaatggccgaattgccatttggcgttttggaccgtttgtttttcgtcggagtgccaattgtggacgcagaagtcagagagcgatttcgaagactatggtaattggaaaattataaa

SEQ ID NO: 67285 - DNA, 352 bp, Heterodera glycines
  Genomic contig location: Contig_ID=SeqID_38495; Location=480..831; Strand=+
  SCN-specific regions: Sequence locations=1-175,203-292,315-352
atgcggccacgttccaaatccctttcaaatataaattttgaaattactcaaacaccaatctgccgtttttatctacgctttatggatgcgttatatggtagaaggcgtttatcaactcctcatagaaattttttcccaacaaaaatgaacataggtctttctcagcacttttttcattttaaaatatattttttaaattttagaagcaaaacatgatcggatttttttgaagcgaaaaaagaacaatcattgggtgaagattcgacgggtatatccagtattcatcttggcgttaatataatttaaataatttagtcgtcacgtctgctggataaaagaaataatattgata

SEQ ID NO: 67286 - DNA, 166 bp, Heterodera glycines
  Genomic contig location: Contig_ID=SeqID_38498; Location=403..568; Strand=+
  SCN-specific regions: Sequence locations=1-166
atggcccgttttgtcaaccattcttgccagccaaactgttgcgctctgctgacaaccaccacaacttcaacagatgatgccaattctgatcagaaggaagtgccgtccgtgttggtctatgcgctgcggcgcatttttgcgggcgaagaattgacaatggactacg

SEQ ID NO: 67287 - DNA, 141 bp, Heterodera glycines
  Genomic contig location: Contig_ID=SeqID_38499; Location=446..586; Strand=-
  SCN-specific regions: Sequence locations=1-141
atggccaaattggccacaacggagcagctcaacgagcagttcggactgtgtgacgaggaaaaagatgaagtcgggcaaaggttcgctgtggcaattcgccggacgaaaatcattcggcacggaaggcaaaaagtccaaacg

SEQ ID NO: 67288 - DNA, 777 bp, Heterodera glycines
  misc_feature (642)..(642): n is a, c, g, or t
  misc_feature (735)..(735): n is a, c, g, or t
  misc_feature (745)..(745): n is a, c, g, or t
  Genomic contig location: Contig_ID=SeqID_38500; Location=5..781; Strand=-
  SCN-specific regions: Sequence locations=1-777
atggacaagaaaataaacaaaatatacaccgacccggccaatccgggcgggtatgcgggggcgagtgctctgtacgcggcggtgaaggagaagcacccgaagttgaagcgtgccgagtttgaggactttttgcaaaggaacaccacctacacgctgttcaagccaaagagagacaagttccgacgcctacgcactgtgcctacgggtttcatgaccggtacgttgtaccggggcttattgcgcacaattcagggttcagatgttcaggcggacttggcagatttccaggcactttcgcgcaagaacagcggctaccgttacttgctgttggcggtggatgttctatcgaggcgaatgttcggcgcgcccgtaaagagtaagcgccctgtggacatgaaaagggcgtttgaagagctatttgagcaaatgccaagggtgccagacacaatgtacaccgatcgagggctggagtttgtggcaaaaccgttgaaggagttttacgcggagaagggcattcaaaagtttgagaccagttcaaagaagaaggccgccttgggcggagcgggccatccgcaccctaaagactcggctgtacaaatatttttccgccacacacttcggtttgggtttgaatgtgctggncaagtttttgagtgcatcaacaactcggtgtgccgcgcgaccggccttagacccaacgaaatcattgacgcaatgcgcaaggaagggtgtggnaaggaggggntgtacggcgaaggactcgcacaattgggacaa

SEQ ID NO: 67289 - DNA, 576 bp, Heterodera glycines
  Genomic contig location: Contig_ID=SeqID_38501; Location=293..868; Strand=+
  SCN-specific regions: Sequence locations=1-388,411-413,448-537,560-576
atgggcaatgtcgtcagtaaagtgggcaattttatggtcaaggcagcatttgttgctgtcgacggatttttggctgttggcgaagcgtttggccaaggaatgcgcgcacttttgtccccggaagagcacgccaatcctccgatcactcaagtgcttttggttcgacgccgtggcgatctcatcccgtgctttcgcaatgtgttgaaaagcaaagtaaaaattttttttgaaattttaatccattttttggatgccattcgccattttgtatcactttttctttttttttctttttaaatttaagaatgaaactgctcttggaagcatacatgatgaactgagcgacctcggcttggaccacatttcgtacgcatttgttaagggcgtcgagtgagtgaaaaaggaaaaggcggaaataatttaaataaatttaattttaattatttagtctaaaattgggcttttttttacgttcagagtggacatggtctgcaacaaatgtgccgccaaagtggagcaactcgacgacttgtgttattgtgtggatgccaaagagagatgccatcaccgcaaatg

SEQ ID NO: 67290 - DNA, 458 bp, Heterodera glycines
  Genomic contig location: Contig_ID=SeqID_8199; Location=567..1024; Strand=-
  SCN-specific regions: Sequence locations=1-10,42-162,184-309,422-458
tttgccaaaagtgatgacgaggaggaggaggagggggcggacaatccgacggatgacatccgaaagatgcgagaagaggaaagaccccaagtggtggtgttggacccgagaacggatctgtcggcggaagaactgcagaaagagattgagaagggaaacgaggaggaagacagtgagagaagggggaggggtttaattagaggggtgggtgctaattgaggatttatcgttggattcgaaaaatttcgaaaattacaatattttcagagcgcaaaataatggaaggaaaaattatgtttcggaagcccgagaaaaggaagacggaaaatggaagtgggaaagaaggaagcaaagaggaggaggagaaggagaaacgagccaaaagagaagagaaaccgggacagcagcagaaggagcagaacagacgacttctttcgtttggggaggaagacgaatga

SEQ ID NO: 67291 - DNA, 186 bp, Heterodera glycines
  Genomic contig location: Contig_ID=SeqID_8200; Location=131..316; Strand=-
  SCN-specific regions: Sequence locations=1-186
atggcttcgtccgattctgaagcttcttcgttcgcattccctcagaattcgaagtgcggcgccacggcgagcggacagaaaacaacggccaatgcttcgtcctctctggcgatgcgagtgcagcggaaagtgttgtccaaattgtccaagcggggaatggtgcgacttttgggcgacaatcgtttg

SEQ ID NO: 67292 - DNA, 195 bp, Heterodera glycines
  Genomic contig location: Contig_ID=SeqID_8201; Location=211..405; Strand=-
  SCN-specific regions: Sequence locations=1-53,95-195
atgctcgccgttgtcgctgtaagtttcggagccaccgttacggtaaggaaacgatattaatgtattttaattattttaagaattttttttttttgaaaggtgacttcaatcattataacaatttgtctacagcgaagtcgaattcgaaaattaatggccgagaaaaatggaaaaatgacaatttacggagaataa

SEQ ID NO: 67293 - DNA, 947 bp, Heterodera glycines
  Genomic contig location: Contig_ID=SeqID_8201; Location=1263..2209; Strand=-
  SCN-specific regions: Sequence locations=1-80,102-254,276-552,574 -752,814-947
atggcatttttgccatttgccacggccaatttggctccgttctcccccatcattcagcttaacccccgcggcgtctcctactccttcactttggtcatctccttccatcccgtctttttgactggcattgaccgtgccttcaacattcgctgctttttcacagaagcagtccgtgcaattgatgcttcaatggacgttaggtgagggaaagcatttgccaattgcgttgcttttcccctgtttctattccgtttgtccctcctttagccccctttcaacttcggtggtggagcgtcagttcgcccttccccagtgcaattaccatttacgacacggcatcgacggaccctttctgaagtacgcgtcaattggcgagccggtgacgcatgtttggcagtgcgacccggtggccggatggttgtacggagtgctcattcactcgtgctttgtggacgacggacgtggcaatcgcttcgatttggtggatgacaaagggtctgtgacagcagtgggaggaaagcgcacttctgctggggagggggagttgaaaatcgttgggaccccgtggtttggcttgtctcaagaattcgggactgactcggccgattctctcttgggagggtctccgtcggtccgtccatgttctcgtcccgttgtccttgttcagctgcgtcaccgaccaatctttgctggccgacattcagtacgacgaaaaggcatttgccgcccattcgcatgcccacgtggtactcttccgtcccttttcattccgtccctcgtccatttccgctccgtcccttcagttccgttacgccgatcgtgtccaactgttcttcacctgcaccgttcagttgtgcttccgcgaagacggcggttgcgaaggaatctctccgcctcagtgcgacagacacaacacttccccagcccaaaggtcgtccgatggataa

SEQ ID NO: 67294 - DNA, 108 bp, Heterodera glycines
  Genomic contig location: Contig_ID=SeqID_38507; Location=334..441; Strand=+
  SCN-specific regions: Sequence locations=1-65,88-108
tcgtacgtttcagacctctcacagtccaggaaaaaaatatggatttccatgtaaatgatagccctaattattacacaaatgccttttttaattgctcacccaatgcaa

SEQ ID NO: 67295 - DNA, 345 bp, Heterodera glycines
  misc_feature (297)..(297): n is a, c, g, or t
  Genomic contig location: Contig_ID=SeqID_38510; Location=637..981; Strand=+
  SCN-specific regions: Sequence locations=1-345
atggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactggccctcggagctgtgtccagcggcgagatggttcttcccaagtccgggaagctcggatgcctggccagcgctgtgtcattaccacttgctctgtctccttcgctgcccatgcgcacgcttgcgctgaaacgggangttgtttctgctgaaactatccgtctttacaagacggctgtaatatag

SEQ ID NO: 67296 - DNA, 1004 bp, Heterodera glycines
  Genomic contig location: Contig_ID=SeqID_8203; Location=676..1679; Strand=+
  SCN-specific regions: Sequence locations=1-347,395-444,467-624,646 -1004
atggcaaaaacagcagaattctatgatgataatgataacagcaaatctagcaaaggcaatgcccaattgaagagtgatcatcccacgcaacaagcaaatgggacaatggcagcaacaaagggcacggagtcaaaaggtgccgatgagaaaggtgggcaaatacggcactgatcaaatactggcacgggaaaataagtctcagcttgtcatattttatatgtttatagtacctaactcaaaaaggtcatgtggtgaattagctacgaagatttaagtctgatcagctctcttttattgagctatggatttattcaaaagcatcccgcccctctccttcctgaaacccgaaaaaaatttttttgaaattttcaaattttttatattctttaaaattcaattttcccccacggagccagtcggcactgccccggcttttcttttcgtctaaaaatatcataaaaaatttcgtatcgtcgacaagcaaaaaaggtcatcaacagggcgcggcgaaagtggctctcttgccgaaacgttgagagtctggctcggccatctgatcaatttaatcatttttattattttttccaaatctgttaatttatgttttgatatatttaagcagtgaattattttttatttttttttgttccaaattcctattttatttctccatcccatcgccctctttagctccgcttcatcccaactcatccgacgactctaatgcctccccttccgttggtgggtcgtccatttccgactttgtcgcgcagcttccgcccgcccctccgcttctcgtgcacattgcggtcccttttttgctaattgccgctacgtttgtcggtctgttcaactgcgctgtcgcgttcggcctgtactttgttttccgagctgttgcttcggactttggacgaagtgcattgtatacattacccagggatttcaagtgggtgctattgctgggcaaagagtcgagaatgaagcaaattagttcccggggataa

SEQ ID NO: 67297 - DNA, 992 bp, Heterodera glycines
  Genomic contig location: Contig_ID=SeqID_8203; Location=1336..2327; Strand=-
  SCN-specific regions: Sequence locations=1-237,272-992
atgcgcgtacgcgttggcatgcgcgttgaattgggcaaatgtcagcgatcgaccgctctccacctcgaccacgcactgtttgttcgggtgacggcgcactgtgcgcaaaaagtgggcatggattggtgcaccgctgcggaatgcgcgccacaacagccatttgagttggaagaacagaaaggtgcccctgttggagagaaaaagtggtcagtttgacacagcaagggttgccaataacagaaaaaattaatttgaaaatgaaaagtgaaaacactctgaggatggatgatcaaaagcaaatgcaaaacgtaagcagggaatgaaaaaaattaaattgacaatatatcaatgttcttataatttcgtttaaaaattgcaaaattatcgcctattggcagacgggtcgaaaaagtttcattaaatttaaaaaatgtacaaattgataatatttgctgagcgaaaggccactttaaagctttccgatcagtaaacctcgatcatgtcaagcacaagaaatgattcaatcattcaatttacagctatcaaattttgccataaagaattgaccaactcgcctccctggacccgtattttgtgttgatctaattttcttggaaaggtcaaagactacttgaaagtgattaataattatccccgggaactaatttgcttcattctcgactctttgcccagcaatagcacccacttgaaatccctgggtaatgtatacaatgcacttcgtccaaagtccgaagcaacagctcggaaaacaaagtacaggccgaacgcgacagcgcagttgaacagaccgacaaacgtagcggcaattagcaaaaaagggaccgcaatgtgcacgagaagcggaggggcgggcggaagctgcgcgacaaagtcggaaatggacgacccaccaacggaaggggaggcattagagtcgtcggatgagttgggatgaagcggagctaaagagggcgatgggatggagaaataaa

SEQ ID NO: 67298 - DNA, 1981 bp, Heterodera glycines
  Genomic contig location: Contig_ID=SeqID_8204; Location=301..2281; Strand=+
  SCN-specific regions: Sequence locations=1-72,95-201,225-313,335 -335,358-548,607-737,813-1015,1037-1141,1171-1200,1222-1223,1246 -1498,1520-1624,1646-1764,1794-1981
  Gene Ontology: Mol. function=transporter activity; Cellular component= extracellular space; Biological process=transport
gcattctttgctacatttacaccagcggaacaaccgggtaaattttttccttctttttttttgtaaaatctgtaaattttgatttctttttaagtgcaccaaaggcggcaattatacggcactatcgctattatttgatgtccattggctgtggcaatgcctttggcattgttccgtcggatagagtaagtaccctttgagttttaattaaatttaattattttgcttacagctttatttgacactgccaatgtaccatacggcgggcggcattcttggcacatcacaagttgtcttcaaaggttagctaatgctaattgattttgattatatggaatttatttattcatttaattatgctatggatgcataagtataaataaatctttattatcctttaaggttgtacggcatgtattcgtacaaaattttctgcaagcaatttctggaagggtaatttgttctactctttttgttaaacgaaaatataaaataaaaaccgaattgttttaaaattaaacgataaaataaaatgaaaaatcgaattctttttataataaatttatataataattattatttatattttttctcttaaataaatttctttactccccccccccctcagattgtattcgctttgaatgcacagtgagccaatacattggcgaaatttgtcgatatttgttggctcaaccgccgtctccaatcgatcggaaacatcccatccgggtgagttataaaatttattaataaaaatgaaatttcattaaaaaaataatgattgtaacgaaaaattattatttttttttgttttgacacaaaatctcataagaatttcattcgtcaattaataaaacctttttgtcattttggcttctcaccggcaatggccttcgtccacaaatttggcgtgcttttgtgcaacgttttggcattgcaaaaattggcgaattttatggtatttataaacaatctatttgtttcatttgtggttcggttggttgtctctttgtttcttttaaaatgatttttgcaagttcaattccttttgatgcaacggcaatgaagtaaaaataaccctattttgtgaattgctaatcaatgtgcagtaaatcgattagtctttctgagccgaagcaattttttatttttaatctaaaaaattttcttgcaattttttccaggaattgcttttactttaaataaaaaattatttttgccaaataaatgtttcattaaaaacaaaaatatttcatcagagtaaattaataattttttctaaaggcagcaccgaaggcaattccaaccttttgaatcttgacaatcggccgggctcgtgcggcttcatccccatttacaactcattgcacggcttcttcccgctgctcttgctcaaggtggacccgaagacgggccaactgatgcgcgacaagcgcggcttctgcatcaaatccgtgccgggcgaaaccggcgaattggtgccaatattattattaaacattttcatttatacatacataaatttctgatataatctgcgcttcattaagataaatcccccatgcatccttatgcagttagaaaaaaaaattttctgcgctttttgaaaaatttcatactatgaaatttaaaaatattttttcagtgggaaatgatgcgaggagaaatgattcgggtacgggggggggggggggacggggacggggacgggaacctagtgtaccctcttttttaaaattgtatgattgattttcccaacacaaaaaaaaacaaaattaatatttaattaagttgttgagggagtaaaagttttttttgttttttatataattaactctttaacaattcgcctcaggtcggtgccatccgcaacgacccattgctccgttttgaaggctatgtgaacgagggcgacacgcagaagaaactaattaggaattgtcaatctgctggtgaccaagtgttctccaccggcgat

SEQ ID NO: 67299 - DNA, 891 bp, Heterodera glycines
  Genomic contig location: Contig_ID=SeqID_38516; Location=65..955; Strand=+
  SCN-specific regions: Sequence locations=1-693,736-891
atgcgtgcagttcggccaaggcaaagtttgacagcatttggagaatgttcgtcgactgcgaacaggcggtgaggacggcgctgagtttggacgaagcgaacattcagcgcagaaaagcggtgcattttgttacattggaaatggcattttcgaacttgacattatgtttaggaacaagaaaaactcagtttggaccgcttcagtgacagcacaattgacgaaaagctaagtgatccgaacggaataattttggagccgatgaaggaattgttgaagacagaaaaggactacattgaagacatgaggtgggaagggactctgaatttgcattttcgaataatttaaggcgatgcgttgacatttatttgtacgcctaccgtacgtccggctcaatgtgtccaatgacaatccgaggcaaagagcgcgagatttttgggaacattgaagaactttatcagtttcatagcaggtgatccgaattaaaactatccaaaaaaccacaaaagtgccgcaagttaatatgaaagtaattgttttagtgttttcctcaacgaactgatggcttatgcgttgaatccggaggatgtcggctattgtttcattgaatggatggaaaaactgaaggaattgtacgcggattactgcttgaacaaggaggagaacaattacctcatttgtcttcctgaaaccatcaaaattttcaatgtaaaaataaatttgcattagtcaaaattgaaaacttcttcccattttaggaaatacgcgaacagaatgggctcgacgtatcgcatgaccttcagtcactcgtcatcaaacccgtccaacgagtgaccaaatatcacattctgttaaaggaactgttgaagcactgctccaaaagtgcgaaagaaa

SEQ ID NO: 67300 - DNA, 327 bp, Heterodera glycines
  Genomic contig location: Contig_ID=SeqID_38517; Location=429..755; Strand=-
  SCN-specific regions: Sequence locations=1-144,166-327
atgaaaaagccgttggaatctccagcagtggcggcgtcgtcggacaacaaaacgattgggcaacaaattgcgcaaaatgttaaagttgctgacaacgctaataagcaaatgatgttggatggggaaaaacccgaagaaagtgaagaaaaattaaaggaaaatttaattgacaaagacaaagaacatggagcaaatgaagcggaaattgagttggcacgaaaagcatttgaaaattggatgaaatcgatgacggagacgacgaaaaatatgaaaacggatgaaggatttggcaaaatgaaagtatatttgcagtggctgttccgttga

SEQ ID NO: 67301 - DNA, 1241 bp, Heterodera glycines
  Genomic contig location: Contig_ID=SeqID_38518; Location=77..1317; Strand=+
  SCN-specific regions: Sequence locations=1-24,46-276,315-790,813-1241
  Gene Ontology: Mol. function=RNA helicase activity; Biological process=RNA processing
ctgaaaattgctgtaattcattgctttccaccaacagaattgtggaagtgtccggcgacaacacgcccgagccacacgaactaaacagggcatccattctgatcacaacacccgagaaatgggacgggatcacgcgctgtgcggacacacggcactacgtcaaacaggtggaactgttggtcatcgacgaaattcatttgcttggcgttgaacgcggtgctgtgcttgaggcaatcatcaccaggtgagtgggcaggcaatcctcggatattgttatcatgtaaaatttcaaattttttgaatttttattgttaaagaatcaagtcgatggcacgccgtcgtgagcttgccaagttgccggttcgcgttgtttgcctgtccaccgcgttggcaaatgctggcgatgtggctgaatggattggcgttcgggatcatgggctcttcaatttcaggcccagtgtcaggccggtgcctgtccaggtgcacattcaaggctttcctggccaacactattgtccacggatggcactgatgaacaagcccgcttatcaggcaagtgccatagcgactgatggcaagttgtgggtgccatggtcattgatggcaccgtgtggttgccatggtcattggtggcttagtgtggatgccaggtcattcccccatccatcactttttcagtacatcaaacaattctcgtccacaaaacctgcactgatctttgttgcctcacgacgacaaacgcgcctgacagcgatggcactgctcggcttgttgcagcgtgaaggggaacaaagccatcagcaatggttgggcatgaatcagacagagttggagcgcacgttggcctctgtgcgggatgacaacctgcgactgacgctgacctacggtgttggcatccatcatgccggactgcacgtggtcagtcgatgaaataatgtaatgtcatgtcactggcattttctacctctcgaaactctcgatttggttcatcgagtctgaaagatgaaaacattgagtcccatattttcaaatctccaccaatctgtgttattgttttgttgtacaactacaggctgagcgtgcactggtcgaacgactgtttgttgaacgcaaaattcaagtgttggtcgcaaccgcaacgcttgcctggggcatcaatgtgccggcccatttggtcattgtgaagggcaccgaatactatgatggcaaaacgcacaaatacatcgatttcccagtgacag

SEQ ID NO: 67302 - DNA, 392 bp, Heterodera glycines
  Genomic contig location: Contig_ID=SeqID_38520; Location=230..621; Strand=-
  SCN-specific regions: Sequence locations=1-141,191-342,366-392
atgtgtgaggaaattcggctacgattcccaaaattgaatggcattgtcagctgtgcgtcagtgcttccaagtcgtaggacaaaaagccatgacggtcttgaacttacaattcaggtggttcaattaatttaaatatgtgtcaaaatatatatttaaattaaaaaaatttattattttttaaaattaatttccctcttccaattaggtgaatcatttggcgcatgttttgttgtggaccgatcttttgccactgctcgagcaaaattcgccgtcacgcttgttgactgttggctcaatgctacataatttgtacacatataaatgccattttaaatcaaattataaaaaattgccaaaaattttaagctgctcaattgactggaacgatttga

SEQ ID NO: 67303 - DNA, 1044 bp, Heterodera glycines
  misc_feature (66)..(66): n is a, c, g, or t
  misc_feature (109)..(109): n is a, c, g, or t
  Genomic contig location: Contig_ID=SeqID_1074; Location=123..1166; Strand=+
  SCN-specific regions: Sequence locations=1-400,422-493,515-652,674 -771,793-931,1018-1044
atgcgattgttcaaggacaaggacgaagatgaacagggcgaccgcctgatttgtatcagcctggcncaggtggggagttcaagcagtaccaggagggacaacccctaancccccatttgacattttgccgctttttttagcgcttcactgatgaatcgcattacattatgggagcgtcggacgctagtcaactgcccatggatgtgccgctgatctccatcaaccattgtctcgcggatttcatcaaaccggaagacattgaaggctcacgctgtgcacagtgcagcaacgcaacgccaccgccgtctgcgccaccaacgcttgtcaagcagctgatgttcacgcgattgcccgacattttggtgattcattaatcattgattaattgatcatcgattgattgctccccttttttgccccttcacagatcatttgtttcaagcgcttcatctatgaaccatttgagcgccgatacatcaaacagcacgtgcccgtttcgttcccgttggacaacttcagcctgagcaaatacttttcgcccgatgtgccggctgcgctggtggcccaacttcctctctattcctgcattgcaattgtggtgagttgagagtgattttgatcagcggcaatttgaatgacatcattaatcattcttcccctctttcttttccttagactcatcacggccacttgaactctggccattactgctcgtttgtgcgtgacggcttcactgacaattgggttttctgcaacgacgacagaactctcgtaagaaaacaatttcgaatcaattaatgccagcttttcatccattctttttagcccactgaaagctgcgatgtggacacgcgaaatgcctacattgtgttctaccaacgcgcaaattcagtcgctgcccaatgagatgaaatgagaggataaccattgttgtatatatatgtgtataattgttgtcgtatatgtatgtatgtgtatattatcgtatgtgtatattcatttgtatgtacaatatgttcattggtattaatgatgtgttgatga

SEQ ID NO: 67304 - DNA, 74 bp, Heterodera glycines
  Genomic contig location: Contig_ID=SeqID_1074; Location=1827..1900; Strand=-
  SCN-specific regions: Sequence locations=1-74
gggtctcaggttcgattcccagtgcatgctattgatgtatttcgatgattttaatgaataaataaaaggaatag

SEQ ID NO: 67305 - DNA, 3320 bp, Heterodera glycines
  Genomic contig location: Contig_ID=SeqID_1076; Location=1631..4950; Strand=-
  SCN-specific regions: Sequence locations=1-366,388-714,736-1712,1734 -1825,1847-2095,2117-2631,2653-2931,2953-3320
acgtcaaaatcgtggctgtgcacacagtcaaagtgacaagccattgcttgaatgtcggactgaatcgcggtcattggtggaagcttcaagtgaagataaatgacaatgattgtgagatgaatggggacaccggagcccaagcaacaatcatcacaatccaaacatggattaaattgggaagaccaaaattggaactgtcggacattgaaatgcataattgtaatgaggaaccatttcccaccgaaggaatgtttcaatgtgtcgtcagttgctttgacaagccgccaaaaaggctaactgcatatgttagcagtgctgtcaattacaatctctttggattgccatggattatggcttttgatctgatcccaagggaagtcatgtttcctaaggttcagcaaaaagagatgtgcgagccaatcagcatccatgccacattggcaccaatgcgaaaggcaaacattaaggatgaagcatcactgattgaggctttgaaaacggatttttcggaagtttttgaaccaggacttggccaatgttcgaaaatcaaggcacatctgatcctgaaacaggatgccaagccaattttctgcaaagcacggccaatcccacacggtgcaactgaagccgtaaacgctgaattggaccgacttttggaaatcggtgccattaagccaattgatttcagccattgggctgcaccaattctcgccgtgaaaaagaagaatggcaaaacaagggtttgcatcgacttttcgacagggttaaacaatgccctcgaattgaaccgacaccctttgccgagaccggatgatatttatgccgcactgaatggagcgtcatatttctcaaatttggacttgagggatgcctatttgcaaatggagttggacgaggagtccaaggacctttgtgttatcaatacgcatcgcggcctattccaatgccaacgtttacctttcggagtaaagtcggcaccgtccattttccaacatcttatggaccaaatatgtgctggaatacccggcgtgtttgcctatctcgacgatgggctcatcgcttctaagacgttggaaggacatatttcggcactttaccagcttttcacgaaaattaaggaatttggcctgcgtattcagttagaaaagtgcaaattcttccaaaaagaattgctttttcttggtcatattgtgtcatcaaaaggcattcgtcccgatccggcacgttctgaagcgatcagcaaaatgcccgcgccacacgataaaacatcacttcgatcgtttttgggagcgctgaattattatgggcgattcgtgaaagaaatgcgtgaaatacgcacaccgcttgatcagctcctaagaaaggacgaaaattggaattggagcgaagagcaacagaaggcttttgaaaaggcgaagaagatcatgacatctgatctgctgttgactcattataatccggctcttccaatcatcgtggcagcagacgcgtccaaaaacggaattggcgcaacgattggccacatttttccggataagtccgagaaagtgatcgaacacgcatcatgtgttttgtcagattcccagcagaattacagccagatcgaaaaagaagcattggcttttgtgttcgcagtgcagaaattccaccgaatgttattcggcaggaaattcaccttatttactgatcacaagcctttgcttgccattttcggttccaaaaagggaattccgatttattccgccagccgattacaacggtgggcgttgatcatggcaaattatgatttcgacatcaaatacacgaatacagcatcatttggacaagcagatgtcctctcaaggctaatagccaattatccaaagcctgaggaagatgtgttgattgccaacatttgcgtcgaaacagactgttatattaacaccattttacagtcgcaaaccgatcatcttccagtcacggcacaagaaattgcggaatcaacaaccaaagatgagacactccagaaaattgttaattttgttatttctggttggccaacgaagtgcagggaacccgaaattgcaccatttcatccgaaaagaaatgaaattttggaaattgggggctgccttctctacaaaagtcgtgttatcgttccaagccaactgcgtggccgaattttaaaggcattgcattttgcacatccgggaattgtgcgaatgaaggccttggcacgccagtatgtatattggccaggaatcgattcggaaattgagagagttgtacggcaatgtgatgaatgccaaggtgcacagaaatgtccgattaaggcaccattggccccatggacagtcaccgacaaagcatttcaacgcgtacacatcgactttgctggaccctgccaagatggatatgtttattttattctggtggacgccttttccaaatggccggaagtctatcaaatgtcttcaattacggccaagtccacagttttcacacttcgttccataatccatcgccttggcattcctgaggaaatagtgtcagataatggcacacaattcaagtctgctgaatttgccgctttttgtaaagaattcggcatcaagcacaccttttcaccgccatttcacccgcagtcaaatggccaagtcgaacgatttgttgacacctttaaaagagcaatgaaaaagtgttcaaaagacgataaaaattggaccgaaaaggtgctgctcgcttacaggacaacgccaaacaatgccattgatggctattctcccgatcaattattcttcggacggaaactccgaacgaaattggcattggtccttccgaaaggacaccgaaacgattcggagaacatcgacaaaattcagctcgacaaaagaagaaaggactattcgaataaaatggcaaaacaattcgatgaacggcatggtgccaaagaaaaagtctttttccccgccgaaccagtcctccttttgaactacaggaaccaaaaaacttattggctccatggtacaattgtagagcgagtcaggaattcgcctacataccgagtccatgtaccagttcttggtcgaattgtccaccgacattcgaaccaacttcgtcgaaattgtgttttcgaagagaattcgaaacacaatcctggtcccgatcagcagccaattccaccagtcaacggacaagctcaaaatttggcgcatcaaattgctgatccggtcgatcaacggactgatcaacaagccgcaaatgacccgccgacaatggctcttcgacgatcgcagcgtaagccgaagccggtgattcgcttctcgccttccggccgctga

SEQ ID NO: 67306 - DNA, 551 bp, Heterodera glycines
  Genomic contig location: Contig_ID=SeqID_1077; Location=625..1175; Strand=+
  SCN-specific regions: Sequence locations=1-156,182-266,290-375,396-551
atggccgacaacaattggttgtcgtcttcgttgtcgttgaacctttttgaaagtgcgtcgaaatcgaacggagacgcgtcgaggcggtcgaacgcgcgtttgggacgcggaagagacgaaacgccggccgacgactggggggcacttaattaaagcaattaattaattagttaattaattatagcgaaatgtgtacttttgtgggtgctggagaagactctgtatcatataaaaggttggatacgcactgacactgatgagaaaagagaggaggaggcaaagggaaagggcattttggacaaatgccattgggagacaattaaaagggagcaattaacaactgctaattaatcaacgatgatccaactgacaaaaatatatatatatatatatatttaagcaattttaaggaattcgaaaacttaagaccaaaaaaagtgagtcggcgcaaagggaaaaaaatttggcaaatcattgaaagagtcggaaatgggcaatctgtgaaaacgatggaaaggagtgaattttgaaaaggaatttaaaaagaaaaa

SEQ ID NO: 67307 - DNA, 1375 bp, Heterodera glycines
  Genomic contig location: Contig_ID=SeqID_8206; Location=1..1375; Strand=-
  SCN-specific regions: Sequence locations=1-975,1030-1102,1127-1375
cggttggcctttctcttttcccttttgttgtcattcgtttccgccactcagttcctccgctccaaaacacgtgcactttttcattttttgccatttaaattccgattccctgaagggattgaccaatgcaatgccgacaaaagcagcgtcggctgcggcccggcggggaaatgcgtgccgtttccgcacggtgcgcggtgccaatgcgcaagcggacggatgggcacagagtgccaaagtgagtgtcgcctacattcaattctggcacattcttgacctgagaagggcgatccattgggacgggcaattatcattataaagcgaatggcaccagcggggggcggatccttttaattagtttcgagagttgccggattactttttgcttatgatcccatgattatctgattctgaatccctttcagggccttgccaggttcgcttctttcgtctttaccctccggcgtcgtccctctcactctcttccccccccttaaccccttaaaaaggacatttataattcgtgcgaccgatggcttcaggagggccgctgcgtttggacgcgtcccttctccgctttcttcttggacaattgtccgttcacttgcggaatctgtcagagagcagcgggacaaaaaagtcaaattttgattcaaatttggctaaacgatttgccaaggccttccggttccgctcccgccaatgttggagccgttggcctggtttgtcggacggtggcagacccaaacaattggacggcactcggaccgattcccggcaccgctgtcgcgcgggccgtacattgaggtaagaatggcacaaacagtgaagcaatgcggtgcaccctaagactccaccgcccaaattccgccgagacataactccgccagagcaaaaaattttcattagaaatcttgaaaatttttttcttagagaattcgaagaaaaaaatactttcaaaaaaatttccagcggttttttttaaatttttgaaaaaacttagtaatttatattaaattttgaaaaaatcgcttgaaatttttttgaacattttttcttcgattttctaagaaaaatttttctaagagatttttctaaattgaaaattttttaaaattttttttttggcggagtttcggcggcggagttttgtcctgctccggaagcaatgcagatcaaattggctcgctctgctcagattttggacgtccaattggccgaagtgccttctttcgaccgaccaccgctgaacatcaggtcgagtcgaactgctccaactcatccgatcaatttttgtggttgaagtgtgacggcacgcactttggacggatgggaagagcacaacgaagtgggctttctgacggtgaaaccggcg

SEQ ID NO: 67308 - DNA, 285 bp, Heterodera glycines
  Genomic contig location: Contig_ID=SeqID_8206; Location=1814..2098; Strand=+
  SCN-specific regions: Sequence locations=1-285
gctttggtcaccaaattctgtcattttcagtattggcaagacgaatttctccagtgggacccggacacttacgacggcgccaccgaaattttcttgggtttgtttttgtcgagagtgactctcggcctttgactaattgccttttttgaccttagggccaatttttccttttcagcctcaactgacatttggatccccgaattttcgttgtattattctgtaaattttaacgacgcggtcaaatagcagtcgaacaatgatgtccgagtcaattacaccggtgag

SEQ ID NO: 67309 - DNA, 98 bp, Heterodera glycines
  Genomic contig location: Contig_ID=SeqID_8207; Location=201..298; Strand=-
  SCN-specific regions: Sequence locations=1-98
atgggcccaggagccaagcaaaagagtgcagcgttggctgaaaaggacgggaaattggccaagggaaagggcggcgaaggagcgatcagtgatcagtg

SEQ ID NO: 67310 - DNA, 2669 bp, Heterodera glycines
  misc_feature (2650)..(2650): n is a, c, g, or t
  Genomic contig location: Contig_ID=SeqID_8207; Location=244..2912; Strand=+
  SCN-specific regions: Sequence locations=1-262,284-407,445-1153,1175 -1602,1624-1687,1778-2200,2222-2283,2332-2482,2505-2669
atttcccgtccttttcagccaacgctgcactcttttgcttggctcctgggcccattcaaatgactctatcaaatactcactgttttccaagaatctgtccttgatagacttctacgacaaccaagaatggcaacttgacctggtccgtccaacgcaatttggcattttgtctcttttaaatttggacattggccaagccattttaattgggccattgcttttttatttatttttcctttggcactctctcccctccttttgcttaaggctcaaagtcacatcacttcggatggctttctgtacgactatttagaccccccgctgttctgggaaatggtcgtcattgacttggtggtgggacggcaaagcttttactatgtgagttaatagcagtgccacgacatggctaattagttaattaattgtttgattaattaattaattggtttgttgttttaccacttaaggtgttcaacttggtcattcccagtgccatcataagtcagttttgtttttttgcttgccagcaccgtaccccaacccccatcaaatatacggtattggccccttttcagcgcttgtcgccgtcatcggtttccacacgccgagcacaagtggaaaaatgaggttgagagggcaaaagccgacctttaacggtcctttttgttaagagacgccaaattccgacttggcataatgacactgatgaggcgagtgaatgccacggcacccaattcaaacgaattgtcaaatgtttagcatgtccatgattttgttggccatcgtcgaagacatgcccaagttcagcatctccagcagtcgcaaggggcgtggctcattttccggcattcccctgatcggtcagtcgttttgattactcgtccatctgattctacaatcttttctctcacttttcctctgtcttcccatcaatctgtatctctcatacgctgttttctctcttcattctcctgtctgatcactcattttcctgttcaccgactgtattttccctaccgatcgttcctgaagatcagtcacctttgttgtcttcccctttctccgatatctcgcatttctatcccctcctcctccctctgagcactcattctgttctgctgatcagagtcctctattgcctccgctgatcagactctttccctcccccttttttgtacaggcctttactactttatgctgttggccatcgtcggcatgtccaccgtcacaacgtgtgacttttttctccccgccctctttctctgatcattcatttcccttttcagttcggtatgttcccaattcggtcgttccgtggtcatttcccctgtcagatgttcgtctacgtggaacggaatgtgcgcattcaccaccacgtgcccttttatttgcgttggatgattgcaattgagcggcgcaaacggaggataaggcgggcgataattggacaattaagccaggggattaatggaaattagagcaaattaatggcaaataccattgacattgcttaccgtttacatcgctttagcatggggtacagcttccgcttctccaaagccaaacggaccagagaaacacagcgccaacagaagcacaacggaggggaggacggagcaggcgaaatggtcagtaagtgggcttctcaaattcagtgcttctcctctttcctttcattggacaaaaactttccttttttttgccattctttttctcttttcccctcttttttggctatgcttttccccccttttctccccatttccctgcttttcctgcccattttccacttaggacactttgctgacttcgacccccgcgacaacggcgtgcggtcggcgtgccagccgaatgggcagcgcattgtgcggccatttgaacggatttgcgggcatcggaggctctgacagcaatttgttgcgctgcgtttcgccaacgccgtccgagcggcagcgaaacgccgaagccgaaaaaacgacggcgacgacaacgaaagtggtggcgaaaagtttgttgaggctaatgccacgaaggagtggggacggacggaaacggacgagcggaagtgcaaaaagcacgcgggagcaaaaggaggtcgaagaggtcggcgcagaggggggggggggtaattaagtaattaagggctaattgaaagggcaatgccctaattaggtaatgcataataatcatcgaaaaggcaaaaacgaaaccccaaaaatagaaactttctccgcctaatagcagcactattgtgccagtattttgtgtgccaaatattagcagaataaataaaaatttgaaaattgtcaatcaattggaaattgctttcccaatatctgctggatttgggttgtcatttggggtgcaccccaaaatctcgccgcctaaagttaaaagaagcattccgctaaaaaatcgctttgttcgcttcctagtccttttcgattgagtcaatggcaactcgtaaaacgcaactcgtttcaataaaaatttaaaaaaataaagcctaagcctaggcccaagtaagcctatgattaggcctaagcctaaagcttcatcctaagcttatgtacgaattgcctttttacgagttgccgggttatggattttttgggagagattttgggcggcagagattttgtcccatccncctgccattcgtcattcgt

SEQ ID NO: 67311 - DNA, 202 bp, Heterodera glycines
  Genomic contig location: Contig_ID=SeqID_38522; Location=801..1002; Strand=+
  SCN-specific regions: Sequence locations=1-202
gagagtgtcctccgtcgggacggttgcattgtggtgaaagacaacgtggccaaagggactgaaaaagaatttgacgaagtcgacaattcatgggccaggcctcgggaaatgctgcacaaattgttcgaacgagccgactgtcgaattgtgctggagagaaaacagccgaacattccgaaagctctttacgaggcatgggaaa

SEQ ID NO: 67312 - DNA, 583 bp, Heterodera glycines
  Genomic contig location: Contig_ID=SeqID_38523; Location=46..628; Strand=-
  SCN-specific regions: Sequence locations=1-81,119-583
atgacgcaacccgccgcggttcagccaaatctgcagcaattaatcgacgtaattgctcagcaacagacgcaaatcaaccagctgataaatgttcaaagaaacaatcagccaaatccagcaatcatccaaacaataccgtcaatgccggacgtcgcaattttcgaacattgcgacgaaaagcatcgcatcaccgaatggctggagcgtttcacttttgccattgactcgtgcgcaccgaacgcggccgatgacataaaagtaaaggcactgatgaacaaactgtcggaaaccgcgttcagcgagtacagcaaatttgttctcccggccaaggtgacggatttcgactttgatgaaacaatttcgaaattggagaagctgtttgccaaaccacaatcaatatttgtggaccgatttgcatgtctgatggccaccaaagacgatggcgaagaatttcaacaatttgttaacaggcacaaacgacttttgaaagattttcagtatgacaaattgaatgaggaacaattcaaagggctaatgctcctaactgcgctgaagtcttcaaaggacgcagttcttcggcaac

SEQ ID NO: 67313 - DNA, 680 bp, Heterodera glycines
  Genomic contig location: Contig_ID=SeqID_38526; Location=410..1089; Strand=+
  SCN-specific regions: Sequence locations=1-345,368-376,420-445,468 -563,609-680
atgtcatcatctccgtccactgctgtattcattttcgcttacacacttttttccgttgaactgatcacttgtgtcgccgttttggccatcacttttctgaatttggctgtcattgtgccaactaaacttttgcatttgaacctgaaaagcattctgatcgtccaaagtattgccgttatgctttatgtgttaccgcgtgtagtaatgcttttccaaaaattcacatccgacgacccatttgcacctgccaacgttgtactacaggtacaagcacagggatggcataaattccgaacaaaatttaaaaaatataatagaatcaaaatttaccgatagtcggaaataatttttaatggatttaaaaaatcgcaaaaagttttttttttataaaatgaatttctaaaattatagaatataatgacttttgacgctttgttccgccgtctgcttggtcatgctttgatcattgaacgatttatcgccacacttcgcacaaattcatatgaaaagttttcaaaagtgttttttactctgacttggttttgcattacggtattcgttggtttttaaaaaaatttaattctttaatttaatttatttattttttacagttcgccatcgcttttgtgaacactaataacacaatgaatcagtcagtggactatttaccgaaattctaa

SEQ ID NO: 67314 - DNA, 253 bp, Heterodera glycines
  Genomic contig location: Contig_ID=SeqID_38527; Location=376..628; Strand=+
  SCN-specific regions: Sequence locations=1-253
atggcaaatcccgcggacatggcactgctgttccaacagctaacagacactctcaaaaacattgcaaatcaaaatgcaaatcccaataaacaaaactccgatttattcgctacaattaattcacaattgtccgaattcatctacaacccggaggcggatttggtttttgagatttggcatgagcgctatgggccattcctcgagacagatggacagtcattgccagatgaaatgaagacacgtctgttggtcg

SEQ ID NO: 67315 - DNA, 557 bp, Heterodera glycines
  Genomic contig location: Contig_ID=SeqID_38529; Location=197..753; Strand=+
  SCN-specific regions: Sequence locations=1-346,428-434,473-557
atgtcggcggcgcaagtgtcattttggctggtcggcgcaagtgtctgcggcgcaaccgcggcgcaagtgtcggtggcgcaaatggcagcggcgcaaatgtcggcggcgcaagtgtcattttggctggtcggcgcaagtgtctgcggcgcaactgtcgcggcgcaagtgtcggtggcgcaaatggcagcggcgcaaatgtcggcggcgcaagtgtcattttggctgggcggcgcaagtgtctgcggcgcaactgtcgcggcgcaaatgtctgcggcgcaaatgtcggccaatccgaaaaattgattttttaatgctttccaatttccttctcctaaatcagattaacttaatattttaatgattaaatattttaatatgttattagaaatgttaaaatgtttattaaaaatttttttagttaaaaaatgtaaatgctattattaaatctcttttttacttttgaattattatcagggcttctttttttatgtaagaaaattcgctaaatatgtataaaaatgataaaatatatatgaaatatgtacaaaaatatgtaa

SEQ ID NO: 67316 - DNA, 2339 bp, Heterodera glycines
  Genomic contig location: Contig_ID=SeqID_8208; Location=553..2891; Strand=+
  SCN-specific regions: Sequence locations=1-55,77-323,345-347,369 -406,428-593,625-688,710-710,998-1043,1065-1075,1127-1234,1257 -1712,1735-2173,2195-2339
ttgtcttccaaaacgaaaagtgaattcgaaggcgaatgtgaagaacattctctgcttcaaattggatggaattggtgagaaacaataaaacaaagtcaattagagagtccttattttaataacttttcaggtggaggaaagaaatgccattttcctcccttcgcccggcattcccggcgcacccatcgaatggcacgcgtaattcgaacgttcgaaaatttttactaaatggggggcaaaacataggtcgacaagcgaagaaaacgcttcatctgctgttggcttcgaaaggcattgtccgctcatttttctgcagggtaattaaaaggaaataattaatattgagtaatgagtaattaggtgaagaatcggacgaaaattgcaaccaaaatgtgatcgcaggactggcaaatgttctgccaatggaacggattgatgattgccaattggaaatgcctttattggagaagcgaatcgaagaggtggcgaggagcgggagggatgggcactgatcaatgatcatcgatcgattgatcaattgtgattggaaagtctatcgattttgactggaccgaatatctctctaaaattgagattctttagaatttcttggagtgcagctgtccatgggacaggtaagaatattaaacccatttgaccgaataagaggttcactctctcttatttcctctttttcgtctctccctttctctctctctccttcccctcccctcctccttcctccttatccctgcccctttttttcctctgtccctttctctctctccctccttctccttccccttcccctcccctcctccttcctccttatctctgcccctttttttcctctctccctttctctctttctcttcccctctctctctctctcttatctcctctttttcctttctctctctcttatttcctctttttcctctctctctctctctctctctttctcttcccctctctcctcttttctcattctctctcttcagttctttgctcgactgtccggcactgaacagaaactcacggccaactgaatgcgtttttctgattttaaaggtgttttttctgaaaatgttttttcttttttattatattttttagtttttattttccatttctcaccctttccacgctgaaattgtccttcgcaaacgcatttgcttgtgcattggcgaaacaaactcaaatttcgcagttggttcctcaatttggccatgggccaaaaaacaggtaaaaacaaatgttttcgatttattttaatggaaaatgatgactttaggaaatattaacaggcacgggtctttttgtggatatcgtcgcgtgcattcccaaagtacaaaaacaaatttaaaactatcaaatttctcccaattttcagtgttccgttggctttgagcgtcgcgaagagttggccaaattggctgttcaggttaatgccattgatgttatacgaattgatcaaatattcgcattcttagcatgccaccaacagcagtgatcagatggaagacggcgatttgtctttggtttcgttcggttcgtcggctttgcccggggcgctggccgattattcgccacgggacgaagccaaaagcaattacctaagcgaatacgtctccaaaacgatcagtgcggtggaatggctgatcaaagtgagtcgcccaatgatcgtccaattaatgccaattctttgcccattttattctcaaattttcatttttcagctcgaccgactcaggtgggaaaagctgtgcaaagtgccaaaattggtcggatttgcgatttgtttaggcaggaggaggcgatcagaagggcgatggccaaactaagcgcggaaagggcaccaaaggcggaaattgagggatgccgggcatcggacgggcgaatgacacgaacgatttcgctgccgacatcggtgggtgtgcaatgtttgttggttgtgccattgttggcatgccaaatgcattggccctttaaccctcgacaacattcagtttctgccacccctccatttgtccaacttcaatctgatctcttctaagcaaatttcgcctgaccatgttcagcaaggcgatggccaaaaatcaatcggtgccattcgccccttggcttacggcatttcgccaacagcaaaaccaatcgccacccctggcgatggccccctcacaaatggtcaaaagcagtcaaagtcatacggatgggttctgccagttgctccaccatcagtcacgtcccccgtgcgcttcgtccagcagttcggcttcatcttcgggctacgcgtccatgggtttgtgagaaagaatgccaatgcgaaaacattctga

SEQ ID NO: 67317 - DNA, 388 bp, Heterodera glycines; identical to SEQ ID NO: 51536
  Genomic contig location: Contig_ID=SeqID_38532; Location=214..601; Strand=-
  SCN-specific regions: Sequence locations=1-20,42-275,297-388

SEQ ID NO: 67318 - DNA, 457 bp, Heterodera glycines
  Genomic contig location: Contig_ID=SeqID_38533; Location=21..477; Strand=+
  SCN-specific regions: Sequence locations=1-457
atgtccaatgaggcggaaaaggagttcacatcgacgggcaacccgaaggcaccagcgcttcacgtggtacttgactggatccaccgatcatggcaggagatttccaaagaagtgatcatcaaatcatttgagggtcagttgaaaaggaaaaaagaaaaatgcctgaatttttagtctgtggattgacaacgccattggacggaacaggagacgaaaaaattgcttgcttcaagccgaacggagcaattggaccgatcgggatcaaatttttgcgcgaatttagagcaactgaaacagtgaaagatggacgaaatgatcaagaggaagccggcctttctgaagatgacggtgatgtagagctggatggagttggagatgacgatgaatttttgatttgttagcattttactgtttctttcgttgttattttaaaaaaattgctgtaataattttttaa

SEQ ID NO: 67319 - DNA, 71 bp, Heterodera glycines
  Genomic contig location: Contig_ID=SeqID_38533; Location=534..604; Strand=-
  SCN-specific regions: Sequence locations=1-9,31-71
ccccgtctcctttaaaggccctgtctccaattatgtccccctttctgacgaggttgaaaaataatcccccc

SEQ ID NO: 67320 - DNA, 533 bp, Heterodera glycines
  Genomic contig location: Contig_ID=SeqID_38536; Location=16..548; Strand=-
  SCN-specific regions: Sequence locations=1-14,39-533
atgtcgtactcggagagtgccacacagaaaatgattgccagaaaagtctataaaaaggtgagtagtgaaacagcggaaaatttacgtcgtaaattttttcccatttaaaatttttccaattgaattaattgtgtccaaaaaaagtttctacaggaaaaaccggaaaccgtcggccagctaaataaatcgaattaaagtactagtttttttagatttagaaaagactaaaaaaaccttttcaaatgcattccaattatttaaaatcaattgtttcgccgcttccgttgcatcttcaatttccctcatcatttccccttttcagtgaccttctaccacgaggggttaaggccattcaccattcttcccttccttctcaatatctaaaatggcagttttattgcagtttacaaaggctgtatatgttcacgtaaacaaaaatgtcgacaattttcaaattcataactgttctcagaaatattggtatcattcgacattccgaatttctagctcaatagacttagaattttaataaa

SEQ ID NO: 67321 - DNA, 642 bp, Heterodera glycines
  Genomic contig location: Contig_ID=SeqID_38537; Location=720..1361; Strand=-
  SCN-specific regions: Sequence locations=1-86,108-562,588-642
gttccaataatgattatccttggggggcaagttcggtcatcacaaatttacaatgcgcaggaattttgcaggtttattcatttaagaattattataaattaatttatgttaaggatttggcggttacgtaagcacagaagaaaaaaagcaatttagcagtaaacgagagaatgagctgttactgcaaatcccaaagaatggcgtcactgttccgtaccgagtcgtagacaatccaacacgattgaaggacgaggaatgggaccgagtggtcgcagtgtttgtgcaggtgggcgtatggtcatttcaggggatttgcaaaactgctttagggtccggcctggcaatttaaaaattggaaatggaatggcaatccggttgagatatttgccaacattggtgcgtttcacttgcaattcgaagaacgtacgagggatactgagtgcgattcgggtcgggattagttcaactgtttattaattggggaagaatcgtgagcagataacaaccaaggtagcttaatttttgatagtgaaaactagtcttttagtgtttcatgtgtagtgatcggaaggttcgcaaaggcatcagggatggtcggaggtgaaggaattttgggcaatgctagacgggcgcatttagaag

SEQ ID NO: 67322 - DNA, 321 bp, Heterodera glycines
  Genomic contig location: Contig_ID=SeqID_38538; Location=40..360; Strand=-
  SCN-specific regions: Sequence locations=1-96,243-321
gatgatgagtcatcgatattgcctttttaccgtctccaacattcaaaatcattgccagtggaccggacaccgacaccaacaaatgaagtggcttagaaaaaattttaaaatatttgaagaaatttttaataatttaaattgaaaatttttaacaataaaatgaggtggcttagtaaaacttaattaaaaaattaaaatgaaaatacaaatttaataaataataattgaaattgaaaattttagcaagaagaaaatgtaacgagcaatataaagatagccaaaaaaattaatgtcacagctgacgggaactgtttgtttcgt

SEQ ID NO: 67323 - DNA, 682 bp, Heterodera glycines
  Genomic contig location: Contig_ID=SeqID_8211; Location=228..909; Strand=+
  SCN-specific regions: Sequence locations=73-126,226-271,402-415,470 -470,519-591,641-682
atgacgcagaatgcttcagctggaattgcttcggaattggttttgaatagaaatgcttcaagatttatttcggtagcgcagcgaacactcctttctctttactaacgtctcttttcatctgtttcagtcactgctcaaaattccaaccgttaaaatccgcgacacaaaatcagtcgagcacaaagttgctgaaatttcaaggacaggttacgacaaactcattgtgagtcttacaattagtcagcttttctttgtaacgagctaaatttaggtaatctcagattttgactacactttgagtcgctatcacagaaatggcgaacattgcaagacaacgcatggaatatttagtggagtttgcgttaacgaaaagaatttggagttttatgagaaggcgcatgttttggaaacaaagtaaataaaaatgaaaattttatatttcttataaaattatgtttttttaaattaaggtataaacccattgagttctgtccaacaatgccaatgtgcgacaaaatgtttgtttatctgcctttttcattctgttaaaattttttgtttacttgtttcaaatgcggaattttcatttagtcctttcatggaattgtggtggaaggaatctcatcgactgattgttcaggttcttgcttttataattttttttttgttgtaatatgtagta

SEQ ID NO: 67324 - DNA, 1096 bp, Heterodera glycines
  Genomic contig location: Contig_ID=SeqID_8212; Location=239..1334; Strand=+
  SCN-specific regions: Sequence locations=190-460,519-567,849-968,991 -1096
atggccaatgtgcaccttatctccaatatgatgcaatttgatgaaaacgaagtgtgcatcggctttagagaaccgctcatccacactttcaacaagaaccaaactgtgatcaaacaggaggcgcccttcttccacaaattggcggaccgtaacgcagtgctgctattgggagacagtttgggaggtgggtgaacgaatagatgagcaggtcaacgctgggtaatagtgccgatgggaccccccccccccacctttttcgaaaaatgacttttttgattacggattgtattagggattttaagggtcggagaatccaatacaatctttgtaccagagccgcaaataggaatgaatttatagattcgtttattgtacaaaaaatcaatggatatttgtttaataggctgaatctctgataaaattcccttttactagtaaatgtttttcctttttaaattcaagatgttcgaatggatgttggtgttgaaaatgagtcggtggtactcaaaatcggatttgtaagtgctcattcaccgccacaacttttcatcccttttcttcgattagctcaactttgattccgacaatttgctcgaacggtatttggacgactatgacattgtgcttgttgatgaccaaactatggacgttccattattcattttggaacacatcaaacataaatcagcccattgaatttatcaacaaaacaatagccattttgttgttttcacagtctttggttttgactattagcacggattatttgccaaaatttctgtctatagtgaatgtttcttctgtttatcctttttattgtaaaatataaaatacattttatgtccttttgtctctttgcattttgtgttatttccatttgctaatttactcttaaaaatttttatcaaatttttatcgctcgcttttaatcattttgtgtagtaattatttgtaggcctttgcgatgaaagtcatcaacgagtttggctatcgtcaagatgcccgaacacccagccaaatccgcaacattgactatcaaatgggagtttactcacatgcagacggctccgcttacattgagcagggcgagacgaag

SEQ ID NO: 67325 - DNA, 528 bp, Heterodera glycines
  Genomic contig location: Contig_ID=SeqID_8213; Location=2512..3039; Strand=+
  SCN-specific regions: Sequence locations=1-263,285-528
atgtccgctattcaactttctcagctgttgaaagcgactagcaaccgcaaaattgagcaccccgtgttgatcaaccacatttgcaccgcactgaaagagtaaaaattcatttaaaacattcaaagaaaatcccccactaagtcaagaacgaatctcgtaatattaatatgttcaatgtgcccaattgaatcattttgggattgctactagtacaatataaaatgtgattgtgagagactttggatattgtctcaatgtctttcaaaaatgccctcctaaaatccgttcctccattcagccgtcctttgcctccgtctctccgccacatttgtcaaattgctttttacttgtccaaacattcgttcctcgataagccgcttctcaacagaatcaaagaggattttttggtttatgtccgaaatgaaatcatctcgaaaacatctttttcacacattgtgatcgccttcggtcttcccttttttctttctttttttattttcaaatttcagctttttttcgtctgactga

SEQ ID NO: 67326 - DNA, 591 bp, Heterodera glycines
  Genomic contig location: Contig_ID=SeqID_8214; Location=81..671; Strand=+
  SCN-specific regions: Sequence locations=1-136,158-173,195-591
tccttctcgttggtccgtgacattaaacgtggtgagcaaaagcatcacccattgttggaacgctttgaactgatgcttcgcttggtggttccgctcaattcccacagcactccccaggaatggtcagttccgccgatttttatttaaattgaactctatcaaaatttaggcataaaactggcgcttttctggaaggccgttgctttgtggacacggcacaacgccaactcatccctttgagagatgtcaacggaaatgcaaatgtccgtgaagttgcagtgattcttcttatggacagacacttcacccaacgcattggtccctccgagaagggccccgaccgaccgaccggcatcaatcagatgtgggaacatggcggactaagtcgggactggtgactctgtcccgttttcttccaggaacattcgtcatttaaaattggctgggatccatccgattgtattcaccgaacggcacttccgcaaactcggcgacgatgaacgatctcaaataaaatttattcgagagaagatcctttccttatcggaggaatttcacaccaacgaatggacggaagagaataacagttaa

SEQ ID NO: 67327 - DNA, 804 bp, Heterodera glycines
  misc_feature (792)..(792): n is a, c, g, or t
  Genomic contig location: Contig_ID=SeqID_38542; Location=6..809; Strand=-
  SCN-specific regions: Sequence locations=1-6,28-92,114-227,249 -348,370-518,566-804
atgtcaatttacaattttttcttgttgttttcgtcattgcttgttgttgttctgcagcaatgttcagcagcaaatgccacggacaaaaacaatgaagacaatgtcaccaaaggtgattaaaaaatattaattagtcagccaattgtgtgtctcattactacaataagaaatgggcaaaatatgttaggcatcgggtgggaatcgaaccccactgtcccggtttatctcatttgggcccaccatgtttttggctataatttttttctctgccaaccaaatccagccaatcttgcttggtatcattcgatagccctaaatgttatagcctcaaaagtttcggaaagcttgaacaaagatatggcaaaaatgttcgaacactgagttctttttttgaaaaaattcatctggtcatatctcccaaattttttaatttatggcaatatgctgatttttttgtgtgtatgactttttattcctttgaaccgtttgccccaaaaattccgctaaaattttctaaatttaaattttattgctttattttcatctgtaataaattcttcaaaatgatgatttttatatcctaaatgctaattttttgaaaatttaattttagcaatttcttccgacaaaattgtgccaaaatctgatgccattgtccactcggggcctgttgttgaaagtgcgtttgctgtcgataatttgtcggagccggtgaagaaatggacaaactggcgaaatgggaagaaattggaagtgaatgaggccatggaagtgccattggtgatcaacccnggatgggcgaat

SEQ ID NO: 67328 - DNA, 649 bp, Heterodera glycines
  Genomic contig location: Contig_ID=SeqID_38544; Location=185..833; Strand=+
  SCN-specific regions: Sequence locations=1-269,293-649
atgaggaccttttatgacaatttggaaggcgaagcgaagaaaggcgcaacgaagaaaatagtggaggaatgctacggatgggtggacgaagtggcgacggaggacgagcgaaacgcactgaagcaaatgcaccaccaaagccatgacgaatgcaaggccaaagtcagggaactgatgggacggctaagtgaggagagaagcgaacaagtggagaatcggatgggtttctgcgaacacgtctattacgggaagatggacggggaaggcgacggaggagcaggaacagctggagacgaacaccaccaccaccatcatcaccacaccaaaagacgggcaagcgatgggaaaagcggacaatgcccaaacaaaatagggaaaaagcggataaaggaaaaagcgaacaaacaaaaatatcggaaaagcggactaaagggaaaaagcggacaaaatgcccccacccccaatatagcacaataaacagcagtgaaaatggcagtttaaggctcacaggcaacgcagagaccaccaccaccaccaccatggcgaacatggacttgaggattatttcaaaacgcatttggcatggttaacggatgagcaaaaagcggaaataagcaggatgaaggagtcagggaaaagccgacaggaa

SEQ ID NO: 67329 - DNA, 54 bp, Heterodera glycines
  Genomic contig location: Contig_ID=SeqID_38545; Location=829..882; Strand=+
  SCN-specific regions: Sequence locations=1-54
atggcggtacgaaaacgtcctggcccgcaacattcactatgggtaccgaaacgg

SEQ ID NO: 67330 - DNA, 806 bp, Heterodera glycines
  Genomic contig location: Contig_ID=SeqID_38550; Location=223..1028; Strand=+
  SCN-specific regions: Sequence locations=1-806
atgggtacgcaagtgatgctgtccgcaatctggacgtcacccagggactgtgcaacggcacacggctgcaggtcatgcgcacttcggagaacaaaatcttctgccgaatcctcaccggaccacgagcgggtgcgcagaacatcatcgccatcccccgcatccaattcgagtatggccgcgcccgtcatcaccgtgggctacgattccgccgtctgcagttccccgtccgactttgctttgccatgacgatcaacaaggtgaaataacagaaattatatgcgagtacatacatatgctacaaaattttaaggcacaaggacagatgctgcagcggatggcgctcgtgctcaacggcagacaatgcttctcccatggccaagtgtacgtcgccatgtccagggtgacgcagatggacagtatcagagtgtacgcgccgttctgccaaagtgggtacgggacgcacatcgagaacgtggtttaccacgagctgctggacatggacaatgccgcacaaatgccgcaactgacgaggactccgacctttgggcgaccggacgtggacagtgacccggacgtgacaataccggacgtggacaacgaccggaactttacaatacctgacgtggtccccagagaaccggacatggaaatggacacaaacgtggctgaaccggacgtggcgatggaaaatgaagttgaagcgggtgcgatggaagaagtctcacctgatacttcatttgatgattttttggattgattttgttatttattttgctgctttatttgattaaacttttttaaattga

SEQ ID NO: 67331 - DNA, 785 bp, Heterodera glycines
  Genomic contig location: Contig_ID=SeqID_8215; Location=755..1539; Strand=-
  SCN-specific regions: Sequence locations=1-245,268-330,354-461,483-785
atgggccatatttttgggagaaagttcgaatgttttgaaaaaggcttaatctctctctctcctcctgggctttatctgactgacaaatctgtaaaaatccgcttgttcgtcgagagtgtaccaccgccagtcactgccagtctcgaagtccccattccccactttttttttgcttgtcgagaagcacaaatgatcaatttgctttatagatcacttttcagtatagccaaatgattgacaacagcaatgtttagcccccaaacatttgctttttctttaaatttttagtctttggtttacagtaaattagttgaagtaccgtttaaaaccatagaaaatcttcaaaactctttcaaatgtgaaaattatctagttaaaatccataatttaacaaaattttcatttaaaatttactgactcgtgaaataacaattcgatcaggggtctcagaaagtgatttaatcaaggatatttgttccacccactaaacttggattttatggaacgaatttactgactgttatttatttggacttaaaattctcaaaaatagtttcaaatttttgagaatttattaaagattcaatttttgaaaaaggctaaataaccatgaattctattcaaatccgatacttaatgattaaaattcatgggtgattttaaaatttaatggattttcaagcaaattaattttttttaatttccgacaaatttattatttttttacttcaattttttttgtatttaatcattcaaattcacagtcaatacacatatgaaataaa

SEQ ID NO: 67332 - DNA, 550 bp, Heterodera glycines
  Genomic contig location: Contig_ID=SeqID_8216; Location=1521..2070; Strand=+
  SCN-specific regions: Sequence locations=1-76,99-182,213-213,245 -337,359-527,549-550
atgaagcacaattaccatgatggcacttccaatgcgtacgcgtcatcccctgtgccgacaattagcacatgttcagcaccaccaccaccaccaccaccggcggtgccaatgtcgtacatgaacccgaaacagcataaacattatcaatgttatcagcagcaacaggaaccacttatgggtacaaaaaaaaataaatatttaaaattaaaaatgcactaaaatttttgtgcccaaattgtttcttgcttttcaagacaggctcaaacataagaaatgcccttgttttcaaggatgcccttgaaaaacgtagcattttttggccaaagctcgacacagattttggaaattaaaaaatgatttactgtattaaattaaagatggctacggttatgccgtcccagtggtgccaatgccaaacaatgatcataacaatatgaggagcttttgtgccgcattatgtcgttgccatttgaaaaatgtgagcatgttctgcattgcattcgtggaattttgcatttctggtcagttccagaaagcattcattcattga

SEQ ID NO: 67333 - DNA, 214 bp, Heterodera glycines
  Genomic contig location: Contig_ID=SeqID_8217; Location=290..503; Strand=-
  SCN-specific regions: Sequence locations=1-156,196-214
atggcacatttttttgaaattatgggttgggagaagtctaagacatcggtatttggtgtacaggcagttaagatgctagagtaagtaagacgcaaatttccaaggacgcccttgacatggatcaaggatgcagaattaagtacatatttggcgacgattaaaaaaaaattaagaaaaaataaacaaaaaaattttcagtgttaaaattttttga

SEQ ID NO: 67334 - DNA, 811 bp, Heterodera glycines; identical to SEQ ID NO: 38552
  Genomic contig location: Contig_ID=SeqID_38552; Location=1..811; Strand=+
  SCN-specific regions: Sequence locations=1-811
  Gene Ontology: Mol. function=adenylate cyclase activity; Cellular component=integral to membrane; Biological process=signal transduction

SEQ ID NO: 67335 - DNA, 549 bp, Heterodera glycines
  Genomic contig location: Contig_ID=SeqID_38554; Location=358..906; Strand=-
  SCN-specific regions: Sequence locations=1-259,281-549
attatgctctttcatcgtgtctttggcgctgcttttaaccattgcccagcaaaaggtctcttcaactcgtgtgcacattttcaccattacgctacccgtcgccgaattcctcgcccaaaatcattcgcggatttgtgatggttcaagacacctcaaacaaaaaaaggaaatttctttttgtcggtcgaatgtccaataaatagcttttcgtctgtcttcacaatgacttttcaaataaaaggggggggggaggggctaaaaattgactttgcccttctccccgtcccttaaacattcattcgtacgcctccgctttcgacatgatattccttccatccccttcagttccactcctttttgttttgcttgtgttaatttttgtttgttgtttggccactttttctttccatttcctttttttttacttttgtcgctgtccaatgagtggcaaataaatgcccttaaattattatttcttcatgggttctcacctctgtgtaccgtgtaccaatcattttgtttgtgtattttattaactcatcatctgtt

SEQ ID NO: 67336 - DNA, 293 bp, Heterodera glycines
  Genomic contig location: Contig_ID=SeqID_38557; Location=1..293; Strand=-
  SCN-specific regions: Sequence locations=1-293
atgagtgatctgactcatgacggtgtagagcgtttaccgctgcacacattcactgaaaacgcctatctgaactattccatgtacgtcatcatggatcgggcgttgccgtacattggcgacggtttgaagccggtacaacgccgcatcatctacgccatgtctgagctggggctgaacaacagcgccaaattcaagaaatccgcccgtaaaaggggcgacgtgctgggtaaataccacccgcacggcgtaggagggtgttatgaagcccatggtgctgatggcgcagccgttct

SEQ ID NO: 67337 - DNA, 674 bp, Heterodera glycines
  Genomic contig location: Contig_ID=SeqID_38559; Location=932..1605; Strand=-
  SCN-specific regions: Sequence locations=1-182,348-674
caccatggaacaacacaacatcaacgacaacggcggaagggacaaaagaaccaaatggaaaagaggagggactttctgctgaaaaggcaaaaacgaatcggtaacagttttaattagagttaagccccgagcccctcagcccccgacgatttagctcacctcgacccgacgatttagctcacctcgacccgacgatttagctcaccccgacccgacgatttagctcaccccgacccgacgatttagctcacctcgacccgacccccgacgatttagctcaccccgacccgacccccgacgatttagctcaccccgacccgacgatttagctcaccccgacccgaccccagacatgtgccccccgaaagtccccggccctcgacattttgccccccgaggggtcggggcttaaccctagttttaatgagcggcgggtcacatttttggaaaatagttttgaaattcttttgtgtcctttcagtgccgaaaatgcaactgaaaatgtgccaaatgtctcctcgactttcgcggttccctcgcggcattccgtccccgatttgccacctgcgtgcgctgaccacccgccgggactgatcggtcccattccggtgtggatggacgggccgggattcgagacggtgggaaatgatgagagacgttactcaaacaattaa

SEQ ID NO: 67338 - DNA, 551 bp, Heterodera glycines
  Genomic contig location: Contig_ID=SeqID_8218; Location=2703..3253; Strand=+
  SCN-specific regions: Sequence locations=1-64,87-166,190-421,443-551
atgaccgcctctttgcaacaaattcgagcccaacccggctggacggtttggacttttaacttacaaattctcattgttttcattagggttgcgaccccgacatcggggttggaaaattaggggttcggggtgaaaattccccgactaaatttgttggggttggctggagaaatttaaaaatgtcgggggctttcataaaaagtcggaaataggaaaaagaaaaagttcctgaacacaaaagtcataaaaactcaaaatcgggggcattggaaacgaaaatcataaaatgtttatttataaaaggagtaattatggctaaatgctgcaattttcaggcggacaaatgcaaagagcaaattgaggtggccaagagcgagaatcggacattccaacgccaaacgctgcaggcgcatctggtccatttgctgaacaaagagcacaaattcaacgaggccatccaattgggtacggacggacgtacgaaaaaccgaaatggatgcaaaatcatttttttggggattaaacaatttttcatcgaaattcccatttaa

SEQ ID NO: 67339 - DNA, 67 bp, Heterodera glycines
  Genomic contig location: Contig_ID=SeqID_8220; Location=1..67; Strand=+
  SCN-specific regions: Sequence locations=1-67
atcatgacgggcaaaacggcacaaaaatatgccaaacggagacggaggcaatgcacgccatcgcaga

SEQ ID NO: 67340 - DNA, 686 bp, Heterodera glycines
  Genomic contig location: Contig_ID=SeqID_38562; Location=280..965; Strand=+
  SCN-specific regions: Sequence locations=1-210,241-482,505-657,679-686
atgattgcttttctgttggacgataaaaatttctcgataatttgcgaggagctaaaattgcgcaaaatcgacacgacaaatctatgggatgtgctgttcgacatgatcattttggacgcgttcgaaggtaaatttgccgaattgggattgtttttcatggaacatttcaagagcggcgatcttttggaaaaatcgctaggaaaattttccaaaatttttttgaatatttataaaaaatttctgggtttttcattgaaaattttctaattgataattcgttcctgctctaattcatttatttctgtctgtgcctttttagacgtgcaaaaaccgccgtccgcaatcgccgcactgctcagaaacgggttcatctccacgtcaatgaaacagtcgacgctgaacagtttgatttggtcgatgatcaaaacgaagcgacagcgactgcaagtgaccgaaatttgaaaccaaaagttgacacacttttgcaaaatgaatttctcatcacaggtcaaaaacggattcatcgcccatttctatgacatttcccaagtgatcaccggctcactgaccatgggactgatcggcggaagtgacaaagagttccaggaactctgtgtgtactttaaggtcacttattagtaaaaagacattttcaacgacttacccaaatttatttggattaataa

SEQ ID NO: 67341 - DNA, 387 bp, Heterodera glycines
  Genomic contig location: Contig_ID=SeqID_38563; Location=9..395; Strand=+
  SCN-specific regions: Sequence locations=1-37,73-81,169-387
atgccgtggctaccgtttttgctgatcctgctgcccgccaacatcatgaccatggtgatgtatgcctttcgtgcggaacgcaaacacatttccgaaagcgaaacccactttcggaacgcgatggaatattccgctatcggtatggcgttagtgggcaccgagggacaatggctgcaaaccaacaaagcgctctgccagtttctcgggtacagtcaggaagagctgcgcggactcacctttcagcaactgacctggccggaggatctcaataaagatctccaacaggtggaaaagctgataagcggtgaaataaacacctattcaatggaaaaacgctactacaaccgcaatggcgatgttgtctgggcgttgcttgccgtctcactg

SEQ ID NO: 67342 - DNA, 384 bp, Heterodera glycines
  Genomic contig location: Contig_ID=SeqID_38566; Location=502..885; Strand=-
  SCN-specific regions: Sequence locations=1-384
atgagcgggaagcgcttgttcacaaacgtgctcaaatcggccgtcgggacagtaaatgaccgtccctgtattccacccgagggattaaatcgcgaaatgctcaaaagaagaccgactccagcgccagtgccgcagtttacgacacgcagcgcggagaggagccccgtgaggaagacatacgcgccgtttcggaaagggatgccactggaacgcgcggaggaagctatctacaaaatccgcaagtcactgctccaggccgcggacgcgctttcagagctcgccgacgaactgttcccgcacggagaagcgcgagagaaagatgaaggaaaggaggacgaagaggcgcagtggggaggaccgggcccctctcattcttttatgtag

SEQ ID NO: 67343 - DNA, 67 bp, Heterodera glycines
  Genomic contig location: Contig_ID=SeqID_38566; Location=1273..1339; Strand=-
  SCN-specific regions: Sequence locations=1-67
gagcattgaactcaaccaaatgcgagtggacgctgtgccggacttggcaaggttcacccaattacag

SEQ ID NO: 67344 - DNA, 66 bp, Heterodera glycines
  Genomic contig location: Contig_ID=SeqID_38567; Location=867..932; Strand=+
  SCN-specific regions: Sequence locations=1-66
tgtccgtttggggactcaacattatggggagcaaaaatccacgcagaattaaagtacagggtatag

SEQ ID NO: 67345 - DNA, 884 bp, Heterodera glycines
  Genomic contig location: Contig_ID=SeqID_38569; Location=1..884; Strand=-
  SCN-specific regions: Sequence locations=1-293,316-563,586-884
  Gene Ontology: Cellular component=integral to membrane
attcagtgggcctttctgttggcgagaagagcgcgggatcaagggatgatcgaaagtgacataatttacgtggatttactggaggaaagagaagcggcaaaagcgaatcaattgaattgttttcagaaaatacgccaatatcgggtgaatgtgctgacgctgacactgtacgattgggtgcccattccattggttggtgggcctttggcaaaatgccaatgatcaattgtatttgctcttttgttggcattgatcactgggttacgggtaaaaggccaagtgaccaattgtcgttgctcttttgtcccattggttggcgagttgtggtaaaatatattaagtatctaaatgatgtgtacgtgatgaactgtcttgttctcgttagcattgctaattgccttcgtctgatcattttgtccatttgtccccccctccccctcctctaaaaaggtgtacacccaagtggtcaatttggccgtccgtctttactttgtcatcgctctttttgccagacaatttctcaaagatttcggtggacggaatttgggagaccatcacttggtaattgaatattattttgtttcactttttgcttaatttcacagaaagtcgatataattgtgccgctgatgaccattttgcaattctttttttatatgggatggataaaagtggccgaagttttgctgaatccaatgggcacgcaaatcagctgaatgttcggaaggcaaagaaataattgtttaggtgaggacgatgacgacttcgagacgaattggatcatcgaccggaatttgcaatgcgggctaatgatagtggacgaatgctacgggagagagccaccaatggagagggaccaatttgggagcgaagcaatgcgccgg

SEQ ID NO: 67346 - DNA, 1119 bp, Heterodera glycines
  Genomic contig location: Contig_ID=SeqID_8221; Location=18..1136; Strand=-
  SCN-specific regions: Sequence locations=1-511,597-876,898-1119
atgctaattgcatttatgaaaaggaatcatgaaaccataattattgaatattcaatggaaaaatatgaggcatacctttgcattgtgtgttttatgcgaagaattggcaatgcaacaaaataagagagaaatttgaaaaatatgacaaagattgccgaaatattttggactttttgttctaatatttgagtcgagaagacgcaattctcacagttaagccaaacctcttatttaaacaatattatgcaattactgaaattggaatcgaagagctaaaaatttatgccataaaaaaatttcgtttaaattttaaaggaaataaaatttcataattttctgatgaattaattccgctccaagtagttatttttattgaaaatttaaaatcttcaccaattatttttttgcattaataaaaattatcaaatctgcataaaaatattaatcaaaatcttttttattgattttattatgaatgaaaattgatgaattatttgaaagaaaattcagcaaatttatataagaaaataataaagaaaaaattataatattcttaagaaaatggaattttataaattaaattttatgttattattcataatcaattcattaaacaaaactttatcagttaataatttttgtgaaaagaatggaaaacttctgcccatttttgctgaaatatttggccaaggatgggaaactgagcaaaatgcaaactgtcacccaaatgatcaaaatgatttaaatttggcacattcaaatcgcaatgttcagattgacaaatacaatgatcagcaaaaacttgaaattattcataaatttcatgcaataaaagaaggaattattaaaagacggaaattagagagaaaagttcggaataaaattgaacaaaaaatagccgaaaaattgggaatttgtcgaccgaaaatttataaatggaacaaagaatttgaatttgtttatgaaaataaattttataaacagaaaaagcaagaatttattgaacgaattgatgatttttggaagaatgtccaaaaatggaaaacagaaacaatttgcggaagagttgggcattgctggatatacattaataaaatggaaaagggaatttggcattga

SEQ ID NO: 67347 - DNA, 635 bp, Heterodera glycines
  misc_feature (538)..(538): n is a, c, g, or t
  Genomic contig location: Contig_ID=SeqID_8221; Location=1759..2393; Strand=+
  SCN-specific regions: Sequence locations=1-144,189-191,214-324,346 -450,530-635
atggcattcagtttggcaaaatgcgcatcaattctttgctgtgcagttttgctcgctgttatcatttgtttttccaacaaaaatttgtacaacatttgtataaatgcgatgattttaccgtataaacacagtaatttttcatgcaaaaatattaaaattaaataaaaaattattattatattatttatgaatgaatttttgtaacatgtttttcatttactattttaggactaaagcacagtttggcgatgtgcccaataaaataggagtcgaaagatcgccataatacgaatggtaggccggttttcgggatcgggttatggggatggtatgttggcatttggggtccgactaaaaagtcgagggtttcggggtgccaacacttatccaatgcttataaaattgcctctgtttctatattttccaactaacaaataagtttttttggctttgatttatttaattcttagttttttgtttaatatatttattttatagtcaattatttctgtgttcatttacttgtttaacatttctngtccgaacacagctctgagcaaatatttccaattctgaggaaattttggccaattaattgctcaagcaatttataagtgaattagaggtcatttgca

SEQ ID NO: 67348 - DNA, 930 bp, Heterodera glycines
  Genomic contig location: Contig_ID=SeqID_8222; Location=297..1226; Strand=+
  SCN-specific regions: Sequence locations=1-144,186-188,211-447,526 -669,691-711,733-836,859-930
atggcattcattttggcaaaatgcgcatcaattctttgctgtgcagttttgctcgctgttatcatttgtttttccaacaaaaatttgtacaacatttgtataaatgcgatgattttaccgtataaacacagtaatttttcatgcaaaaatattaaaattaaataaaaaattattatattatttatgaatgaatttttgtaacatgtttttcatttactattttaggactaaagcacagtttggcgatgtgcccaataaaataggagtcgaaagatcgccataatacgaatggtaggccggttttcgggatcgggttatggggatggtatgttgtcattcggggtccgactaaaaagtcgagggtttcggggtgccaacacttatccaatgcttataaaattgcctctgtttctatattttccaactaacaaataagtttttttggctttgatttatttaattcttagttttttgtttatatatttgttttatagtcaattatttctgtgttcatttacttgtttaacacttctgttccgaacacagctctgagcaaaatatttccaattctgaggaaatttttggccaattaattgctcaaagcaattataaagtgaaattaggaggtcatttgcatcagaagacggagtaatttctagcggattttctgttgtgaaaaaattttgcaaatttttttcaattccgtccaattttccttctaattttgagtcaatttccagcaaaatttcctgtaaatctttgatcaattcattgttcggcgtgtcaatttttgatcaaatttaatttcgtaaatttctaaattgtgaatttatacatttaaaaattattttgtattaatacctttatttgcaccatcaacagatttgaaacaattaaccgaagtaacacttttaagaaaatgaaaaagaa

SEQ ID NO: 67349 - DNA, 772 bp, Heterodera glycines
  Genomic contig location: Contig_ID=SeqID_8223; Location=130..901; Strand=-
  SCN-specific regions: Sequence locations=1-501,532-772
atggacgggattttaacgggagcgggatttttacggattcccgtacgggactcccgtcccggaaaattttgaactcccgccgatcccgttcccggaaattttttttaccggtctcaatttttcggtttatgttttttcgaaaatgaatttttgattttttggggccgggacttcggaattgtgacaagttttcgcaggatttctaaaccccaccttaattttaaccacaaaatttcagcgtgaattggtccgcggtcatttcacgcaggaaagaactgctcggattgaacaatactttggatgtggatttgtgttttatcagctaccccaagttgtaagtctgtgctattctaataacttaaaatggaattcctatcattaacaacactaaacttttttcagcaatgggacgccgccattgttacattttacggtcctctgtacaattgggacgaattaatgctgcatctttacgacgttttgacctcggcaagtttaaacaaattttaaaatcaaattttttttatatttcctcaaacttcagattgagcaggagaccgaaccaccgaacataacctctcccacgccgaactcttccccaaattccaatggacagaagacgccggaaaatgccgaatctccttcgggtgccgtcgcttctcccaatgctgccgacccatcttccaatgccaccaactcctcgagtgtcaccggctctccaaatgccggcgaatcttgttccaatgccgcgaactcggtaatacttttttga

SEQ ID NO: 67350 - DNA, 390 bp, Heterodera glycines
  Genomic contig location: Contig_ID=SeqID_38573; Location=413..802; Strand=-
  SCN-specific regions: Sequence locations=1-9,31-390
atgagcgacaaaaagaagcagaagaaatcatccaagaagcgtgacaagagcggcgaccgcaagaagtccagcaaagagcagccgagaacggatgcagaagtccagcagccgagaacggatgcagaagtccagcagccgagaacggaggcccctgaagtggtgaatggagcgacgccgagcacaggagttctcacggtctacgaagagccgccgagcacggcaggacagacgacggtctacgaagagccgccgagcacggcaggacagacgacggtctacgaagagccgccgagcacggcaggacagacgacggtctacgaagagccgccgagcacggcaggcggagatgcttcgaaaacgacgaagccaacgactggaagccagaactga

SEQ ID NO: 67351 - DNA, 56 bp, Heterodera glycines; identical to SEQ ID NO: 61815
  Genomic contig location: Contig_ID=SeqID_38575; Location=360..415; Strand=+
  SCN-specific regions: Sequence locations=1-56

SEQ ID NO: 67352 - DNA, 444 bp, Heterodera glycines
  Genomic contig location: Contig_ID=SeqID_38576; Location=214..657; Strand=-
  SCN-specific regions: Sequence locations=1-107,129-444
atgttgtccgaatttagcacactgatcacggcatttttggcacaattgtccactgaggagaaggacaaatgggcaccaaatgccctccggcaaacagttgaagcgttatcaaatgggaaaaatcagcaccaacttttgctggtgccaagcgattttgtggcatttttgctcaacaaaatcataacgagctttaccaacaaaaatggtggaactgtcgaaaaattttcaggaaattcggggaagaaaatttcggaaaattttgcccctccaccaacaagctcaagcagtagtcgccatgttcgccgccgctttcgccgtgatatgtcaccatctctgtggcttgccttggcatgtgcaatgactggttttgtgcacaactcaatgttgtataccatgatggcatacatactaattgttcaccatatccttttttatgatcactag

SEQ ID NO: 67353 - DNA, 764 bp, Heterodera glycines
  Genomic contig location: Contig_ID=SeqID_38577; Location=110..873; Strand=-
  SCN-specific regions: Sequence locations=1-148,184-567,592-764
ctactgattcgaactacgggaccctcaagaacttggacgccgacatcttcacgaagaacgcgccagcaaaaccggcagcggcaccaaaggcgggacaggcgccacatggaggaggcggaccggcacagacaccaagtgaaaaaatggcgaaattttaaaattttaattctttttcatccccttttcagcgactgattcgaactacgtgaccctcaagaacttggacgccgacatcttcacgaagaacgcgccagcaaaaccggcagctggaggagccgcgtcgcagaagtcagccgccggaggagccatgtcgcagaagtcagcggcaccggctggaggaacatcggcactgggcaccgcatcgcagaagaccgcagcggcaccggctggaggaacatcggcactgggcaccgcatcgcaaaatttgacatatgattttcctctggattacctgaacatgagttcgcagtggggaggcggacggctggtaaagccggcagcggcaccaaaggcgggacaggcaccacatggaggaggcggaccggcacagacaccaagtgaaaaaatgccgaaattttaaaattttaattcttcatcccctttcagctactgattcgaactacgggaccctcaagaacttggacgccgacatcttcacgaagaacgcgccagcaaaaccggcagcggcaccaaaggcgggacaggcgccacatggaggaggcggaccggcacagacaccaagtgaaaaaatggcgaaattttaa

SEQ ID NO: 67354 - DNA, 192 bp, Heterodera glycines
  Genomic contig location: Contig_ID=SeqID_38579; Location=354..545; Strand=+
  SCN-specific regions: Sequence locations=1-192
caaaaaggtggagaagcaaagggacagcgcgagagatccgtactgaagaagagaaagggaaaaacggacgagcagagaaagaagggacgaaagtgcggagaacagagaaccaattttgcccatttgggtgaagaagaaagtgtaaatcgtagtaacaaagcgaagaatggaaggaatgaattaatctgctga

SEQ ID NO: 67355 - DNA, 2176 bp, Heterodera glycines
  Genomic contig location: Contig_ID=SeqID_8224; Location=230..2405; Strand=+
  SCN-specific regions: Sequence locations=1-87,109-112,134-265,288 -354,376-505,589-756,805-1260,1286-1290,1312-1338,1361-1418,1440 -1530,1553-1620,1643-1742,1772-1882,1906-2176
  Gene Ontology: Mol. function=structural constituent of muscle; Cellular component=cytoskeleton; Biological process=striated muscle contraction
atggttttgcgtgtgatgtacgtgatcgaactgttggagacggaggagggcggcattgagctggtcgacccctcctggtgtaagcgattggcacaaataatggcggggctttcagtcgctgcgctcgccggcgacgacgagcggacgctgtcactgtcgcaggcaccgccgtgcgacgaaacgccgcggcacgggagacgaacgacgcccggcaccggcagtaccacgccgggcaaaacatagccaaacaattcaaaacatttcaaaattaaattgcttttaaatttgaacagcaataatttgccaggtcccgaagagggcccaccgcgcaagaaggtcaaatcgccgccggtcatctcccccaccggctcttccacgagtctttacagtggcggaagttcgtccatcgaatggacaacgaccggcacatcgttggaaatgcaggggacgagggtaaaaggaaggggagaaaagcataggaaaagcaatggcgaaaatgcaaaacaatttatataaaaaaatcctaaaaatttaataatttttaaaaataatattttggataaatgattagttttattttaataatatgttttagtaaattgatttgatttatcttttcatttgatttaattaatgaatttccattcttttatcctttaggtgacgcgcactcagtacggcttccgcactttgcaggagtcttccgccaaaatgtgccttaaagtgaccggctatcccttgcccgacatctcatggtaattaaaaataaattaatataaatatataattaaataagaaattaatgggcacaggtacaaagatgacgtacagctgaagaacgacgagcggcacactttttactcggacgaagaaggctttttcgcgctgaccatcgacccggtgcaggtgtgcagcaggggccaatcacaattacgaacgacaaacgacaaatttggcatttgtctccgaatttgtcattacgacaaaaattatgtcgtttatcgtcactttttttaaggattaatcaacatttctcaggaaaatgcaaaaaaaaaaaatggcaaaatggcaaaagagcctttctaggggtttttgggtatgtagattccgaatttaacagttattttgctctaattctaatcatgaacttaaattcaaaaaacccgaataaatggatgaaaaatcatagataaaaaaaatagaaatgaaaatctgagatcggattcatgatcagcgaactaatttaccactagaaacatgtttttaatattaaataaaaatttttgggtcaaaataatttggtgcatttttgggacacttctcagacgacaaatttgaggggcggtgttgagcgccccccaaatatttggcgtttgtcgttggtttcaatcataattacgaacgacaaacgacaaattttttaattgtgattggagataacgacaaacgacgtatattacgacagatttggcgtttatcgtttatcttttgtcgttcgtaattgtgattggcccgaggggaagagaaaggcacaaattaaacaggaaagaaatgccaaaattggatggcatttcgactgagttggacatcgcttaaatttcgattttcagactgaggacaccggacggtactcatgtgtggccacaaatgagtacggccaagcaagcacttccgctttctttcgagtgctcaaaggtgagcaacggcattttgagcaacgaatgtggagaaaaaatagcggcaattttaattataattgtaaaatttttaagttgaaaaggaatctgccggtccgtcctttgtcaaatcgttggcggaacggcgcaactgcaaagagggcgaagtgatcagcttcgagtgtgaggtgaacgagcaaaaagagaatataaattaataaaataaaatcaatgtgtcattttgacaaagcaatgactcataaaaaatcaataaataataacaaatcgattattgaataattgattgatcaacaatattaattgatcaggtggatggctggcccgagcccgagttggtttggctggtggacgaccagccgttgcgtccatcgcacgacttccgcatccaatacgacgggcaaatcgccaaactggaaattcgcgacgcacaaccggacgacagcggcacgtacacggtgaatatcgactttatcaattag

SEQ ID NO: 67356 - DNA, 969 bp, Heterodera glycines
  Genomic contig location: Contig_ID=SeqID_38583; Location=372..1340; Strand=-
  SCN-specific regions: Sequence locations=1-154,223-283,324-368,391 -405,427-460,524-755,907-969
atgttggctaacaaccgatcagcactgcttaatttgttgatcggtgtgttaattggatttgtgttgtcattagcgcttttcccatccactgattttccaagtgtcaaattgcctacatattccagaccagtggtgttgattaaggtggataaagaatatttttattataaataaaattttaaaaaacacaaaataatttataaaaaatagaaatttatatttgtatctaatagagatatgttttcttgtttctacctaatttttgggctattaacttttttttatttacatagaaaaaaacatttaaaaaataggaaattatagcaatgaacaaaaaaaaaattaatgataggaatatgaaagctatgcaaaacatattttgcaagtaaaattaagttattcatttgaaatgaatgaattattactttttcataatttcatttacattttctaaaatcggatttaatttattaattcaattaaaataaaatttaccaagaatattatttaatttattatttttctaaaggaagaccaacaaaaacagcgcaatgctaatgtgcagcaacagcaacgagatgagcttttaaataatcatgatcatgttgatgagcatagaaatgagcatcgtcgtcgatttgatccgcacacggaggaggaggtcgatgataatgatgatgagcatggagcggcacctggcataccgttgtttttccacacaaacggttcccatgttaatgaaggtaattagaaagttaattatatttttatttgaacaatttaattattaagtttttaaaaatattttaatttaagctaaaatttatttattttttcttaaacaattaatttaatttgttaaaatggtacatttttaaattaaaatttctatttttataattaaaactctgtatgccgcaggataaatttcgatttgctaattctgtcactttgaaaaagcataataaa

SEQ ID NO: 67357 - DNA, 353 bp, Heterodera glycines
  Genomic contig location: Contig_ID=SeqID_38587; Location=1070..1422; Strand=+
  SCN-specific regions: Sequence locations=66-66,98-104,133-302,326-353
atggttcgattagtctttcgcccctatacccaagtcagacgatcgatttgcacgtcagaatcgcttcggacttccaccagagtttcctctggcttcatcctgctcaggaatagttcaccatctttcgggtctcagcgcatactctctgtctccgccccatcgcatgcgatcgagacgggactatcttgctccccaacaccgcagtgtccagggatcacacatcagctccgtaagaagccttcactttcattgcgcctttgggttttgaacacccaatgacttgcgcatacgctaaactcctaggtccgtgtttcaagacgggtcgaacagatgaccggctatacaccgagaag

SEQ ID NO: 67358 - DNA, 697 bp, Heterodera glycines
  Genomic contig location: Contig_ID=SeqID_38588; Location=112..808; Strand=+
  SCN-specific regions: Sequence locations=1-391,417-697
atgaacccgaaaaggagccaaatggggacgaatcaaagcgtaaaatattaatgaacattaaacacataagtagagcaagcagtatggagatgaaaaccttcttgatttaaatgcagtaattcctgaacgaactttattaaaaatgggcatattgtaaaagaaaaagtaaattattagagacaggaaaattccaaatttgcgcatttcgctgcgaaaaattggagctcaaaaatttttgcaagacgtaactcccggagattaatcctgcaaaatcccgcgcgggatcccgtcccgcgccgctctcctctataaatgatgacaattcaaaaaagctacgaacggactccaaaattgtgaacctttgatttcatttgttcaaaaaagcaaagccaataataaaaaataataattaaaatccttaattgtcccgtactatcttgccaaaaaacccttttctttgtaggaactctcgtacttttggacggttgcatcaaaacagaaactgctcaaaattgtacagcaaatgtgcaaattgcatatgaacgtatcggcagctcgtttttctacggtaattgcgacgctgaaaagaaaacggtatttgagagcaggtgagcaatcagacgaaacatttaccataattgacttgttatttgctaattcacaaatgagaaagcttccctttttgttcagcacataa

SEQ ID NO: 67359 - DNA, 631 bp, Heterodera glycines
  Genomic contig location: Contig_ID=SeqID_38591; Location=164..794; Strand=+
  SCN-specific regions: Sequence locations=1-631
atggtcggtaaatgtcggtccacaattttctgctaaccaaattaaaagcatataagaacagggagggcttccatcgaaaaatatcagaacatcaagtccaacaaatcaattttggggtcgaaaatcatgatttccatatttggccatattttggcgttatgtccatatttttgcatttttccataaaaactctattagaacggcccccagcagttaaagtagcttttttgaccggaaaaatttccgaaagaatcatttgcaaattgaatccgcgacttttcgttatgttttgaaaaattatgtcaaaatccattgtttatcctctggggatggaaagggacacgccgacacatttttttttactcattttttctaacccaactcccaatcacttctgatgtgtaaaagtcccaaaaatccaaacaattaaaatatattcaaacaaaaaagcaacaaataaatgtgaggtatgcaattttcagatcaatttccattcataatgatcgatttatctttcatttcccaataatcgttcattttttcttccgctgtccaccaggcccgggattcattttcagacgaccaccttttgccttcattttgtccgtctttggtggagagaatcgcctaa

SEQ ID NO: 67360 - DNA, 1013 bp, Heterodera glycines
  Genomic contig location: Contig_ID=SeqID_8225; Location=77..1089; Strand=-
  SCN-specific regions: Sequence locations=1-174,200-236,259-272,294 -296,320-814,837-1013
  Gene Ontology: Mol. function=galactosyltransferase activity; Cellular component=integral to membrane; Biological process=sphingolipid biosynthesis
tcctcttccggacaacaactttggcgaagtgtccggcttcaccccggaacaatatcagcgggtcaacggctactccaatctgttctggggatggggtgacgaagatgttgacatgttcaacaggtaaattcgcaaagaatgacaaaagctttttatcacttttaatttttgcaactttataattccaaagtcaaaaaaccacatgggcttaaaaattagtcaaatttagcctttatgtttaattggtagcttaattatctttaaatataagtaagacatatttataatttattggctatttaaaataataataataattcgaactcgaaatcttgaaaaagccagggtcaggacccggatttccgagacggatacccggacagatttcggattaaatgcgggttctgttgcgttatattttcgttatatgttatttaattgaagaattctgagtgttggctacccggacgagcgtaaaagagagctgagtgcgcctgagttgggcttctacacaagccttgaactggccaaaggtgtcaacgacacaacaaacacaatcggaaagtcagtgatttggttaattgatattcataattgacgcaattatttttagcgaagagtgccggcaacgtttgctcgactcggcggtgaagcgaatgccgttggacggcctgaacacaatcaaaggcacatacaaagtggtgtccgtccaggagaacaaactgttcacaaacattgcggtaatgaataataagcgtgaccggtaaatgcgcttagaataagaagaagaggctttatttttgctttatcccttagttttttacaaaatcaaaactgttttgcattattaaaccatggactttcctcacagatcgaccttctgatggaggaatcgcgaaaacgggcagacgacccgtgcaaagatttgccagaccgcgcgaaaattgtggaaaaaacgttgtgcacaacgccaatgtgcattagcagacggagacgaaacgccaaaaaataaa

SEQ ID NO: 67361 - DNA, 787 bp, Heterodera glycines
  Genomic contig location: Contig_ID=SeqID_8226; Location=467..1253; Strand=-
  SCN-specific regions: Sequence locations=1-32,66-124,146-599,626-787
  Gene Ontology: Mol. function=beta-N-acetylglucosaminyl-glycopeptide beta-14-galactosyltransferase activity; Cellular component=integral to membrane; Biological process=development of secondary sexual characteristics
atgagatgtctccgaatgatttatttccttcgatttatttatttgtatttattttattttattatcttacaacaaatgaattcccattttcagaatgtttgttgaccattttgtcattattttggcacttttaatttgtccattttctgtcgctgaacctcttccgttatgccctgaagttccgcccacattaatcgggcgccaattgcccgacaaaaagatgcaaatgctggccgacactgaacgtgaacatcccgaaatggccaaaggcggggagtggaagccgcgcacatgcattgcacagcaaaaagtggccatcatgataccgtacaggtacagtacgacatacagcacgatgaaatgttcgttaaacgctacaaatggaaaaagacgaaaaaattagcaaaccggtacaaaacctttcttttttgcggatttttcggatataagtcagcgccaaaaccatcccaaaacaaaaaataattaaaaaacaaaaaagctaccgtatttcttctaatagagccccagagggggtcttttctaagcctcccagaggagtggtttaattgagggaggaggctataatagaagaaacacggtataatatttaaaaaattaaaattatgtgatactttcaggaatcgagccgagcatttgcgaggtctgctggccaatctgatcccgttcttacagcgtcagcaagctcatttccgtatttttgtggtggaacaggcgtttcccgttggaaagcgggtggacaagttcaacaaagctaaactgattaacg

SEQ ID NO: 67362 - DNA, 802 bp, Heterodera glycines
  Genomic contig location: Contig_ID=SeqID_8226; Location=3212..4013; Strand=-
  SCN-specific regions: Sequence locations=1-802
atgaccctgacagtgaaactgccagccgcttttctgtccgttttgggtccttcttttctttatctcatctttctttccacaaaattttgcgaattggctatttctgggctagtcaccctagtagtaacctagaaactgtcatgcgtgaaactaacattcaatgcatacgatcatagatttttataacttttatagagatctttgccaagtgtgggcagaaagacagcaagcagaagagcggctgagtggtcaaggccttgttgtggaaatcgatgaaagcaaattttttagagcaaaatataacagggggagaatgataaatagagcctacgattgggtttttggtctattagaaaggggcactaacaaagttagattcttcaacgtacagcgtagagatgccgacactctcctgcctataatagctgataacattgaagctaactcaattataataagtgacggatgggctgcttatggagggataaataacatgcaacagcaatacgaccatcgttgggtaaatcatcggatgtacttcgttgatcccaatgacccaagagtgcacactcaaggcattgaggcgacatggagagcactcaaaaatggattgcgacgcttgcacggaactaactctgacatgtttgttaccaacctatctttatcagtatatgttccgtcggttccatggaaatgaaaaaattttccaaaatattctggaagaaattcgataccaatatccactataattgtggctttacattgtgtatttcaattttaggctgacagtttgaaaaataaa

SEQ ID NO: 67363 - DNA, 299 bp, Heterodera glycines
  Genomic contig location: Contig_ID=SeqID_8226; Location=5006..5304; Strand=+
  SCN-specific regions: Sequence locations=1-299
atggccaaatcggcaggttagaaattttctaatcacaaaaaacaattcataatttaatgtttttaggtatgccaactgctgatcagaggaatcgccgtgtgttccgatcacttttttggatcatcgccgtgaatattggtggtattgtattcatacaatatgtaccgcactgatcagcccactgatcaaatcaccgatcaccacttggtttttcctatttgcttagaatggcacaaaataatgagaaaaaatacttatatgtaaaaaaaatcgggtactgaagtgtccacttcttttaa

SEQ ID NO: 67364 - DNA, 228 bp, Heterodera glycines; identical to SEQ ID NO: 66258
  Genomic contig location: Contig_ID=SeqID_38592; Location=213..440; Strand=+
  SCN-specific regions: Sequence locations=1-155,194-228

SEQ ID NO: 67365 - DNA, 258 bp, Heterodera glycines
  Genomic contig location: Contig_ID=SeqID_38592; Location=662..919; Strand=-
  SCN-specific regions: Sequence locations=1-258
gaacccattgtgcctgtgcccgaatttgttgtggatctctgcgattttgaggatttatatttggcggaatttgaggaccaacatcttgcattgatccgtctgagtgaaacaaattggcgtttgatcagccgtacaactgctactgctgatcaaaatgatgatccgaatagagatgaacatcaccaaaatagcggagaaggaccagcagaaaatggaagcgaaaaaacgctgatcgaaatcgggcgattttttagctaa

SEQ ID NO: 67366 - DNA, 464 bp, Heterodera glycines
  misc_feature (442)..(442): n is a, c, g, or t
  Genomic contig location: Contig_ID=SeqID_38593; Location=1..464; Strand=-
  SCN-specific regions: Sequence locations=1-176,198-464
ggaagtcgtcgttcaattggcccattctctgagtgcttttcaaaatgagaccgaccaaattttcaaaaaagctgcgctttggatggaaaaacgcacgcggagaatgaaacaattggacaagcgaatggaaatattggaaaggaaaatggaggcggtggaaaaggtgcaaaatttgggcatttttacaaattattacagtttaaccaaacaaaattattattgatcggatttgatttgttaatgcgtgcttttactcttctcagcttcccgaggtgcctctgctgaattgtgcctccaatttccccgagtttggcacccccggcggaattgtcgagccaatctttggccattccgcgccttttaatcgcagaagcggcgtccattttatggaacagaaatggaaaaaggagttcaattcgaatttgctgaatgaagccaatgnttcgacgccaaggattttttgg

SEQ ID NO: 67367 - DNA, 589 bp, Heterodera glycines
  Genomic contig location: Contig_ID=SeqID_38596; Location=102..690; Strand=-
  SCN-specific regions: Sequence locations=1-106,128-222,269-482,505-589
atgcccggtgagtgccggacgacagacaaacacaattttggtggcatgggggcatttctcttctcccagaaatggcatttcaaactttgaataccaaaatatgttgaattggaaaaggatagcacaataaaaatgaatgtattttttaaaattttaatgaaaaatctgagttttctaaattttaacaaaaaagtaaaaaaaaattctgtgaactctttttggaaaattaaaaaaaatattttcattggatttttatttatttatttttcgttttttcgccatgattttttacccttcaggcgcaccagtgactgttgcaagtgtgaacattgacacggacactttgctgcgcacgcggcacaccgacgccaaacattcaaaagacgacgaaaaccgggagaacgacggcaaatttgatgatgctaatgatgatggagaggacggggaggatcaacagaagggcggcgaagaaacagtggcaaaagagggggaggaagaagaggacaatgggatgggaattgaacgacggggacggcacaatgccaaagctgaaacaattggtggtgctcagctggcaccgatggtttcg

SEQ ID NO: 67368 - DNA, 700 bp, Heterodera glycines
  Genomic contig location: Contig_ID=SeqID_38600; Location=601..1300; Strand=-
  SCN-specific regions: Sequence locations=1-114,158-232,254-263,340 -361,397-467,523-614,637-700
atgtgcatttcattgactacgaatatgcgggccaaaactaccaactgttcgacattgcaaatcacttttgcgagtacgcaggttgtgcacacaaaatcgggtgcactacccccgaaattaaaaaaaaaattcttaattattgaaatttttttaaaaacttggagttttttataagaaaaaaaatttgaaaaaattatcacgattttttggaaaattttttgaaaaaacttactaattcattgtaaattttgataaatcacatgaaaaattttttaaaatttttttcttgaaattttcttataaaaaatatttctaagatttaaaaaaaaattatatttaggggggggggacgacccgggggaaatataatttttttttaatcatagaaatattttacggtgaggggctgggggaggagggaaacgaaatgccacaaaattcgagggcaaaacgccaaattgaaatcgaaaaattaaaaaataaataaaataaacttttttttaatcattttaatgaattaaacaattggttttcaggtgttgatgagtgtcccgattatggaatgaattcggctagtgaagacgaacgtcggcattttctgcgccgttattttgtccattttggccaaccaattggggaagagtgtgaaatggacaaaatgttgtgcaaaattcggcactttgaagcggtacattcataa

SEQ ID NO: 67369 - DNA, 156 bp, Heterodera glycines
  Genomic contig location: Contig_ID=SeqID_38600; Location=612..767; Strand=+
  SCN-specific regions: Sequence locations=1-53,76-156
ccgcttcaaagtgccgaattttgcacaacattttgtccatttcacactcttccccaattggttggccaaaatggacaaaataacggcgcagaaaatgccgacgttcgtcttcactagccgaattcattccataatcgggacactcatcaacacctg

SEQ ID NO: 67370 - DNA, 1396 bp, Heterodera glycines
  Genomic contig location: Contig_ID=SeqID_8227; Location=304..1699; Strand=+
  SCN-specific regions: Sequence locations=1-116,139-321,345-479,501 -591,613-1043,1067-1396
atggccaccgttttgcggtcgtccgctgaactctccgtcgagtcgattgtcgctttgttcaattgttacgtccattcggtaaatttttcactttgcgtttttcctatcgctcattcctctccattttgtttttctcttcagattttcacatttttttgctcggattttgatgcacagcaacaacagcaaatgttcggcaccaatttcgtcacttttcgcctccgccaatttgtgcaatcaatcgaaaagaaaatgaatggcccgggggcgacagagggtgggcaagacagtgtggaaaatgcggaggtgacagacacacagaaacaaaccaattattacaaatatggcacatgccaacgttttagctttcgttgttttgccgtcggtcgtcgctttgccacgcgttggacagaaacgactcggacaaattgtttttgctcgtcgaaagaattgttggcgttgagtcagtgtatgttttcctttctgttcttttgatttttatgcatcaaaatttggatgctttccgcagtgtttttctcgccaaacaaatggaattgcttcggcctttcctcgaggcgcttttgccaaaaagcggcggaggcagcgacagcaatttgtccttggactccttctatcgtgtttgtttgatttaaacgtttatactagagctcgattggacctggacccactcctgggtttttcctggacctggttttttgctcaagtccaacattgaatccaggtccaggcccattttatgccacaaatttgtttttcccccatatgcattttaccccattttcagtcccttgcggcggtgttcgatttgggcgacgcttcgtttggctgtgtggcggccaaaattatactctttcagtcaattctgaagcaaatttcggcgaccgattggacaaccggggaaatccattcgcaacattcgccttatgtggacacaattgtccaagtgaatggggaaaacagaggggggtgggggtgaatattggcaaaaaagcaaaggaaaaaatggccaaaataacaattgtcagccttttccataaggtgttttactggtgttcctttttaggaatgttcgcaattcaaacaaaagttcgtccgccttttcccctacgttcacatttccgacgaattgtacgccgccatttggtccatgcttttgctgtgcattttccgtattttggtccaggggtacgcggacgcccaatttgtttcagtggcaccattgacaaaaacgtaattttttaggtacgccgacgtaaaaaagtgcagcattgagggaagagcactgcaactgttggatgtcgagcaattatgtggggaattggaggagatcaccggactgaggcaatttcacaatcatccctttattttagtgtaa

SEQ ID NO: 67371 - DNA, 4055 bp, Heterodera glycines
  Genomic contig location: Contig_ID=SeqID_8227; Location=1242..5296; Strand=-
  SCN-specific regions: Sequence locations=1-264,288-819,841-915,939 -1231,1258-1258,1280-1306,1328-1509,1536-2328,2353-2680,2702 -3021,3045-3245,3269-3385,3407-3447,3470-3927,3951-4055
  Gene Ontology: Mol. function=protein binding; Cellular component =cytosol
aacgaatttgtcatcaattcggaagcgattaagcgcatattggacgacccgcgctacgctgacaaaaaggtccaaaatatttttcaattaaagtgactctgacttaatggaattttttcattaataatttatcccaacttttttttacaaattttggtaaaatgtcgatgagctctatttttcggcaaaaaatcattaaaaaggtgaaaactatatggctaaacacaaacatagcatttattttagccctattccgaatttcacttcttaaacttggaacaaatgccgaaaatatctatttacggataactcgataaatacaatctcaaatttggctgggattcggaacaggccaaatgaatgtcatattcgtttttgtttggttttttgccatataaatgtggttactatgttttccttttaggtgtgtgtagtcagcgtggcgggcgcctaccgcaccggaaaatcgtttattttaaacttttttctgcgttatttgcgttggcactcagcacctgttgctgacagaacagtagattggttggaaatggaatcgacgttggggggattcagttggcgaggcggcgacgaccgggacaccaacggaattctgatttggccagagcctttcctactcgaagaccgcaacggagagcaggttttggcaggaggggttagatttggcggaacaattcacgccccaatttaattccctagaaattcattggtctgtctttattatgatgatttttcaggttgttgtcctcctcatggacacacaaggcattttcgacatggatacgacggtcaaaaagtgctccaccgttttcgcgttgtccacgatggtttcctctgttcaggttttaaactgaaaagaatttttgaataaaatttaaggaattccatccgtttttccattcatttggttcccagattttcaacatcaacaagaacatccaggagaacgatctgcagcacttgcaactgttcacagagtacgcccgactggcgctggacgaggacaacaacagcaaaccgttccaggcaatgctcttttttgttggttgaccctttctctcatcaatttcagtcgcttttgttccttgtccgtgactggagtgtgcctgatgacgcggagtacggctcaatcggtggccaacgcattcttgacaaacgattgaaggtactcaatcagatgaatgtatcatgaatctcatgcataaattgaagattttcttatattcttccattccatctcaaaatttaaaatattttccattagctaggattcttcgtaaaatcaattcctgtgcccccatttattctcggcttatccattgatttgttaaatgtatttgtttttgccaggttacgcgccgtcaacacccggaacatcagcagctgcgccttcacattcgctcgtctttcgacaacattcgctgctttttgctgcctcaccccggccgcgaagttgccacaaacctgcactaccgaggcaaacttgacagtttgtttattgttttatctttttgtttgtccactgaattcaaagcatttcggttttccctttagaaatcgaccccgacttcaaggcacagctccgttcacttgcgaactatgtgttctaccccaacaatttggtcgtcaaacaaattggcggtcagcccatcacttgccgagagcttgccggctacataaatgtgccctttttcgcgtcaattaaaatatttaagttcaaatttcaggcttatttcgaggtgttcagcaaggctgaaatgcccaatccgcaaaccatttacgatgtaagtggaaagaacattcattcctgtgttgttattgacccgagtgattagtgaaaaggctaattaatgctttccctccttatgactgccaattgcttttgttttttttaggtcaccgctaagaccaatcattacgaggccgtggagagcgcaaaggcggtgtatatgagggagatggaagaagtgagtttttttgtagcatttgaatgattgttgagggcaaatcataccgaaaaagccaattatttttgacatgacattgggttcatgggttccatgcaataaattcacacaactcccccccccccccttcccacttattcgaactcaaacaaattcagtcgtgcggtggcgactcgccctttatgagcggcgcggaactgcgagcagagcacgagcggtgcaaggaacaggcgatgcgcatcttcaaaacggcgaagaaaatgggcggtcccgagttggcgaagcaattcgcacaaaaattgaagcaggacatcacggtgggctttcaaatttttccattgaaatattaaactgctaaaatttgcgctatttttgttaattcgctttctgtgactttcaggaggcatttgaatcgtttgagcatgcaaacaactcaaaaactgtacatcttgtgcgtacgcccgccgtgctcgtcgcttcgatgattgccctttactgctgttcgttttgctttccctgcgcagttgtttatgtccaaaattaattctcgtagattaatgaaatatttaaaattggtattccgaaggcccataagtttacattcactcctccactgattgggcctgaattcggtgaaatgcccatttttcaggtcaactatttttccaactgctcggcctcgacaccatcgcctccattttctccctcttcctcacgctgatttttgtcgcgcttggcatttggacatattcacgctacagcggccatttccgccatgcccaagtgttcatcgacggacgggtgcacgcgctgttgcacaatgtgttggcgccggcctttttcaaggccgttggtcgcttggcgctgaacatgacggtgattagccatattttgttttcttatattctctgaaccgttttttaggcgaaacgcaataataatttgaagcgaaaatgaacggacggcgaaagcgggtcaaagcaacgaaacttatttggaccgaccgtaacaatttatttgatgctcatttatcccataaataattgttggttgattctttcgttcgaatatatgtttgtttttgtgaggcaatttcgactaatacaaccattcgacaaatttaaatttaagcctttttttatcacaattaacaacattcaatatatacaaacaaaactgggatttgttagaattacaaaatgtgagtgttcttttgcgtgacttattaaatgcgaagatgaaagggattgaaatgatgtgaaattaaacaataaattggaattattcattggaaaagagagttgccgccttccccaattccgctcgcgtccaacagattggccatgatgcgcgacatggtcgcttttctggagttcgtcgcgacggaggacgagctgttcgccgccgccccagccgctgcatttaaaattgcgctcgtttggcttaggctgtactccttgaatttgttaagaatcccaattaaaatccctattttttctccactcactgtatgattcaccatccaattttgaagctctccaaacggcaaataaaatgctttgacgaaattttcgacgaacggtcggtggggaagaggcctaatttcgggaatttacactaaaataaagggatgattgtgaaattgcctcagtccggtgatctcctccaattccccacataattgctcgacatccaacagttgcagtgctcttccctcaatgctgcacttttttacgtcggcgtacctaaaaaattacgtttttgtcaatggtgccactgaaacaaattgggcgtccgcgtacccctggaccaaaatacggaaaatgcacagcaaaagcatggaccaaatggcggcgtacaattcgtcggaaatgtgaacgtaggggaaaaggcggacgaacttttgtttgaattgcgaacattcctaaaaaggaacaccagtaaaacaccttatggaaaaggctgacaattgttattttggccattttttcctttgcttttttgccaatattcacccccacccccctctgttttccccattcacttggacaattgtgtccacataaggcg

SEQ ID NO: 67372 - DNA, 387 bp, Heterodera glycines
  Genomic contig location: Contig_ID=SeqID_38603; Location=613..999; Strand=+
  SCN-specific regions: Sequence locations=1-163,186-387
  Gene Ontology: Cellular component=nucleolus; Biological process =protein biosynthesis
atgcgtcttgagaagtgttggttttgttcatcaacaatttatccgggccacggaattcaattcgtacgtaacgacgcaacggtgaaaacaatttattgatatagtacataataaattaaaatttttgtttaggttttcaagttttgtaggtcaaaatgcaacaaattatttaaaaagaagaagaacccgcgcaaattgaaatggacgaaggcatcgcggcgaattcggggaaaagttagtgtttgacttttgtttttactcttttacatttattgtaaatttaaatttcttttactctttaggaattggtcaacgatgttactcaagcgatggaaattcgcagaaacgaaccgacaaaatatgatagaaacctttgggaaactgcag

SEQ ID NO: 67373 - DNA, 268 bp, Heterodera glycines
  Genomic contig location: Contig_ID=SeqID_38605; Location=323..590; Strand=-
  SCN-specific regions: Sequence locations=1-172,220-268
atgagtttgctctattttcgcatttcccgagacctggacttcatgaaaatggtctataaggatgtgattgcttcaaattcatcaattgagcaattcatgggattttgtgaagaaatgcatgcgcaaggatttcataaacagccattggcaatttatcttcagcgatcggtggaaaaaaaaagaattaaaatattgaaaaaaaaattaaattattttttaggactattttgtacatatcaacaaggatggtgaatttcaactgaaacag

SEQ ID NO: 67374 - DNA, 595 bp, Heterodera glycines
  Genomic contig location: Contig_ID=SeqID_38608; Location=197..791; Strand=+
  SCN-specific regions: Sequence locations=1-595
atgagaaaatcctcgatgaatttgcttctgttaaatttggtaagagctctaaaaatatatcagtttttcaaatattgaaaaatctccgcatttatttggggtttttctcatatttttttttcttccacaaaatgccactgttgccaaaataatgacagtccctggactttgacttggaaattgtggcaccattcccttccccgccatccaacggtgctgcaatagacgtgccgaagaaaattttgaaattatagagatttgttaacagtttattacaataaaactggctaattttggagtttgaaaattacaaaagtttcctttttcccttaaaaactttctatctcccctatgggaccattagagagtgccaatcccaacaaaatgtttgaaataaatttcatacatatatttttaatttcaaggctttgtccgatctatgtctgctgtcaataaactcgctttatcttatgccaaaattgtttgaacgaccaattctgaagttttcactgatttattgccatttccatatttttatgaccggcgtttgtggcctggtctctattctgacttatatggccatctgtgtggaaag

SEQ ID NO: 67375 - DNA, 358 bp, Heterodera glycines
  Genomic contig location: Contig_ID=SeqID_38609; Location=2..359; Strand=-
  SCN-specific regions: Sequence locations=1-81,120-337
atgtcaagagttgctcggaaggatgaagtgccaatcaaaattttgaaaagggtccaatggcctcgggaattatacctgcggtaaataataaaaataaatattaaatttaaaattaattaccataatggacatattacgccaactaaacggtccaatccgatgcataattgcagaataacggcaaatgaagtgccaaaaatgggcacaaattggatgaaaaagcaagaccgaagcgtgatgtaattgatgccaaaaaggaaaatgaagaatttgacggaatatccgatcagcaaaaatgaggagaagaaagcgaacaaggcgatcagaatattacatggcaaatttaaaaataattaaa

SEQ ID NO: 67376 - DNA, 634 bp, Heterodera glycines
  misc_feature (603)..(603): n is a, c, g, or t
  Genomic contig location: Contig_ID=SeqID_38609; Location=803..1436; Strand=+
  SCN-specific regions: Sequence locations=1-150,240-545,567-579,603-634
atgtgcacgcttagcgacccgacaaatcaaccagaaatttttttgctgctaagcaccgcttcgttggttttatattgtggcgaattcgagtgctatgcccttatttggctgctaacttggtggagaaattcgcagagtgagaaaattattatttaatttaatttttattttaaatttaaattttttcattagtttttgaaaaatataatttaatttaatttttattttaaattttaattagtttctgaaaatggccgacgattgatggtttcgttgagtgtgatcatgtcaatgggatttgtatgtgacattggagtaagcacatttgaataatttattcgggatttatacatcaaaaaaatttggaaacacatttttaattctggtttttttcgaatttcaattcatttttgagaaatcgcacagattcctacttttaaattttcgaatttgaacaaaatgaactttttcatttccgatgtcatttggtacaaatacgattcatgaaaaaaaaaatcttgcaaccctgtacaagatcttacaaaattttaaaaatctttataggacaggtcctgaataatatatatatatatatatatatantttttttttatagctgtaaaaaggtataaaa

SEQ ID NO: 67377 - DNA, 57 bp, Heterodera glycines
  Genomic contig location: Contig_ID=SeqID_38611; Location=33..89; Strand=+
  SCN-specific regions: Sequence locations=1-57
gctatctatgaagctattcccgaaggattcggtctccccataaatctgggcgcatcg

SEQ ID NO: 67378 - DNA, 1032 bp, Heterodera glycines
  Genomic contig location: Contig_ID=SeqID_8228; Location=137..1168; Strand=-
  SCN-specific regions: Sequence locations=1-352,374-385,408-1032
atggacgaccagcggatgcccgtctctgccgcgttcagtgtgccccaaattgcgaccgctttgggtgtgttttttaaatcgttatttttcaattttcaaaaagttggccaaacatatttttaaaattcgggaactttttcaccggtagatgggccaaagaaacagaaattgcatgacatatttatgttagtaatatgcatttttttcacagtttcacgccaaatcaacgaaaattcgcgcttctaccgtctgttggacacgctgctgaacacattgagagagtgcatcatacaggacgacggaaatgcgggtgattattccattccttattttagactccctaatttttgtgtgtgttcaatattttggtaatgcaagatttggattaataaataaatattttgaatgaccaaaatgttttcagccgatctgaccaatcctgaccatgttggcaacgaggcgttgaaggactttgaccatccgatgcatggcgagcgcattcggcagatcaatcgcgaatgccagcgccaattcaaattgcacggtttgttagcatagttttttatttcttggtaaatttttcacaaaatccccaaacagatttttttttctcgacaaattatattaaccaattgtcatcaaatacataattgtgaagcacttaagaaattggaaatcagaaaattataagcgatttgggtctcaaaaattgttttttaaaacgaaaaatttctaaaaacattgccgttgttatttcttaaaaaacaaggtcaggtgccagtgtgtgggagttgagccgcgactatttggacctgagcgaagtggtccgacttttgctgctcaccgccggcttctacacaaagtgccggcgccaaatgcgcggccaaatgcactgctatgaggacgacgggttcatttttgcacaacaacatcccgaacttgttgaacatttggaaaaggtcctcccaatgggaattcaaaatttaacttttcatttccataaacatatggcatttcgaggtccaaaataaa

SEQ ID NO: 67379 - DNA, 1160 bp, Heterodera glycines
  Genomic contig location: Contig_ID=SeqID_38614; Location=343..1502; Strand=-
  SCN-specific regions: Sequence locations=1-33,55-156,182-203,225 -226,248-345,367-590,612-746,774-1112,1136-1160
  Gene Ontology: Mol. function=DNA topoisomerase type I activity; Cellular component=chromatin; Biological process=chromatin assembly/disassembly
atgagcaccagcaaaatggtgggaacaatgttcctgcaccaaaaggagggacaaagtgaggggaccgacttgggacaatgttccatggggcgaacggatacgcgacacccacggggaaaacggtaacgaacattttgagcgcttttttatatattagaagaaatgcctttttatggtaacatcatttgaaaacaaaccaatttaagaaaagaagaaaccagcaatgagaagaaaaaggggaaaaaagctgaggaagttatgccgaaaaagtcaaaggaatcgacctcaaaaagtcgaaaaaagaacgaaagcagcggagaggaagaagactttgacgacgactccgacggggaagaggaggaatatcagccaaaggtaaggcgaagagaaggaaaacggatgaaaaaggatgacatacttcagaaaaagaaacaaaagtcggacccatccccggcgaagaaaagcgacagcaaaaagtcaacgaaaacaacaaaagttaccaaggtggaggtcaaggaagagagcggcgctggggttgagcacaagaaacggaagacaacgaaagttgaagtgaaggaagaggtcagtcggaagaagaagcgaagggaaacaatgggagggaagggacactaaaatggaagagaaaaagcattctaatttccctggaatattatatatttaaccttggtatttttggacatttccagccctcctcttcccagggaagtccgtccaagaaacgtgtgaagaaacaggaggaagaagaggaagtgtggcgctggtgggaggaggacgagtcgaacgcgggcgcctccgatgggtccatcaaatggcaaacgcttgtccacaaagggcccgtctttgcaccggcctatgtgccattgccaaaacacatcaagttcaaatacgacggaaaggtatggtggaattacaacttttaaaaccaaaaattgatatgggagttttttaaggagatggatttgtctttgccggccgaagaagtggcttccttttacgcgaaaatgctcgaccacgactacacgtcaaaaccggtgttcaaccagaactttttcaaggattgggtcaaagtgatgacaaaggcggagcgagccgaaattaaagatttggccaaatgcgattttaggtaaacaaaaaataaa

SEQ ID NO: 67380 - DNA, 748 bp, Heterodera glycines
  Genomic contig location: Contig_ID=SeqID_38618; Location=758..1505; Strand=+
  SCN-specific regions: Sequence locations=1-6,28-244,272-561,584-748
atgtccaaccaaggaggtaaaaaacaaccaacggattcgttaattagggcgaagtaccgtaagcctatcgtaggccatttccagcggatgcatttctgttccttcaattctaagcttaccaatccgttaatcgttcttcagctgatcccattgtcgtagctttgctggccaattcatcttcatcccctcccactgagtcgccttcatctgctgacattcgtccgacttcgcttggtcaattgcttctcccctcctcttcccctcccccttcgtcctctgttgctccaatcactgatcagtcgcccactgtccctggcaaaggcactcctccgaccattcgagtggacaacggtttgtccacttaattgggcgtcattcatcctaattcgttccctccccccccccaggctgcttcatcactttccaagcggaatcccttgcgcaacggccctcccatttcaaggctccgttcgagctgaaattggatgtcgagtcggtcgaagtgtgtgccatccgctgcttccaggcactgtccatggctttcccgttaattgctgttaatgaatgcccctttttccaggacgggtgcacaagtgcgctgttccatcgcgagtcgcgcagctgcgagttgagctacgacgacaaacacttctgctccaatgcgccgatcataagcaaattcgcccacttggccaatctgagcgacgtgaatccctggtggattcactgcgtcaattgtcggcccgaa

SEQ ID NO: 67381 - DNA, 55 bp, Heterodera glycines
  Genomic contig location: Contig_ID=SeqID_38619; Location=724..778; Strand=+
  SCN-specific regions: Sequence locations=1-55
atggaaaatgcaccggaagtgaaaagccaaacgacggagacagaaaagggaacgg

SEQ ID NO: 67382 - DNA, 1114 bp, Heterodera glycines
  Genomic contig location: Contig_ID=SeqID_38628; Location=249..1362; Strand=-
  SCN-specific regions: Sequence locations=1-23,45-623,645-683,706-1114
tttggagcataatccgtacttgacagcagccgaaagagaggcaattggcaatcggaaggaggaattgagacagctcagtttgagtgtcaaaaggaatattctcgtcgatttggacatttctaccggagcaatgcatcagcaaaaggcaatgccattgtctgttttggttgaacggcatttatttagcaaaaacccatcgaaacggtggacgaccccatcctccaggcgattctcctcaattcggcggcgcggaatttacaccaaaacactgatgaggacagcaaagagcagaaaggggaggagcacgcttcactgattgacaactttttacccagggcgtaaaattgacttgagaatcagaaattgcatctcaccccccccccccccccccaacagtacgaggacagtaagggcagtactgaagtgtcgggggtggcagcagaacaattgggcaaaccgtcgcgacaaaaactcttgtgtgtggcactgaaacagcctttcgctgggcgtttgttgtcgttggctttgtcctcaaaagactccctttggtcgtgggattctctcttcataaaccaaataatgggttttattgcagtgcaattccttggcttcaaagtgtgcaacacaaagggccgcttctcatcgccgcattggaagacgacgcgcccattgaatattttaatggagaggacacacaaaagagcgaaggtgtgtccgaaggggtggccaaacgcatgggaaataattgcagcaacgggggaaggggacggcgtttcatgccaacggagaaacgtaattcttgccaaagcgactctcgtcgattgcatcacttggacagaattcagccgagaggtgtttgtttgcccgcatcggaaatgaattcctctgctaaatccccttccccccgtttcagtactctgctgaacggactctcttccgtccattacaaaatgccttcgtcctccttgttgcggatgccgaggccttgtcaccgccaatcccccacaaatgcccgtccgaattttttgaggtcggccgatcattggtgaacgcggtcaatttagcacttgtgaacggaggagggatatatgaagaaacattgacaacattctga

SEQ ID NO: 67383 - DNA, 631 bp, Heterodera glycines
  misc_feature (541)..(541): n is a, c, g, or t
  Genomic contig location: Contig_ID=SeqID_38631; Location=76..706; Strand=-
  SCN-specific regions: Sequence locations=1-270,292-588,610-631
atggttgagatgggaaccgaaattcaaacatcacgaaatgaacttaaggcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcgctcggtgagcatattaaacgtaaagatattgaaaatatacaagtatctgaagctgagaaaggaccacaaaaaagagaaagactagccaatgaggatgttcaatttcaatatgacagcattgatcaaaaatttattgtctatctttccgctgctgtctcccacatagatttgtcaaaacacctcgcctatgtgctcggttttaagaacacaaggctatttcatgcggaagaagcgaattatatgccagatttgactggcggcgtaaggcagctatacatttatgcaccanatttaatcgaaaacacaattatcggcaaccagatggccccactcttaagaatagttaacgtcgtcgatgacccaggatcgattagtgaaa

SEQ ID NO: 67384 - DNA, 1056 bp, Heterodera glycines
  Genomic contig location: Contig_ID=SeqID_8234; Location=1140..2195; Strand=-
  SCN-specific regions: Sequence locations=1-257,279-332,370-903,975 -1007,1041-1056
atgccatttcatcaacaaacgcaacacacagcaaaatgcaaatggaaatgccacaactgcctgcgtgttgggtctgcctttcgaggaaactgcgtccaaggcaatgacaacttttttgagacctgcttggggtgcaataaagtaaagttatttgagtttcgtttcaaagaatttttttgtttagacatttaaaagtcgtgaatgctatgaacaccatgccaaatgtacaaactacagggtcaagcgtgacaacgaacatgaaattgtgggaaaatcaatttgtaaaagctcgaagaaatgcgtcgactgtggcgtgatttaccaaattcgggttattataaaataaaatttttttattttattaattttctctttagcatcaccaacaaaaagagcatgtttgcggtcaaaaattctgcaaaatttgtctcggcttccatgccccgcgagactgctacataccataccggcctaaagtcaagaaggagaagcgcttcgtcttctttgactttgagtgcactacggatttcaagcccgacccgcaactcatgcggttcaagcaccaggtaattatttttttgaattcaaacacaatttaaaaaaaaaaacaaaggtcaacttctgcttcgcccatgtgacatgcacccgctgcattgagaagggcatttgggaccaggagctggagcgggcctgcgctctctgcggccgattccgaacttatgcctggtctccgtttgagttctggcacacggacgtggaatgccgcaaggtcgtcgaggacccactggctaccttcaccaagtggttgctgaactttgaaacggaagtcctcggcatggagcccggagcgaagaagcgcagaaagaggaaaaacatatcacattctattgtaatattgaaatcaataaaaataatttttttatattgtaattcaataacataaatgttcctttttataatttttaatttatttaccacttgatgatcatgttaatagattgaaattgtatataattttttttaatttaaaatgaattaaagcttcttaataataaa

SEQ ID NO: 67385 - DNA, 704 bp, Heterodera glycines
  Genomic contig location: Contig_ID=SeqID_38632; Location=3..706; Strand=+
  SCN-specific regions: Sequence locations=1-99,354-419,684-704
  Gene Ontology: Mol. function=DNA binding; Cellular component=nucleus; Biological process=regulation of transcription, DNA-dependent
tggaagaggatcagtcagtggaagagaaagtggaagaggatcatcaaagtgtaagtgatactgcaagtggaagagagactggaagaggttcagaaagtggaagaagaagcggcagtggaagagaaagtggaagaggaatagaaagtggaagagaaagtggatgtggaagagaaagtggaagagaaatagaaagtggaagagaaagtggaagagaaagtggaagaggaacagaaagcggaagtggaagagaaagtgaaagaggaagagaaagtggaagagaaagtggaagaggaacagaaagtggaagagaaagtggaagagaaagtggaagaggaacagaaagtggaagagaaagtggaagaggaacagaaagtggaagaggaatagaaagtggaacagaaagtggaagagaaagtggaagaggaacagaaagtggaagagaaagtggaagaggaacagaaagtggaagagaaagtggaagaggaacagaaagtggaagaggaatagaagaggaacagaaagtggaagagaaagtgaaagaggaacagaaagtggaagagaaagtggaagaggaacagaaagtggaagagaaagtggaagaggatcagaaagtggaagagaaacagaaagtggaagagaaactggaagaggaacagaaagtggaagaagaagtggaagaggaacagaaagtggaagaggaatag

SEQ ID NO: 67386 - DNA, 396 bp, Heterodera glycines
  Genomic contig location: Contig_ID=SeqID_38633; Location=187..582; Strand=-
  SCN-specific regions: Sequence locations=1-41,63-396
atgttcccaaataagcgcaaatgttctttcaatcccgattgggaaaagcaatatacttttgtcaaaagaagccgaaaagggaatggatttttttattgtgctttttgccaaaaagacatcaatgtcgagtcgatgggagtttcggccataaagtcgcacacggaaaacaaagaacataagcaaattaaagaggaacggcgtaaaagcacaacaattgagaattttgttcgatccaaatcgacgcttaattcaattgaccttcaagttgcaacggctgagggtcatttttaatcttttttaagtgtaaaaatttgtttttaggcacttttgcttaccatgtgtgtaatcatcatcaatcgtttgcgtcaactgattgttcatcaacgtgttaataaa

SEQ ID NO: 67387 - DNA, 510 bp, Heterodera glycines
  Genomic contig location: Contig_ID=SeqID_38637; Location=78..587; Strand=-
  SCN-specific regions: Sequence locations=1-124,153-161,183-255,284 -432,454-510
caagttttttacaaccacttattgccaatttaatttcttgcagatttaaagccatccattgcctgccggttctcggcacagcaaagcactaatagggtgtttgactcacttcaaaaaataattcattacccaaaagttttttacaaccacttattgccaatctaatttcttgcagattgaaagctatccattgcctgccggtctcggcacagcaaagcactaatagggtgtttgactttcttcaaaaaataattcattacccaaaagttttttacaaccacttattgccaatctaatttcttgtagatttaaagctatccattgcctgccggttctcggcacagcaaagcactaatgcactaatacggtgtttgactcacttcaaaaaataattccatacccaaaagttttttacaaccacatattgccaatctaatttcttgcagattgaaagctatccattgcctgccggttctcggcacagcaaagcactaatacggtgtttgactc

SEQ ID NO: 67388 - DNA, 308 bp, Heterodera glycines
  Genomic contig location: Contig_ID=SeqID_38638; Location=1..308; Strand=-
  SCN-specific regions: Sequence locations=1-212,234-308
  Gene Ontology: Mol. function=ATPase activity; Cellular component =cytoplasm; Biological process=synaptic vesicle priming
aggtcccccaaatactggcaagtcttatttggctgcacaaattgccaaggactcggaatttccattcatcaaagtttgtactcccgaagaaatggttgggtacagcgagacggcaaaatgtgccaaaattcggaaggtgagtgtgacaattagcatagagaactaaataaccagtgtcaggttttcgaagacgcgtacaaatcgccccttagctgtgtgatcatcgacaacatcgagcgaatgatggattattccccgattgggccacgttattcgaactttgtgttgcaaacactccttgtactgct

SEQ ID NO: 67389 - DNA, 703 bp, Heterodera glycines
  Genomic contig location: Contig_ID=SeqID_38639; Location=1..703; Strand=-
  SCN-specific regions: Sequence locations=1-156,178-703
  Gene Ontology: Mol. function=calcium-release channel activity; Cellular component=integral to plasma membrane; Biological process =calcium ion transport
aacgatgcggggggggggggagagagctgctcctataattgaatctctaaaggttcttccgctgatgtttgcttatttcaacgcacacaagcagtatttcatggccagcagttccatcgttcagacggggacagcctcaaacaaagaaaaggaaatggtggccaggtgagagggggcaaatgggcaaatcattttttggctaacttttgcccccgggcaaatgactctttccgcccgattgtcccccgctgcttcctctgttttggcatttccctctccatcaatttcagtctgttctgtcgtttggctgcccttcttcgcatcaaaaaccacgccttcggcagtgttgccaaaatcaccgtccgatgcctccagggactgacccaggcactcgacattcgaactttggtcaaaaccaattcggacatcgttcgcaccggtgccattctttgcctttcctttcctcaaaaccctctctctgctgcataggattgctcatcttcttctccaattgtgccgatgacctttttttggctgtcaacgaactcaaagagggcggacagtactctttgcttcggggcgaaaatttgaagttttcgtcattttttccttcttttggcattccgttgcttgctaaggtcgggggtatcgatggaattcgccttccaaatgatcattccccgtcctgagtaccgttttttct

SEQ ID NO: 67390 - DNA, 674 bp, Heterodera glycines
  Genomic contig location: Contig_ID=SeqID_38640; Location=273..946; Strand=-
  SCN-specific regions: Sequence locations=1-238,260-264,286-521,543-674
atggcatcggcacagaacagtggccatgccgttgacccgtccactgtcagtgccgatttaaacgacatttgtggggacaccgacggaatggcaaatgaagaagaggcggacgacgctattgtgaaggaaattgtgacggcattgttgtcgggcggaccgttcccagcagcggaagagaacgacgagcaaagccaagccatggagcagcaacagaccaatgggacagcgatggatggtcagagtttgttcaccaaaatggtgtcaattgaaatagtttttaaaaaatagaatttggttggtcggcttgcctaagtttatgtgttcagatgcttctttttcatctgggctctctcctcttgcgtccgatgctcatcaaccagtgctatttgcctcatttttcgagttaatttttttttgcaattcgttttacaccgaattagccgacaattaccgagtgatttggtcaattttcaggtcccaacttggtggaaaaaagttggagtgcggtggccatttgtatcgacggagtcggcaccggggcgacagcatttattggcgctgtgaccaaaaccggcgctaccgctgtgccggttcggcgcggacagtgggcgaagcggagggcaccgaggttggcacaaatccgcaaagcaacaacttggcactcccctccataa

SEQ ID NO: 67391 - DNA, 904 bp, Heterodera glycines
  Genomic contig location: Contig_ID=SeqID_38641; Location=298..1201; Strand=-
  SCN-specific regions: Sequence locations=1-4,135-155,181-306,432 -496,518-729,751-763,785-820,842-859,881-904
  Gene Ontology: Biological process=N-linked glycosylation
atgcaaaagaaaaggcgaaagaagcagaaaaagaagcatcactcggaaaaggagttggagaaaagagtggcaaatggacaaaaaggagagaacgaaggcagaaaagaagaaaacgaaggcagaaaagaagaggagtttaaaatggcaaagggaacggaggaggaggaggaggaggaagagagacgaagtggcacttactcatcctcggggggggaagtgtatctgaacgaacgggaggaggaggaactgctgatggtcatggagcaggggctggacagaaggctgggcaaagagaggggccaagtcggggaggggaaggacaagcagcagcagcagaacggtgacaaggagcacaaggaggaggaggaggaacagaagcagcaggtgggccatggaatgggggggggggggggaaatgggacgaggggaggcgcagagccattcattggcattaccaaaggtgcgcaagcgcgagagtcttgactcacagagccgaaaagtagtttaatttgattttacgcattttttaaattggagaaatattttaggtcttaaaataatggacaatgaatgaataatttcatttactaattagccaacagatttacaagggatttttaacagatcacaacacaaaatgatcaaacagcggaaataatctcctcaaatcattcgcagacgccgaaatcgccaaattatcattcccaacaaacacaggaataattagcggaaaaatgtaaaagaaaagctgtgcgatgattaagggaattgtgaaagaaaaacgttttattccgtaatgagtcatttgggcgaaaaattgagtttatttttgtattgttttggatcaaaaaaatttatatgaaaacaaacaaaggaaaaattcgtaaaaaaagacggaaataaa

SEQ ID NO: 67392 - DNA, 450 bp, Heterodera glycines
  Genomic contig location: Contig_ID=SeqID_8235; Location=840..1289; Strand=+
  SCN-specific regions: Sequence locations=1-72,96-450
atgaatggaatcactgctggggattatggtgcgattggcggcacatatttttggttagagtcagcaagcagcttattttggagcaaattaaaaaagcttaacccgattttctattatttttttttgataaagatttgtttcctaaactttgtctgtgacatgcgaaaacaatttttagaaacaattttttcatcaaataaaaaattcaagaaaccaactttgtattttattaccaaaactctatataaaagccaggaagaaaactgtttgcttgctttggaatggccgaacaaatgacaaattaattaaaatttgcgttttttaattaattgttagtaattactaatcagtagggcgtccaaaaatatggatataaaatcgcgaaatatggccataaaatatggacaacgaatcgcaaaatatggacataaaattgcaatatggacataa

SEQ ID NO: 67393 - DNA, 2089 bp, Heterodera glycines
  Genomic contig location: Contig_ID=SeqID_8235; Location=1359..3447; Strand=+
  SCN-specific regions: Sequence locations=1-158,180-438,460-1090,1113 -1200,1222-1340,1362-1507,1529-2017,2039-2060,2082-2089
atgcaacaacccaatcttttaaaaattcatggttcactccagcaaaaattatcagcaaaacgtactgcggcacacttgacaacatcgcctctctcaacaattccatcgaaacgacaacagtttcttgacggcgcggcgcaattggacatcacagcactgctaaccagcactgaagtgtcagagccagtccgtgcagtcattctccaactggacgcacttctcaagctcgcggtggacatggttcatgagacgtcgatccaggacactcgcgcggtactggaggaggaccggcgagaacattcggtcgttctgatgggcgttccggaatcggacagtggcctttcctctacacggcgcgcgattgctgaccaacagcaggtgttagacattctggacgtttgcgaaatcgaggcaatgccgaccaaggtttaccggatgggccaaagaaaggaaggaggtccccgacttctcaaagtggaaatgccaacccgaaagattacacaaacatttctccgcaataaaacccgtcttaaaaactccaaatttcaagctgtctccgtccgtccatctctctcccctgaacaactcaaggagcggcataatttgatcaattgttgcaagacagcccgcgcccaatttcctaatctcaatttcattgtttatgctggacatgtcattccccaaaacgatgtctctgtttttcgtgatgaccctggtaattattcctgtttttgccataaatccaattcataaaatcttgcgggaaccacccacactgaaatttcaaaaaattttacaaacgtaaattctggtaccgcaagatttttcaaaagtcctcataaggttaataaatatatacaaggtgctttagttaatataaggtctatctataacaaatgcgaacaattagaaacaatttttgaatccttaaatttagactttatctgttttactgaaacctggggtaaaaatgaaaaccaatttccttttcattcaaattttcttcaaaatcataccatttcttacactaacagattgaataagcgtggaggaggcatagcttttgtcgctaaaaaagatatacagttttttgtaaagttttctgaaacaaaatttgggtgtgaaatactaatattgcaatttcaaaattacaattcactaaatttgattcttatttatcgacctccttctactaatttaaaaaataccaaaaatctttttaaattccttgacctttacatttcggaaaactgttgtatacttggggattttaaccttggaactaaagatttaactataaaaaataaaaaacctttccctttaagtaattttggtaatttattttgtgatttctttaataaatataatttgacatcctgcattaatgaacccactagggagcaatcctttctagatttaatcctttcaacaaaaactgacttaataaatgcggtagaagtaaaaggtggacttttagatacaaatcatctaacaattctttttgatttttgtgttttaaagcaaaatgcaaacaagaaacaaattgttcttaggaaatacactaaaactaatacctttctattcgatgcatatttatcctcatttctccctcaactactacaaaaattttatacagttgaggataaatatgctattttctttagttctgttcgaagaaatcttgaaattaatattcctgaaactattttatctgttaagtccgccaaaaacttttacccaccgcatttattggcttcaattagggaaaaagcacgtctatataagctaatgaaagaaaatagaggaaaatatgaacctttatataaaagtatctccttacatattaagactcaaataagaaatattcaatcccgtaaagaaaataaaatactatccggtgataagaatagattattttcgtatcttagaaaatactttaaaccagtagaggatccaccagttattcagtataatactttgtttgtttcagactcaacttctaaagcggaaatttttgcaaaaattttttctgaaaactactgtaaataattattctcttgattttgatacttctttttcttctccaaca

SEQ ID NO: 67394 - DNA, 1029 bp, Heterodera glycines
  Genomic contig location: Contig_ID=SeqID_8235; Location=3780..4808; Strand=-
  SCN-specific regions: Sequence locations=1-300,322-460,482-548,571 -919,945-1029
atgacttatttcgagtatttaggttagttcttttaaacagagaatttgggtccaaatgtgtaaaaccatgtagaattttataagtagttaggaggtcaaaaatttttcttcgtttttcaagagtagctaatttaaaaaattggagccgttggtcatagggaatatatggaagacaacattttctgaaagcgattcgagtaaaatatttttgacatttttcaattttgataatatgcgattttagttgtggattccaagattcaggggaatattctagaagtggacgaatataactaacataaatatttttccaaactgaaattttctttgatttaataacacggaaaagtaaacgcatacggtagtaggcgttacgggtaattttgcttatgtgttcggaaaaagtaaatttattgtcaataagaatccctaagtcacgaatagtttcaacttcacaaattgcattatcattaattttatattgttccctggggttattctttccaaagtaaataataaaagttttattgatggaaattttaatataccatttcttagaccaatcagagagaatatttaaagcatggtgcatagcaattctatcattttttgttttatgtacggaatataatttgacatcatccgcatataattttaggtttaggaattaattcaggtaaatcattaatatatatcagaaacaaaagaggcccaagaacagaaccctggggaacgccagagctcattttatactcagaagagagagtattatcaacccgaaccctaaaggtacggtttgaaagaaagtcagatatccagtttaagattttacccctaataccgattctatgaaccttatataaaagtaaattatgggggataacatcaaatgctttcctaaaatctatatagacacaatcgatattcttatttttataaataccatcataccaattttcaagggttgaaattagttgtgtcgtggttgatctgccctttataaatccaaattgatgttcagagaataaa

SEQ ID NO: 67395 - DNA, 1673 bp, Heterodera glycines
  Genomic contig location: Contig_ID=SeqID_38645; Location=130..1802; Strand=-
  SCN-specific regions: Sequence locations=1-36,81-210,241-253,275 -324,360-363,389-424,446-456,503-516,550-594,616-808,841-862,907 -909,931-931,961-1012,1135-1137,1165-1172,1248-1319,1387-1522,1558 -1673
ctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttgggcaagaatgtcttcattaatcaagaacgaaagtcagaggttcgaatgcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaaca

SEQ ID NO: 67396 - DNA, 1565 bp, Heterodera glycines
  misc_feature (48)..(48): n is a, c, g, or t
  Genomic contig location: Contig_ID=SeqID_38645; Location=14..1578; Strand=+
  SCN-specific regions: Sequence locations=1-232,268-403,471-542,618 -625,653-655,778-829,859-859,881-883,928-949,982-1174,1196-1240,1274 -1287,1334-1344,1366-1401,1427-1430,1466-1515,1537-1565
catcagcggacgggggcatttggtggtgccaacgctagcccacagtancagcaggtaggtggtgaataggaatcactggagtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgcattcgaacctctgactttcgttcttgattaatgaagacattcttgcccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggagagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagt

SEQ ID NO: 67397 - DNA, 887 bp, Heterodera glycines
  Genomic contig location: Contig_ID=SeqID_38646; Location=217..1103; Strand=-
  SCN-specific regions: Sequence locations=1-660,690-849,871-887
atggacactgagcaaattccgcagaggccccgcacggtggacacggaggagtatgttcggacccggattgaacaaattgccgagcttttggaggtgaacgaaatttttttttttgttaacaaaagtcatgaaaacacgtttccaagtgctttcggggtcgttgatcagtgatcacgaatccggcaaaaaaaaagtcgaattcaaatttttcaaggaaatcaaaaaatttgaatttccaactttttgggatcctgggattcggaattgttcgaaatggatgctggattcgtgatcagcgaccccgaaaagccttggaaacatgttttcatgaccattgaaaacacaaaaaaaatttcgaaaaggggggggggcagcagccttactatttacctaatttacctaattttttttgccgcgaaacacgacccaaaatcatcgtgtcgggtttcggacttccggacgagaaacatgtcgggtttctggattaaggtttcggtatcagggtgactcggaacaatcctgctcgggataaatcaaaaatgggaaaatacaataagtttaattaggcccacaatttagtaaaagaggccatttctacaatactttcgttgaattttttttatttatggataaattaacctttaagtctcttaagggcacattttttatttaaatatgtatttaaatttgctttttagttatggcgttatgttctggtcccaattctgtttatcacatttgtcctcccattggcattcactttccaaattttgaacttggacatgcttattcatgttcaaaaggataatgtcacattcactcttgacaacaacgaacgcactgccaatgatgtgagaaataaaataaaaatgagaaattttatataa

SEQ ID NO: 67398 - DNA, 939 bp, Heterodera glycines
  Genomic contig location: Contig_ID=SeqID_38647; Location=2..940; Strand=-
  SCN-specific regions: Sequence locations=1-457,480-662,684-729,751 -856,925-939
atgccccacccattgacgattttcttaaataatcaggggcaaagagtggtcgaaaatggcgtcttggagaagactcggatcgggagaacgaccaacgccactgggccaactcttttgtgccgaagagagagggacaacgccaagggcaaagtgccgaaaggaaaagtgccgaagggacacgcgacaaaagccaattggcagcagatggtgagaaagggcgaacagaagcacactgggaacagcaccagccaatttcaaagtgcactttgctcagttcggttttgcgttttgtttgccattgatcgcttttctgtggcaccgatcgatcgctccgttcgtccaaagaaggcgttttcatccgtcacagatgccattcttcccaacatcacacctttcttccctcccccccccccccctcagtttttcagtttcttttttttgctcttttcgatcagaacagtgaattaattatttataaagtgactctaatggtatttttttacggtttttgaatgattgatacgatttgtaattagttattattctagtatttctatactatatctgttgaataaaagttaagtattttggatgacatattatgtgttctattatgatttgtgggtgggaaggaattcgaacttcaatcctaatatacattaaaatatatattcatatatttagtttctacctttagggaaattgataaattggaaaagcgatttagacattttataaaattgattttaaaattgaagtattatcatgactaatataatgacatattatttggagtattttttctcgctgaaaaaaacactgagataaatatctatgaaacgagaaatggagagagaataataattaattttaatttaaacttttaaaattcaaaattatttatagaaaatttaaaattaatatgctaagccaaataaa

SEQ ID NO: 67399 - DNA, 384 bp, Heterodera glycines; identical to SEQ ID NO: 66175
  Genomic contig location: Contig_ID=SeqID_38649; Location=417..800; Strand=-
  SCN-specific regions: Sequence locations=1-20,51-384

SEQ ID NO: 67400 - DNA, 157 bp, Heterodera glycines
  Genomic contig location: Contig_ID=SeqID_38649; Location=1278..1434; Strand=+
  SCN-specific regions: Sequence locations=1-122,153-157
cttgcgctgaacggagttgtttctgctgaaactatccgtctttacaagacggctgtaatagcggcgcttggcaacgctcgctagcagctatctggttgatcctgcctgaactgatgtgaaaatttcaaagattaagccatgcatgtgtaagttaacc

SEQ ID NO: 67401 - DNA, 1436 bp, Heterodera glycines
  Genomic contig location: Contig_ID=SeqID_8236; Location=143..1578; Strand=-
  SCN-specific regions: Sequence locations=1-79,144-165,187-251,306 -382,463-546,689-907,1205-1265,1389-1436
  Gene Ontology: Cellular component=extracellular space
atggttggctggggatggatgaagggccccgtcaatgggccatattatgccacttatgcccaatattttcgacggttactaattaattagttaattaggcaataattaattcgttaatttgccacttaaaaattaattaattattttattttgttggtatataaccaaataaatttgcagattttttgaagaatatgcgaaacaaaatctcaccttttgggcactgacaattgaaaatgagcccggtgggcaaaaaattcaaaaatttaaattgctaaataattaattaattaattctaattttaggtgccggacttttgcccttttggagttggcaagcgatgtatttgtctgcaacaacacaacggtggcgaaaatggagaataaataaaataaaaaaaaataataaattaatttaaaaatcatttaatttctaatgataattaaaaaaatagttttaatgaaggatatgagcatatttataatcaacactaatattttaaatataatgttattacaaaaacttacttaagtagaaaaaatacaaaattaaaataaattaaattaaaaattaaataacttttttaaattaaaaaaactttttaataaaacataagcattaaattcattaaaaattattagctaaattgtaaaattaaattttcatgaattattaattaaaattaaaaaatctttgcatgaaaaagaaattcaacaatttttttgaaattaattgccttgtgaaattaaattaaattgtcaaatttgaagtcaattcgccgccacccttctcgggcccgagctgaaaaaatcggtggcctcaaaaaatgtgaaaataatggcacacgacgaccagcggagcaatgtttatgagcaggcggaaacggtgagaggagggcacaaattcaaataataataaataaataaaataataataataaattaaaaattggattttatgcaattttaattaaaaataataattaaattaattaaaaatattttaataaaatttttcactcgaaatttttaaaaatatttcgataaaaagattatttttttgctcaatttctttaaaaaaataattgaattaaaattgtaaaatgtttttaatttatgtacttttaataaaaattaatttttaaatttgttatatgcattttaatttaaaaaataataaaaattaaaaatattttttatttttcaatcgctattttattaacaaaattcgataaaaaaatattatttttgctcaattttgcctgaaaaaattaattaatattaattatttgtttttctcaatttatacaataaaaataaataaaaaattacttttttgtttatgcaatttgaaaataattaaattaattaaaaaaaattttatttttcagttttacggaacaccaggcggtgaacagaccattgacggagttgcg

SEQ ID NO: 67402 - DNA, 161 bp, Heterodera glycines
  Genomic contig location: Contig_ID=SeqID_8236; Location=2353..2513; Strand=+
  SCN-specific regions: Sequence locations=1-161
atgatcggaacgccccactattacatgggcaggccaattgaaatggccaagagcagtcatagagaaacttgccgactcgagaccgagaatttatcgcccgagacttctcagctcgagaatcaagattctacactcactgatcaagatcaattcgcggattg

SEQ ID NO: 67403 - DNA, 255 bp, Heterodera glycines
  Genomic contig location: Contig_ID=SeqID_8238; Location=1069..1323; Strand=+
  SCN-specific regions: Sequence locations=1-255
atgggttccgattcccatattttacccggaacccgggtctccaagatggaccccggaaaggattattaccggactaaaagcccagttttaaccggattccaagggtctgctcgacttttcaagacccggaccctggtttccgattgcaaatttttcgcggagcggctttctgagatgggccccggacaggatcccggactaaaagtattatactttgacatagcaccgtaaaaaaaatttgaattaaaattttta

SEQ ID NO: 67404 - DNA, 503 bp, Heterodera glycines
  Genomic contig location: Contig_ID=SeqID_38652; Location=233..735; Strand=-
  SCN-specific regions: Sequence locations=1-107,134-174,213-234,256 -263,292-503
atggagaaggcctgcaacatttggagagattatatcgattttagtgcgctaggttcgatgaaactttttaaaatataagcctaaactttttggcctgtttaaaaaggaattaaaaatttttaaaaattttattcatctcccttttgatagaaaaaacatcagagagccttatttaacttttaattaacattttgtgtgtttcagagcagtttctgaaaaaatatttatgaattgattttgctaaaaatataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagatttttattcatctccctttttgatagtgaaagcatctgagtgcctaaaataacttgtaaataaa

SEQ ID NO: 67405 - DNA, 1017 bp, Heterodera glycines
  Genomic contig location: Contig_ID=SeqID_38653; Location=146..1162; Strand=+
  SCN-specific regions: Sequence locations=1-83,119-1017
atggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaaccgacggaaacaatgtccgtgttcatgctcccaaccgggaaattgatgcccaaggccgagccaaagtgctgaatattgtagctactaatatgctcaagttacaataa

SEQ ID NO: 67406 - DNA, 584 bp, Heterodera glycines
  misc_feature (23)..(23): n is a, c, g, or t
  Genomic contig location: Contig_ID=SeqID_38657; Location=869..1452; Strand=+
  SCN-specific regions: Sequence locations=1-124,146-253,275-584
atggcgattttacaccaacaganaggaggtaatgagaaaaagagaaaccgtaggaagttaaattgagttttggaaatgttaagataaatattaatttatgtttgcgaattaaattttataagattttcagaagttaattgtgaatcaattagtttggacaacgatggacaatctgatggaaaagcgactgatccgcagcagcagaaagtgagcaattaatagcatttgtacgagaaagatttgaaatattttgacataatatttttaaaggaatttgttgaaaagtgtgccaagatggaaatggacttcaaaattagcacattggaacttgagaaagttggttttcatagataattaatttatattcttgtcctgacctatgcacaaaatcgataaattagagaaatttcgtttaaatgttagaaaatggaaaaactaatttactattttgtgtttgcgaaaaaaaatgggcgtttctttacgatatttttacgtttttcgagaatattctgcgtataaatatgtagaaaagatttattatacacatttggacattttgtaaagattttgaggtttttgagaaa

SEQ ID NO: 67407 - DNA, 1022 bp, Heterodera glycines
  misc_feature (979)..(979): n is a, c, g, or t
  Genomic contig location: Contig_ID=SeqID_38659; Location=885..1906; Strand=-
  SCN-specific regions: Sequence locations=1-278,300-615,637-1022
atgtccaaacgtaccactcccaaacaaaacggatcggttatgaacatggatttgtcgaattctttggccaataagacagatttgacagacttggatttgcgaatggttgacgatccgcaggttttttaatgcttaaatggtatctcttatttttgtctcggacgatgctccattttccagaaagtttcttatttagattgaaaatttatatgtttttggcttttcccattcacgctgtttttgacttttgtcccccattttcagcactgtctcccgtccagttccggcgcctcctcttccgttcccgtcaatgttcaaccgcccaatcacagcgaacattcactaattagccgtgcccgtttcgatgctcgggcaccagccattgatctgcgaatgcgctataaattgaacggacttcgctattttcaggacattgcggtccctttccgtgcccaaagtggaaagattcaaaaattcagggcaaagaccttcgcgggagcggtaccgatccgacgttcgaatatgaaaaaaagccactgaaaattgtctcgtttaatgtgctgtgccagcgaacaatggacaaaatgccacacctttatatgcatttgcgacgcaaccactgctgtagagaatgggagcagagaaaggtcagtgtcaagattggtcactataagtcttttttttaaaagaaaaaaattggtattttaatcaaaatgcgatgaattttagttaaatctccttaaattagcgattcgattttatatttattcatacatgaagaaaaaagggtggaagagtcaactgaaatttttgcgaaggtgtatctggtcatgggtaaggagaagctgggctccacccaaaaaaatatttttctgttatgttttgttgcgattgttttatgatcatttcatgactaataatagtgctgctcatatatgggtgcctcattcgaaaagggtgcatcatttggtcacattgnatcagaattttggagatctaggatgttcaaaatcaataataaa

SEQ ID NO: 67408 - DNA, 505 bp, Heterodera glycines
  Genomic contig location: Contig_ID=SeqID_38660; Location=168..672; Strand=+
  SCN-specific regions: Sequence locations=42-42,92-98,176-212,237 -400,422-505
atgccgtgctcgttcgggctgctcgcgctgagtacgacgccgattgcccggccggtcccccgggagatgccggcattgccggaccgcccggcccccccggcgagccgggcaaatgctatggcagcgggtccaaagagtccaaagaaaaggagtacaaacccagcaagcgcagcattgacaacttcgagcatggcttgcgcgtcgccagggggtaaatttaaaaattgaatttgaattggataagccggcattttaaaaaaccaaaagactgattttttgaaatgaacaaatctccgtattttctaagttagtcccccacttttgagagtttaattataagcctcctccgtggctttatcaaatgccaaatgtttcccatttgtagctacaagcaagaagtcggaccccctggccccgcgggaccgcccggccctcccggaccggacggaccgcccggagaatgtgaatgcaaatactgaggatgatgctgaagatggtccacgat

SEQ ID NO: 67409 - DNA, 534 bp, Heterodera glycines
  Genomic contig location: Contig_ID=SeqID_8241; Location=426..959; Strand=-
  SCN-specific regions: Sequence locations=1-298,320-534
  Gene Ontology: Mol. function=dolichyl-diphospho-oligosaccharide -protein glycosyltransferase activity; Cellular component=membrane; Biological process=protein modification
gtccctctcttcgattttttggctctctctcacaaacagaaggaaacccttctgaaattggttgtcctttcgctttcggccattgtttcttttctcgtcagactttttgccgtcattcgctttgaatctgtcatagtaagtacttttgacagttttttttaatagaaattaaacaaacggtctctttcctcgttttcagcatgaattcgacccgtattttaactaccgaaccaccaaataccttactgaagagggctactacaacttccacaattggttcgacggtaacgcaccattcaaagttaatggtcgccaaattaacattggaaatttagcatttgcgtggtatcctttgggtcgtatcattggcggcacaatttatcccggtttttctttcttgaatttttttcttactttttgttagggcttatgctgaccagcatgttcatccatcgcttcctcaacctgctcaatgtcaccgtcgatattcgcgaagtttgcgtctttttggctcccctcttcagttccttcacc

SEQ ID NO: 67410 - DNA, 749 bp, Heterodera glycines
  Genomic contig location: Contig_ID=SeqID_38664; Location=17..765; Strand=+
  SCN-specific regions: Sequence locations=1-339,364-405,435-498,521-749
atgcggtttggcgaagctggcgaactttggggcagtttttggggttgccagacattcacttgcaaagacggtcagcaaattgaatttgtattaaatttgtggcatttgctcatgaaataaggcataaaatcatttagtataaaaagttacaaacaaattataaccacgattttttttattaaataaacgtgaagaaatttattatagcgtaatagattaaagttttcttaaaattttgatttttatttttgtcaaattttcagtttttaaaaattttcgatccaatttgtaataaaaattaatcacaaaaatatctttagttttttttttcttttgctgaattataaaatttaaaatttaaatgcccgttcttttccaattgctttgcggtgtttgttacgatgctaaaataatgttatttattattatttatagagcatggtaaagacattttccgcatcaatggatgcgctgaaagaaaggacagaaaatgctcgaaagtgtactacacacactgtatgaaaattggtggcctttcgtactgtagtcattgtgatgatttggtcgatggcaaagtgtgcaacagctttgatcagttgatcaaccttgatcagtccgatgatcagctgaacagcattttgaaatcgaacactaacagcaccagcaaagccgagaaacttggcccggcttccgccttcacttggatcagcagcaatttgttgctgatttttggtaatggggaaaaatga

SEQ ID NO: 67411 - DNA, 1159 bp, Heterodera glycines
  Genomic contig location: Contig_ID=SeqID_8242; Location=632..1790; Strand=-
  SCN-specific regions: Sequence locations=1-91,113-114,136-1159
atgggtcgaccgaaagacgggccgaccaaacttcgaatttctcaaatcgaaattcggttggtcttaattacttttaattgttaaaggcgttcgaactgagtgaaggggaatttactaaagaaaaaggatggattttgcaaataattggccgttgttttttcaggcacagaatctgtgcccattctgatcggcacggacatttgtccaactcaaatgccttttagctcatttattgacgaatatttcggtttttctccaactgacaatgaaacaaagaacaaagtggcctatcttaaagattggcacttccaaaagttagaatactccaaaatgccaattgaacaatgcaattttcagttctcatcccgaagagtcggatttgtacgaattgcccgcctttttacgattcgattgggccaattacgaacgatggacagtcactgatcagcagcagaatccattcgggggcgattaccgttttgtttatttcggcaccaaagggagttggtgctgtctgccgatgattacattttcatttcacattttggcttttcctttttgaggacgcctttccactcggacgtgctcaattccttctcttggtctgccaatgtttgcggtcggaagttgtggtatttgctacggccgggcgccgaacgccgcgtgcgccaagcgaacggcgcgtaccctgaggacattcggcagtgtttggggcaatttcagcacgacgaactgttccaatttgtgcaggaaccgggccaaattgttttcgtgccttccggctggtggcatcaagtgcacaatttggtcagataacggcgaacaacagaaaattgccaattgcatttaatgccgatttcaggaagaaagcatttcgatcaaccacaacgtgatcaacgcgttcaatctccgccatttggtcccactgctggagcatcgcctgacggaagtccgtgcggagatttcggatgtgcgcgaactgatgacggaggacgaattcgagaagcaatgcgaagtgagaaataaggccgatggtttcaaattgccaaaagctctcttttttcactttattcagttgttattattgtccgacttaaaaatgaatcgaacaaaacttttgcgactgatggaactgatcattgaatcgcggggaaataaa

SEQ ID NO: 67412 - DNA, 360 bp, Heterodera glycines
  Genomic contig location: Contig_ID=SeqID_8243; Location=1245..1604; Strand=-
  SCN-specific regions: Sequence locations=1-360
atggctttgaaatttgcacttcgccagcagaaggttcgttgtttttaaaatggtggttttttgttgccttttcctttcttttcccattaatgttttcttctttttctgtagggttttgctggcaacaggcgcttttccccttttatccgcccctttacgtcaatgccggcgattcgcttcatttcgaagtgtttgtcagggaccacactttgcatgttcagcccaaacacagcagcaaatggtgggtcactcgtttattaattggcattcaattacgccatgattttaattatttttttcactcattttgaattcactcttttgctttttcagctccctttggccctcccctccgcgtga

SEQ ID NO: 67413 - DNA, 305 bp, Heterodera glycines
  Genomic contig location: Contig_ID=SeqID_8243; Location=851..1155; Strand=-
  SCN-specific regions: Sequence locations=1-305
gtcctcactcatccgttttggactgcaccgatttgcttttgaccgtggacgattgtcccggtgactttccgttcgttgcgtccgctcatgcgacaattcgctacgtttgtcgggggacggcgaccacgctggacaaaggtgagcagccgaacgaatcctttcaatgctttttcatcagcaatttgcccccctggcggtgccattcttttttggcccttttcttccatcggtgccctaagagatgactatttcgcctctatcattgagttacgcctccgttcgcctggcgcattgctaatcccctc

SEQ ID NO: 67414 - DNA, 535 bp, Heterodera glycines
  Genomic contig location: Contig_ID=SeqID_8244; Location=1478..2012; Strand=+
  SCN-specific regions: Sequence locations=1-535
atggttcgtcgtggtggtcgttcttcttcaccaaaagctagcgctccggttcgaagtgtgaaaagcacttctcctgctcgttcggccgttccgtctcgtcctgctggtactcaaccaacttccggtgcaacggcaccgcagcagaaagggcctgggctgctcggacaaatggctgcaactgctggaggagtggcgattggttcggcaatggtaaaagaataggtctaatttgatatatccacttattttagggtcatgccatcggtaatatgttctctgggggtaatgctcaagaagtcgctgctcagcaagatgttcctgccaattcggacaactttgaaaccaccaagcagtactcacagccctgtgagattgagtggcgccagtttcttgagtggtaatacttgtacatggatctattttatggatttcacattatttttcagttctcagaaccagagcgaaggtagcatctcccagggattcaacgacctcttcaattgtggagaagctcgctttggccgttagaccttga

SEQ ID NO: 67415 - DNA, 280 bp, Heterodera glycines
  Genomic contig location: Contig_ID=SeqID_38672; Location=766..1045; Strand=+
  SCN-specific regions: Sequence locations=1-95,158-280
atgggaatcgaagaaacaattaaaatggacagaatagaaatagtgaaaggtgagaagagaaacgaacgatgggaataacaaaagcaaaagcaaacattaaaataatttaattaatttgaaaaaataaaaaataaattaaaataattaatattattttctttctcacaataagatttggctgcgtatgaattgaccattggatacagccgaatattaacttccgacgatgaattgtaagtttaaaatttaaaaggatggtcagggaatggccaaaagaaaa

SEQ ID NO: 67416 - DNA, 216 bp, Heterodera glycines
  Genomic contig location: Contig_ID=SeqID_38673; Location=343..558; Strand=-
  SCN-specific regions: Sequence locations=1-119,141-148,171-216
atgttgaagccattcgtttttctatttttaattttgtcatcaacaaaatatatttgtccaaataaacacaaagacattcgcgattatacggacgctgacatcgaaaaattatatgatcaatgggaagaaaatgatgaagacgaactcccagaagatgagaaacctccctgccaacgaaaaaggccccaaattgacctcgaatcgcttcagcaaaga

SEQ ID NO: 67417 - DNA, 143 bp, Heterodera glycines
  Genomic contig location: Contig_ID=SeqID_38673; Location=934..1076; Strand=+
  SCN-specific regions: Sequence locations=1-143
atgacaaaatcatttcttgagagggacaattttgagagcgaattgggtgcaacgcagcaggatgacccttttggcgaggatttttgcgatatttcaagtaacgaaataattgacgtgttcgctgatggggatttggccggaag

SEQ ID NO: 67418 - DNA, 86 bp, Heterodera glycines
  Genomic contig location: Contig_ID=SeqID_38674; Location=17..102; Strand=-
  SCN-specific regions: Sequence locations=1-86
aactcgtgcggaaatataaaagcaaggaagtattatgctcgcctttgcagcctctgtacggcactggggccaacactttatgtgtc

SEQ ID NO: 67419 - DNA, 1081 bp, Heterodera glycines
  Genomic contig location: Contig_ID=SeqID_38675; Location=347..1427; Strand=-
  SCN-specific regions: Sequence locations=1-16,41-1081
agagaaaattttttccaaaaaattttttttaatttaaaatccccggcaaagtttttgctggaattcaaaaaatttttaaatgaggccaaaaaagattgacccggaaattacgaccgatgaggttaataaattcctagaaaagcagaaaacatacacgattcacaagcccatcaggaaaagattcctgagactaaagacggtaccgagcggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaagcttttgatcatgtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacactgggagccaaaccgtcttcaattaattttgaaaatgcccgtgcgctctgggaaaaattatataaggagaaggaatttaaaatttcgaaaaagaacaaatttaaaattggcgatatcgttcgaattaccaaggaaaagggaaaattttcaaagggatacctcccaaactttaccgaagaattgtttaaaatcgttgttgccaattcgacgacacccgattcatacaggatcgaagatttggaaggaaatttaataaaaggcatattttataaccaggaattagtgaaaacagatggatgatttttacattgtactaccttcgaacacatcagggcaggagaacactacgtcaaaattcacagttcgactccccgagactttggaattgggcacaaattggtcagtagctctctcatcaattatttacccctactc

SEQ ID NO: 67420 - DNA, 491 bp, Heterodera glycines
  Genomic contig location: Contig_ID=SeqID_38678; Location=102..592; Strand=-
  SCN-specific regions: Sequence locations=1-174,196-274,296-414,451-491
atggacaaatacagtatcacaaattgcaccatttttgtactatcgtacagtaagtaatgcatgattttttttattattaggtccgggtcttctattgttcaacccctcgcaaatgggtgggcgtcttcaaatctaatggagtctaataaccaaaaaaatactgtgtttggctggaaaagattaaatcttaattaatatattgggctgaatatgataaaaacgatataccctattgatttttggaatttccttcattaattgctttagaaaatactttaattaattaattaatccatcggttaaatccgtttacaattatttgaagaaactaattaattaaatgtgtggtctcttgcctgagcaccgcaagcagtacccgtgcaccatgagtacgtcttcacagggtacaccttcaattaaatataatcattttttaattcaaaaaaatttcagaattttatactgttttcgtttctgtgacggttgagtaa

SEQ ID NO: 67421 - DNA, 875 bp, Heterodera glycines
  Genomic contig location: Contig_ID=SeqID_38678; Location=1..875; Strand=+
  SCN-specific regions: Sequence locations=1-142,179-297,319-397,419 -730,765-831,853-875
ctccaatatttaactaggctgttgctcatccagtctcacctgagcagcaacagttacaagtcttcctgcacaacttgtgtctcaagtagtcaccagcagcattactcaaccgtcacagaaacgaaaacagtataaaattctgaaatttttttgaattaaaaaatgattatatttaattgaaggtgtaccctgtgaagacgtactcatggtgcacgggtactgcttgcggtgctcaggcaagagaccacacatttaattaattagtttcttcaaataattgtaaacggatttaaccgatggattaattaattaattaaagtattttctaaagcaattaatgaaggaaattccaaaaatcaatagggtatatcgtttttatcatattcagcccaatatattaattaagatttaatcttttccagccaaacacagtatttttttggttattagactccattagatttgaagacgcccacccatttgcgaggggttgaacaatagaagacccggacctaataataaaaaaaatcatgcattacttactgtacgatagtacaaaaatggtgcaatttgtgatactgtatttgtccattttcatacggcaaaaaatcgttaggctcaacccgttcaacccgttgccccggcagcaagtggtggtggcaccagtattagcaccggcagttcgtgcagcagcggaacatgcggacaacaaaaacaacaggttggatagaaattatattaatcataaatttaaaaaaaaaattggcattatgcaaaaaacaggttcaacctgttgcccctgtccaaccggctgccccggctagcaccagctcgtgcagtggtggcagttcatgcggtgccacggcacaagaggt

SEQ ID NO: 67422 - DNA, 375 bp, Heterodera glycines
  Genomic contig location: Contig_ID=SeqID_38680; Location=187..561; Strand=-
  SCN-specific regions: Sequence locations=1-375
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtctacagacttttggaaaaatttatttgcaatttatcaacaattttgagaagtgagttagaaatgataaacttcacgattcaaaccagttttcggtgctctaattaaccgcgataaaaacattcgaatcaattaaatagcttctgagataataaggtttatcataaaatttcatttaaaaataaa

SEQ ID NO: 67423 - DNA, 106 bp, Heterodera glycines
  Genomic contig location: Contig_ID=SeqID_8246; Location=4259..4364; Strand=-
  SCN-specific regions: Sequence locations=1-106
gcagcagggatgggccgaggtttcgcttttcgcatttcgcctttcgcattattcgcattttttggcgtttcgcatttcgcatttcgctttttggcgcgaaatgcga

SEQ ID NO: 67424 - DNA, 1168 bp, Heterodera glycines
  Genomic contig location: Contig_ID=SeqID_38686; Location=30..1197; Strand=-
  SCN-specific regions: Sequence locations=1-180,202-248,311-423,457 -572,595-676,700-860,891-932,1007-1014,1036-1168
atgatggtaataacccaatttaacaagttttatggatcaatttacatattatatgcagcacatatttttgaatcttttatgtacataattttatgattttcaattcctctaatagaacaagcccggcctccaaaaaaaaagaagtggttgtgcttaccataaaggaaatttagtctatcataaaaagataaaggaatattagggaatttatgcctttttgtgacttttttatgcaaaatataaatcgcttaattattttgttttaatatttattataataaaaactttataaatttttaattaaatttaaggtttatgctgtgacattgtccgagaagtactcagtcgaagagcttcgcgagtacaccggcagcgagaacaatttgtacacaaatgcccgtattgaccaatttattcaggtccaaattaaaatctttttttaattaataattttttgtaacaattttttgtaggaagtgggcaattcgattagccgatgtccgggtgggcaacgggtcggttttgttcatgtgacacctgtgccggacgttgaagcatccgtcacgccgacgtaaaaaatattatttttatattcgctttaatttgatatcaatcacccgacaattctgtgattgaaatgtcggggggttcgcggttggggaaaattatgcaatcaaatattaatatttttagtatttttcggtatttgaagaattctttattcgtaagtaataattcgcaaaaaaattcgtcaagttctaaaaaggctatttttcgaaaaaaaaatttttcatatcttttttgaaactaatgaaattcattgaaaacttccaggaaaaataaaacatttaggactatcgaatttatcttttaaaaaaatttttatttttcacagtttttgaaacctaaggaaatccattcaaaatttgcagaaaatttataaatattttgacaaattttgtttaaaatatcgatttttagaattaaataaattttctttaaattagtgcaaatttttaaaatttgccaaatttatacttccagaccatttgaactgaatgcaacaattagtatctcgtcggcaaaagcaaaggatggcaatccaaagaaacaaaataaggaagatgaagttgccaaggctcgagatcaggtgattctgagcagataa

SEQ ID NO: 67425 - DNA, 80 bp, Heterodera glycines; identical to SEQ ID NO: 51817
  Genomic contig location: Contig_ID=SeqID_38688; Location=351..430; Strand=+
  SCN-specific regions: Sequence locations=69-80

SEQ ID NO: 67426 - DNA, 1278 bp, Heterodera glycines
  Genomic contig location: Contig_ID=SeqID_8247; Location=907..2184; Strand=+
  SCN-specific regions: Sequence locations=1-478,500-629,651-897,923 -1085,1108-1278
atgacccaaagcgaactcaaaattttgtactccctgcggcaacaagcctatcaggccaatattgccgcaggtgagtacaaatattttgtggcagatttggagatcaaatctttgaaaaacccccgcccgctcagaactcgctagggatacgcgagcaaaccaaacaaaaaaattaggaataagggagaaaaaaatccctgtgtttcctgcctattaataaatgcccgatcaatttcaaataaaatatctgatttagaacatatagcacaaaagtatgatccatcaatattcatcatcaatgagacctggttaaaccccagaaatacaattgaaaatgaactatctataaatggtagatatagagtaatgcttgcgaaccgaaatgagaaaaagggcggtggatcagcaattctaactaaaacaaatattccttatcagacactattctctgggacaaaattccaaagcgaaattttacacattaaattactttttaaaaaaccaatccaaatcataaatatatatcgtccaccgaattgtacagttcagaatactaaaaagctactcaaatttatttcggaccaaagcgattctgaaaatatcatatattgtggggattttaacatcccaaatattttatgggatgaaaataaggtaattcaaagaaatgaccctgtgtcaaatttattgattgagtttattgaccaaaaacaattgaaacaacatgtaaaggaaccgacaagagaaaagctattttagatttagtaattactagtgaatcagaaataattaatgatttaatagtacttgaaaatttttcaacttccgatcacaaaatggtcggattcaaaataaagggaaaatttagtcgtaataatcacagagtttatagaagagattttaaaaatattaattttgcaaaattaaatctagcgatacttgaaaatcgaattgatttagcaataaactcagtatacaccgttgaacaaaaatatcaagaattcttaaataaagtaatgaaattatatgatacgtttatacccaacagatctctaaaatcgataataaaacaatcatatcctcaaaaaataaaagatttattttcagagaaattacggttacataagcttgtaaaaaagtttcccgataaaagtgagattattttaaattacaaaataatttcaagggaaatgaaaaaacaattgaaccaatttagaaatgaaaaagagtcaaaaattatttcccaagggcaaaactcagttaacaaatttattcgaa

SEQ ID NO: 67427 - DNA, 1506 bp, Heterodera glycines
  Genomic contig location: Contig_ID=SeqID_8248; Location=315..1820; Strand=+
  SCN-specific regions: Sequence locations=1-229,251-302,332-481,529 -850,888-977,999-1004,1027-1221,1243-1256,1278-1506
aatatattaagaaagctccccaggcgaaattccacttcaccggataatgttccttacattttattaaaaattgtgcagaaccaattacaaaatttttagcagatatatttaggctaattttggattccggacaaattccggaaatatggcgaacatcattagttgtaccaatttacaaaaaggcgaaaaaactgatccattaaattacaggccggtgtcattaaccagcactgtctgtagagtttttgaacgaattttgagtagcaaaattttagaatttctgaacagtatagaattttttgataaagaacaatttgggtttttaaaaaatagatcgactacaacccaaatattaaaaacgatggacgatatatataattctctacaaaagaatcaacaaattgacataatctatattgattttgtcaaggcgtttgattctgttccaattgatttattacttcaaaaaatcaaaaaaattggaattgaaggaaaaattcaaaattttttaactaactttttaaaaaatcggagttttaaagttaaaattggcgaagaattgccagaaagtttcaaaatattttcaggagtgctccagggaagtgtcttagggccattactctttttaatttttataaatgatctgccgtcctttattgcaaatgaagcatcatcagttggcataaaaatgtataccgatgatgttaaattatattatgcccatgaaaatgatgataaaacaaatcatttagataaagcaattgaagctttggaaaaatggtcaaaaataaatgggttagaaatttcaactgggaaatgttttgttctttatttagggaaaaataatatgaaaaaagattatttaattaactcaaaaaagatttcagaatcggataatgttcgtgacctaggcattataattgactcgaaactgcatttttcaggacatattaacaaaattgtacgaaacgcttatcttagagttttccagattttaagagtcttaaaaaccagggaaataaagactctaacaacagcttataaaacttttgtccgacctcaattagaatacgctaccgaagtgtggaacccaaatttaaaaaaagacattgacaaaattgaacgggttcaaaaatttttcacaagaaaagcatttagaaaatgtggttttttgtacaaaaaatataaggaaagactaaaaatcactgatttacacaaattagaagaaagaagaaaaatcaatgatttaacaacagcttttaaaattataaaagggttcaccagcctagaggctgaaaaaagtttctttttctcggaaaggcccaggaggcctttacttttgcgagtaaagcgccacacggccaaaactcaaaataattttttcaatagaatagtaaaaaactggaataatcttccagtggtagcggtgcaaattaataaggcaaaggaattcaggggtttactaaaagcaatgagttctgagtaggattttccattttgccatat

SEQ ID NO: 67428 - DNA, 727 bp, Heterodera glycines
  Genomic contig location: Contig_ID=SeqID_38696; Location=105..831; Strand=+
  SCN-specific regions: Sequence locations=1-355,378-382,405-727
atgcacgcgttttgcgctcgagctatttatcatcgggcttgtcaatccaaagcgaaacaacaaagatgctgttttaaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgctttagctatttatcatcgggcttgtcaatccaaagcgaaacaacaaagatgctgttttaaacgaataaagggcataggttattttgaagaagtgtcaaagaacatgcagcaataagcctgcaaaatctaataagtggaaaatacatgagtatagaatttattttcagaaagtgtcaacagacttttggaaaatatatttgcaatttatcaacaattttgagaagtgagttagaaatgataaacttcacgattcaaaccaattttcgttgctctaattaaccgcgataaaaacatccgaatca

SEQ ID NO: 67429 - DNA, 628 bp, Heterodera glycines
  Genomic contig location: Contig_ID=SeqID_38697; Location=153..780; Strand=-
  SCN-specific regions: Sequence locations=1-628
atgccaatttatgatatgacaccacaacacgtgggacgtggaaagacggtggccgaactgattgcggaagatcaggcaaattcaggccaggatttattggctgaaattcagcatcgtcccaaacaaagaggtgagattaagagataaaaattactaaaaaaataaatcacgaaaaaaaatcacaaatttttgataatatatccctcgaaacccgaactcaaacatgacgtatcattcctgctatcattaaatatacaaaaatgttcttttttgtcttaaaaaatttttaaaaattcaatttgagaatggctttttctgctttttagttaatattttggctttttcgtaacaaaaactacataatttttataacagatgctcgcaatatgccatcgaattatttccatttttagaagaaattaatcagctccttgaaagccaaagatctggcccatccaactttgggcaacaaatggacgagctttgggatgcgtcttctgatgaagacaaaagctgacgaattatatctttgagtgtttgaataggctcgtggcatttacgagtaaaattggacaatgacaaaattttttgtttaattgaaactgttaacatattgaaagcaaataaa

SEQ ID NO: 67430 - DNA, 69 bp, Heterodera glycines
  Genomic contig location: Contig_ID=SeqID_38699; Location=683..751; Strand=+
  SCN-specific regions: Sequence locations=1-69
cctctgtacggcactggggccaacactttatgtgtcgttaattttatgctaattctggctcttttctaa

SEQ ID NO: 67431 - DNA, 816 bp, Heterodera glycines
  Genomic contig location: Contig_ID=SeqID_38700; Location=94..909; Strand=+
  SCN-specific regions: Sequence locations=1-192,216-358,380-816
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgcccccgaaacaaaaa

SEQ ID NO: 67432 - DNA, 888 bp, Heterodera glycines
  Genomic contig location: Contig_ID=SeqID_38701; Location=143..1030; Strand=+
  SCN-specific regions: Sequence locations=1-525,573-770,793-888
atgttgagggatgatgttggcgaagcgccaaaacggaggaaaaatgacaaaaaacgtcggggacggaagaaaaacaaagtgtgaattagaaaaaaaacaattaaacgaaaactgaaacaaagagtcaaattatcgattgaaatctggtagaggtaccgtatacatacatcctgtaagagttttgacgccggttacagtaactggttttaccgttattcttttcggacatttgtcattttaccgaactgggaatttgtatttcggtacataccgtatgtatgtatcgtatgcctgaaatatagttccccccccctggggttctctatctatcaaatgcaggggggtgtattataggaaatgacggtaaataatgcaaataaatatttcagaaaaatgatggcacacaaaatcatcaaccgcttacaacagacgacattttcggcacaggagcagtgaatttgccgaaaactgaacattcccagcctgcaaaagagctgtcggaagaaacaattcttgacgaggaagtaaaaatcaataatttttaaatatttaaaattatttttcaattttaagttacccccggccccagccgatttgccaccatttgatgctttcccatcgccaccaccttcatcatccaaacgacggaacacaacaattggcacccaattaccacaattgcctgattatggaaaacgtaacttaataattattcgggattttctcgatgcccagtccccgaatccccgattttggtgccgctggagagattgattatattttcaaagtttcgagaaccgtatgcctagaaataatatccgcaccaaaaacaaggaaaatttatcgactcgagaaccgtttccgagaatcacgagctgccctagaaaa

SEQ ID NO: 67433 - DNA, 1041 bp, Heterodera glycines
  Genomic contig location: Contig_ID=SeqID_8249; Location=420..1460; Strand=+
  SCN-specific regions: Sequence locations=1-596,618-805,858-1041
  Gene Ontology: Mol. function=enoyl-CoA hydratase activity; Cellular component=mitochondrion; Biological process=growth
acttggtggaggacatctctgatcagtacgacgattctgagcaaccaacaatcatccaccacgaaccagcaacaccaacaacaatgtttgacaactatggtccgattgagaagattgttgtggtcggcaccggcctcatgggcagtggcattgcgcaaattgcggtcgagtcgggcgtcaaagtgtgcctggtgggccgtagtcaagagaagtgtgatcagacccggctgaagatcaacacgggagtgcaaaagtcgatcaagaagcgcatggcaaatgaaactgccgaggtaaacgacggcaaacatgaaaatggcatggcaaaaatgatgcaacgagttgaaaattgaaaaatgccactttccataaccaaaatttagtaattgctttcactctttaataagttttaattatcataaatattcctgatcgttttaaaaaagttaaaagtgccaaatgtctccattattcgggttttgaatcggtccaaaaatttcgtttaaacgcttttccgcagagttttttaaattaattctttcgcaatttgaaaattaagagtcaaaacaataagtaaaaaaaaaattagttattctgatcagatgaaccatcgaacatttgttttacttcaggcacaacagcagttggtcgaggcgacaatggaaagccttgagctggtgaccaacttggatgaagcgggcttgtcagatgccgacattgtcattgaggcggtggttgaaaatctgaaggtgaagcagaagctgttcattgaattggaagccaaggtgatcagaggcaatctcgaaagaattttttgatttaaaattaaattaatttaatatttaaatttaattttatttgctaataataagtgtcattcaacaaattcgaaatttataggtcagcgagaagtgtctattggtcaccaacacttcgtcctttctgctcgaggacgtatcgtgcaaaatgggcgccgccaagcgcgagcagttcggcgggttgcatttcttcaacccggtgccggcgatgaagctggtggaggtg

SEQ ID NO: 67434 - DNA, 1097 bp, Heterodera glycines
  Genomic contig location: Contig_ID=SeqID_8250; Location=1602..2698; Strand=+
  SCN-specific regions: Sequence locations=1-593,634-730,752-948,970 -1062,1088-1097
atgtacttcggctttatctgtgcaattttggcattttctctttacatgggcgaaggaatgccaatcaatccgccgccagatgaaaatgactgcgattttactaccgatttggaggttttggcggcatgcaaacaaagatacataaacaggagaagagggctgaatcctgatcaaaatgagccacgcattggcagcaaattggacaagtacaaagaacagttgaaatgtgttaagaccaatgatcataaaaggaagcggaaaattactgacgaagatcgccaagaaaaaatagaactgtataaaaggttgaagtcgaacccgaagcaaaagaatagacgaatgttaggccatttgtccaaattgttgaatgttgagccatcaaaacaaaacgcacaaactgatcagtcatttgagaatgaatctgctggtcaatcatcatcgcaaccatcgacatccgatgcccatcgatcggtttcggaggagcaatcactgtctgatgatgatcaattagtgcctgattattcaacggctgctgctgagaattcgagcaaaaatttgccaaaagaatccaccagtgaaaagcgaaatggatcagaatccaactgatcagatgagtgaacaatatgaagaagatgcgaatgtagatttagtgatactaaattttcacattttcatgagacttgcggtcttttgcatattgtagtaaattttgtgcttccaatgagcctacaaaaatttccaaaaacattttccaaccccctaggaattttttcgaaaatttccccgattttcggtgtattttcggttgtctaggtcaccatgaaggagtgatctgatcaagttggtacaaaagacttatttgatcagcatcaaaagttgtgttagcatgaattatttcagatttttcttaaattcgagattcaaaaagtggtcctaaagatatgaccacccaaaaaataagggtatgtgcgtgcgattggcctggtcgcatgtcggcctaagggaatgaatttatacgcatttagcatcattcgaaagcccattggatactctatctctttgttaaataattttattaattaattttgaaactttta

SEQ ID NO: 67435 - DNA, 381 bp, Heterodera glycines
  Genomic contig location: Contig_ID=SeqID_8250; Location=3396..3776; Strand=-
  SCN-specific regions: Sequence locations=1-381
atgaagcggcgatttgctgttgtggcattggttgcctatttgctgatcggtgcgctcactacgacttgtgaagcggccccttacgcaaaactttctaagccagtggccaaagatgatcaaaaagaacccggtgccattgtcaaaccaagccccgagaaccaagcatcattaaatcggatacactcattctccgcgtcatcgttgccctcacagtcgcccgcctcaccgccgcatgtccaaccaaaagcgtcatttcagcgggtggactcaatttcatccgcttcatcatcaaccgcaaacccaaccgctgacaatcaaattgatacactgccacccaaaaagcgcttctcgaaattgcggatcacaaaaacaaaagaatga

SEQ ID NO: 67436 - DNA, 347 bp, Heterodera glycines
  Genomic contig location: Contig_ID=SeqID_8250; Location=3970..4316; Strand=+
  SCN-specific regions: Sequence locations=1-140,164-187,212-241,285-318
atgctctcaaattctcattgcctgtcacttctctctttggcattatttgacaattttagtggtgggaagcctaaaaagatattcaacgaaaattatattttgctatttattggatttattgaattcttctgtgatgaagtgaatttgttggaggggagggagaagcttaatgtaggctgaatgtaaaaaaggcaattttacgctttattttatgtaaaaaaaattttgataggcaaaaaagatatttagaaattattattaaatttaaataaagtttaataaaacggtattgactccttttttcagatagtcaataagaattaatttaaatatttattttatttaaa

SEQ ID NO: 67437 - DNA, 492 bp, Heterodera glycines
  Genomic contig location: Contig_ID=SeqID_8250; Location=4396..4887; Strand=-
  SCN-specific regions: Sequence locations=1-5,28-492
atgggaaaaaaggggccttccttttttcgcaaaatacggcagaatcaggcgaaaatgggggaaagtgggaaaacgggcgcatcacaatggcagcgaacccatgaactgactaccgccgcagcagatgccgtcgaggctttggccgaacatcttcgcgactacaatgttgccgtgtccattctcctggtcacaattgccgccggacttgccgagatgaacaatcactacaagggcaacttcaaagggaacagaaagtgaattgtcggccgccggagtgtcgctaatttcatccttagcgacgaaaatttaaaattttatgattcatctgtttaaaataatttttcgccaaattcataacctttgtgattttaagcctttttattagtcagcattgtttacatttaaatttctgtcagcccgcctatgtaaaattgccgtatttaaaccattgcaaaatcaccattttttatcgttcaaatcgtcattaataaa

SEQ ID NO: 67438 - DNA, 100 bp, Heterodera glycines
  Genomic contig location: Contig_ID=SeqID_38705; Location=1174..1273; Strand=+
  SCN-specific regions: Sequence locations=1-100
atgggagtaaatggttcagttacggaattcgcgaacaaaattcgtgaattagtagagcaggcaagcccggatccacattatacagacgaagcaagagaag

SEQ ID NO: 67439 - DNA, 1206 bp, Heterodera glycines
  Genomic contig location: Contig_ID=SeqID_38706; Location=125..1330; Strand=+
  SCN-specific regions: Sequence locations=1-851,873-971,993-1031,1053 -1167,1189-1206
atgggcgctgaaacctattcaaattggaaacaatgtcatcaaggaaatggaaattgtcaattcccatggaaaatcattgccaatttcgcgaaaaccgttgccaaagaaaatcatcggattcaaacggatcaacatcttgtgagatatggccaaatgaaaatttttaggcaacacttcccattcatttttcagtttcatcgacaaaaatgtcatcacttttctccgccgttttcgccaacttttcgccgtctgtccaatccatttgaccatcattacgcacaatgatcgcattatgcagttccttttgcgcaacatttggccaatgctaacgaaaacattcatggcttgcgattgtacgccgtaattttctatcgtttgcgtcaattcgtcccgtcaattctcaacgattgtccatcacttcgctttgtctctttcaattttgccgatctcttcgccgaatttccatgtgatgacagtgccgcggcatcggatggacaagcattggccaaatggctgttcactccacttcaaaacaatgtgccaaagatgctcaactgctcgttgaatacggatgatggaattttgccgtcgaatattgaaccgttcaaagcggtgctttcatttatctttggtttttcttaaccaaatttcccatattttaggcttttgcctcggcttcttcccccgccaatttcatcatttacatttcgtttgcgtcgtcttttgctgcttccgttgtgccatttgaactgaccaacgaaaagactcgggaacaattggctttgaaaagggctaacgatagcgatcattttctgttgatccgttgtccaattgcgcgagaggcgagcaaatggacaaaatgggaggaggaagcgattggctgggaaattcatgatcagtggaatcgaattagcattcaagtgtatcacaaggaggaaatcggggacgggtcagcgaatattactcaaaaattatttatgtttaaatttttaggcttctcgacgaaattcccggcccaagtgaccagcagaaatgaatgaatgaattgtggaaaaatgaccgatcaatataattttttgagttgaaaaatgaatttgttgctttttgatgtgctctcataaatgctttttttttgttataatgatcaacatggattttgttttttttaaatcattttaatttggacaccccaaaaatcacagagaa

SEQ ID NO: 67440 - DNA, 411 bp, Heterodera glycines
  Genomic contig location: Contig_ID=SeqID_8251; Location=1..411; Strand=-
  SCN-specific regions: Sequence locations=1-20,84-97,127-163,191-411
cgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgtctgtttcacgcaacagcccggctgaaccgacctttagagccaattcttttcccgaagttacgaatct

SEQ ID NO: 67441 - DNA, 3535 bp, Heterodera glycines
  misc_feature (3431)..(3431): n is a, c, g, or t
  misc_feature (3448)..(3449): n is a, c, g, or t
  misc_feature (3463)..(3463): n is a, c, g, or t
  misc_feature (3484)..(3485): n is a, c, g, or t
  misc_feature (3524)..(3525): n is a, c, g, or t
  Genomic contig location: Contig_ID=SeqID_8251; Location=456..3990; Strand=+
  SCN-specific regions: Sequence locations=1-174,196-861,883-1236,1258 -1301,1324-2584,2606-2707,2729-3011,3033-3535
cctacaggtcgcgaaagtccctaggtgctgcacgggttgcgctaatccgagccccttccggtgttggctagcactggaggggggggggtccaaagaatacgtgaagcggaccctgtgttttctctgacctcatacgggtatatcccgatgatatctatacagtgttcattttcatttcttaacctgctttttcctcaagagaaatatgaccacattcgtttgccatttcgaaggtgcgacttttgagggagttctcagggacatcgagctgttcatgaacggctcgtggcggcacgcagccgcgcgggccagttagggctggtgccaatgaggcagcgaagaagtctctgaaacgccaaaagcagcgggagaagagagagaaagcggagacgggttagagataatagcatgattgacggcgaagcaatactttgacttccaggtacggaggacggcggcaaaaagcaaaaaggggacgaaaccgatggcattgccaaaggggccgaaaccattgagctggacgctgatgggccgtctgccgtgcaaaaggaggggggagcccctccgtctgggaagaaggcgcggcgccattcgtccaacaaaccggaatagatcttgatgatctcagcaattgatcatattgatctctttttccagttgttgcgataaattatcgtgcattatttcttcgattcctccaaagcttaactcttttcctaatacctactcatgtatacgttagtaggcatgttttatgcaggtaaagatagacctggtgcccccgggcgacttgggatgtggatgatggttggcggagagctctgatgacgccgtagttccggaggaacagttcctactagtgccagcctgggctagtggagctggtctggcgagtgctttgctcgtcagataaggggtggttggggtggtacctctggaatgatgtgtcggataagcactctgccttataaagctgtcgttctgcccaggtttctcctaaccaggttgaacttgtaatgagcctttgggtatctggtcggggtctgcgcggagatagctcgcgaggagctgttattacattattggttgaacgcttttgggtcgtactgcacagataaatatgagaaaaagttttttacaacatatacctgagctttcaaatcatattgctatgtctgtgcctgcgagaaattaccccaaattgcgctctttagcgcagggttcttccggcacatcaagtcataatgggaagggtgtcgcaatgcaccggtgccccagcgatgattgtgctggtaaagatccccctcagcgggggtctcaaaaagggaatttgaggagtgtgcgatggactcccagcgaggagaaagctgtcttcgagtattggtcacggttggaacagcatgccatgttaaatggtagcgaagcccgggggacctgtgccataactagaagtcagtttctcattcattgggatggcgagagagagtcaagatccttgtcggatggtgtgcccgagtacccaatgaggacggaaagggcatactatgaaagggtccgactcttgcgacaacgcggatggcaatgggattgtgctaatgaatgcttagtaattggccaatgtacagagccgtgccgtaagccaaacgtggtagtgattaaggctgataagagtgtgaagagatcgctggttaggggaaagcttttgtccctgccccatgtaatgggtgaaataaaccaagtgagcgtgcaggttgaggtgcctttgccaagtgtacccgccagcgtgccccaggttgaagaagttgaaagcaaaggtgttactgaaacggaaccgtcgaatagaccttctttggaagggaatgcggcggaagaaggattaaggaaaccggagcgagtaaacgtacctgttcatgggataatcagtgatagtgaacggaaagacctgaaagaccggttttggagcgcctataaaacggccaagaggtctgtgggttttagaccggctctaaaaatcgaaccgagtagggttaaccgtgcccagtgggaagtactggattcctgcgttgttgaggtgctcaaaaagagggaaacctccaatgggtaccgcggttgcgtcctccggcatttgaacgttgcagtttatgcggcgggatacgtgctggcggaaggcaacaaggaaaggaggcaggtgatcagacgccagtcggcggaatggttgcttcgccaaaagtccgaaatcaacaacatccgtagacacatcggttggattaccgatgagttaacacggaggaggacgggaaagaacccaacatccagacagttgagtaattttgcatggttgcaaaggcgataccaggttttgggtaaacccgtaagggaaacccgggacttggaagtccaacgagaaagacttgtaagtcgtcttcgattggctcaggaccgagttaactcttccatggatcgtgaagagcgagctcgtaaacgaatgttacccctgcggagaaagttggaagaacctttgggtgactctaaacttgacccaaagcaggcacgaacattttgggccagcctgattggagagcgaaaggaatttggaaaaatcccggagcttgaaaactgggccgaagaagtgaggagcaaagtcaccgatggacaaggtttcgcaagtgaccatgtggatcaaactgtttggaaaaagatactgggtaaggccaggccactgaaggcgcccggaccagatggaatccccaatttactttggaaacggttaccatccgcaaaccaggcgttatttaagtggttaatggggatcaagcggaaacagctcagtgtccccagttggctcacaaaaggaagggtggtcctcctacccaaaggaggtgacccggtagacccggccaactaccgaccaatcgcttgtttgaacacgcagtatagtgactggtatggtgacggcatgggtatcggaacacctgaccacatactctattttgccgattgaacaacgagcgatggtgtctggcacttgggggtgtacccatgctatggtgattgacagagcaattacgtcttatgcagaggccactggactaccgctttatgtaggctttgtggactttgcgaaggctttcgactcagttagtcaaccgtggatcaggtacgctctaaaggtcgctggagttcacaagcgaatccgatgtcttattggaatccttatgaaatgttggagcgtaaggtatgaagtgttcaagagcgggagagtgttaaggagtgcgcttttggcagttaagaacggagtgttacaaggagacacgttgagcccgctgctcttttgtctctcagtagccgttgtttcttctgcagtaggcagcctctttgattttgaggtcaccatacctggacgaggagtgatgcagcagcagaaccacttngtctatatggatgactnntaagggtttgctcntagtgaagcgtccttgaccanngatgtagtaacattggagcgaaccgcttcagccctcggnngtgaaaatca

SEQ ID NO: 67442 - DNA, 763 bp, Heterodera glycines
  Genomic contig location: Contig_ID=SeqID_8251; Location=818..1580; Strand=-
  SCN-specific regions: Sequence locations=1-243,265-763
ctcatatttatctgtgcagtacgacccaaaagcgttcaaccaataatgtaataacagctcctcgcgagctatctccgcgcagaccccgaccagatacccaaaggctcattacaagttcaacctggttaggagaaacctgggcagaacgacagctttataaggcagagtgcttatccgacacatcattccagaggtaccaccccaaccaccccttatctgacgagcaaagcactcgccagaccagctccactagcccaggctggcactagtaggaactgttcctccggaactacggcgtcatcagagctctccgccaaccatcatccacatcccaagtcgcccgggggcaccaggtctatctttacctgcataaaacatgcctactaacgtatacatgagtaggtattaggaaaagagttaagctttggaggaatcgaagaaataatgcacgataatttatcgcaacaactggaaaaagagatcaatatgatcaattgctgagatcatcaagatctattccggtttgttggacgaatggcgccgcgccttcttcccagacggaggggctcccccctccttttgcacggcagacggcccatcagcgtccagctcaatggtttcggcccctttggcaatgccatcggtttcgtcccctttttgctttttgccgccgtcctccgtacctggaagtcaaagtattgcttcgccgtcaatcatgctattatctctaacccgtctccgctttctctctcttctcccgctg

SEQ ID NO: 67443 - DNA, 714 bp, Heterodera glycines
  Genomic contig location: Contig_ID=SeqID_38712; Location=64..777; Strand=+
  SCN-specific regions: Sequence locations=1-241,263-346,368-546,568-714
gtcattttctcgaacgaaacgattcaatttgtacgtccctgacggttacgcctactattggcgtgatttgcaggaggagcagcgcttttccggcactcgttggtggatgatcagtgatagtgtgtgccggacctacggatttggaaagacgcctcttgtgtttatcgatggtggaactactccaaaggctaccaaaaagttttggaagatgagttgctgccgtacgtgggcccgttttcccgccatccatttcacatttcaacaaaacaatgcctcaattcacgtcagccgcaacaccaccagtggctcgagtccattgaacccagttattttacaatttattcggtcaaaaatgtatcaattattatatttttcacctcccattatggatttgaactattttgtagagtgaattagcaaaacgtattccagtgcaatcggaccaaaaaaatatatcagattttttaacaattttttgcggcgcatttttccaaaaaaagtttagggaaccgtagggggggggcaaaatttttgaaaatttgagtgcaatttgttaacagattttgtcaaaaaattgccctattccaaatatcaaaaacaaacgaccaacataaatattgatattttatctttttacatccaatggccgaaaaattttcaaaaaattaattttttggggtatttcttgaaaatattaaaaaatgtgactttcaa

SEQ ID NO: 67444 - DNA, 183 bp, Heterodera glycines
  Genomic contig location: Contig_ID=SeqID_38713; Location=430..612; Strand=-
  SCN-specific regions: Sequence locations=1-183
attttgcaagcaaagcgagacaagtgttggcatgcgcaattacatcgaacattcgttgactaaatttgcgacggagaacccatactgtgccatttacgttgtgccgggaaggaacgcgacgccagtgctaagggcggaatattcaaatgggcgactagtccacgtgaacgcaaaggctttcag

SEQ ID NO: 67445 - DNA, 994 bp, Heterodera glycines
  Genomic contig location: Contig_ID=SeqID_38715; Location=455..1448; Strand=+
  SCN-specific regions: Sequence locations=1-375,484-621,645-683,707 -861,885-930,954-994
atgagcgagcaaaaaccatcacaaaatgtgggaaaaacggagtcaattggacaaaaagacaccatggatgggaaacaacaaaaggcacaacaaaaaaacactttggaggacattggcacgacggcgctggagtcggagccgacgagtgaggagctgaagaactttgccaagatgttcaaacagcggcgggttcagctcggcttcacccaggcggaagtgggacaacaactgtacgaacttcgtggccaagtgttctcccaaacgacaatttgccgtttcgaagcattgtatcaaagggcggggggggggggggggagaagctcccggacaatctgtcagtggacaatccgtcagcaaaatttattttaaaacaccatattttatttaaaatcagtttgaaaataaatttaaattgctaaaaaagagaaataataatttgtattactttataaaaaattatgaaataagatattaaattatattgaagtattaagtaaatagaaatactgacggattgtccttcactaacggattatccactgatggattgtccgtccgtgccccgggggagggacgcggaacaacggccaaaaggttttatgggtggggagggagacggatagaattgacagaatttgctgataaaaattgtgagtctgtctctttgaaggcaattgtccttcaaaaacatgtgcaaaatgaagctgctgctatccagatggctcgaacaacacactgacaacgagaaggtcatccagcaaacggtgagacaaaccgcaaaaaaatgggggaagaaaacgcaaaatgggagaaagtggggggggggggggaatgggtgcaaagcaatgggcgacaaaatggttttgggagaaatattaaaaatattcgtttacacagtaatagaagcaaaattttatcttttttgtttgcttttttataaaaaaatttatttacctatttttctacctatttcaggatttttgtacctatttaa

SEQ ID NO: 67446 - DNA, 5723 bp, Heterodera glycines
  Genomic contig location: Contig_ID=SeqID_1081; Location=28..5750; Strand=-
  SCN-specific regions: Sequence locations=1-65,100-374,396-531,553 -981,1003-1141,1165-1764,1788-2635,2674-4936,4959-5604,5638-5723
gttgcgcagttggtgcagcccatcctcgtcaacgcgtcccaccagcaattggcggtgcttacttgttttttttttgttttttaatttttttttaattttgctatttgtaatttcaggaacctttttgtgcggatggaacgcacaacattcaattcttgattggatgcgttgctgcgttgggtcagccattgccgtaagttgaatttacaaatcgatatttaaattgtgcgcgagtttttttagcccgctgtgcctgatcgtcgtgtcggttgaccatcgccctgcgcagcagacgccagctgggccacttgccgtgacgaactgtgtgcttcgcacgggtgacggccaccgcgttgaagcctcgggatggcaggcgcatgcgggttcgctggcggccttgtgtgttggcagtgcctactggttcaccaactgcgtgagccgtgccaaataccagcgactggactgctggttccgcattggggttggaggccccaatgcgcttgtggtgccgcacgtggccccagaggtaagtttttttttaaattttaaattgatatttcttgaaatttatgtttagtttccggcaaacattgcaccagttgtgcccgttcaagttggcgcagggcgtgatgcagtccgggcgctgccaaacgtgaccaatgctggtgatgaacaacgcgaggacgcggacctggacaacaacaacaacaacaatgtgaggaattgatctttttattacgatttgtgtaattttgttacattgtgatgaataaacttttggtctcaggacaatcatggtcttgagccacgtccgagtcgttgcgcgagtcgaactgctggtgcgcgaccaacacaaagacgggctgctgaaccggttcgtttgagggtccgattcgatttgtcccccgatattgaacaaatcccgagaggagaaagacaaaagccatatcccgcccgtaaaattcgtttgctgcccaattttgacatttcacccattcacattgaaaaatcccttgactgcccaatttgcatgtgctcctttgtgattggggagggggccacttctctccattgctttcatatttttcacacgggttgtattgttccttggcttaggatccatcgttcttgtccaacttgtaaatatttattgccatgaataaatttttgaattaattaaaggcagagagatcgattgatgaatgctttgtgattgagcgctcaacagccatgcggaacgtcccacgcaacacacggggcgagatttgtgaactgcgcttcctgccgctggaggaggcacagcggcctgatcttttgatggagacgatcatccagcaactcctcgaccgtgtgctggcgggtcacccacgcccatcgatggtcggacttcagctccacccgccgggatttgatcgcccttatgtcatcgggcttcgtccgccagagcaacacaacgcagcggcattggcggcagcaatcgagcgtctcaatgagcagtcggcagccggcattgacttgcttgccggaacaacggtcaccaaagtcttggcggtctggccccttgactccattcgtgctgacccccaaaggggaggtgaggtgccgttcttattgcattaacgcattgataaaaaataggagcctgtgacagtgacgtggagcaccatgtttccaataacgtgcagtcacttgtccggattcacaaccccaacgaccggctctgccttgcgcgtgccgttgtgatggggatgcatgaccgcgagacgcgaatggctggcggtggcggcaaagcggcattcaacctgttcgccagtcgtcaagaccaacacggtccggcagcagcgcagatgctgactcgtgccggcattgctgccaacagtgacatgtacacgctggacgatgtccaacgtctccagcagtggatcaacaacgagcacggtgtgggccaaattcgcctggtggtgcttgaaaaggagcaggaatatcgcatcgtcttcaaaggggaagggtgagttttttttcattttttttggaaattggttgattgaagattggctgcgaaattcaacctttgccttgtgttggagcgcgggcacttcaactacattggacgagttgagcagctgtttgatgtgcccaactactgcatcgactgcgagcggagggctgacgcgcgttaccacgcgttcggatgcaaagttgtgtgccgcctttgtttgcggtacgggcctggttatccatgccaaactgaacaggtagatggatgccaaaaaaaaaaacaatttgtgtaaaaaaaaatattaagctaccgaatggtggaagtagtgctcgaaagtgcgctgattgccagttcgtcttcccaaacgatggctgctacaacttccatttggccaacaatcctccagctccaatggatgggcgtggacagcgtcaacgtcagccaatctgtcaatggcgccgggtgtgtcgtgcgtgtggacgtatcgcctacgtggccacacatcagtgcccacgtgaccaaccagccgacgatggaatctgtcggcgctgcaatgggccccacaccgtcgatgagccttgctacatccagcccattgacgacggctcagttcgacaacgtgcatcgattgctgttgacaacgacgattctgacgacgacgacgacgacgatgaagaattgccgcttcgtctctgcttcttcgatgccgagacgtcccaggacacgccattacagctgaacaaccgcaccgtccagaagcacgtgccgctgctcatcgtcgccgaagtcatctgcgaacgttgtctgcaggctggcatcagcgtgagcgatggccttggaagacgggctcctggctgcgtctgcatgacaggaatggtgaggggtcaactgtttcgccagtggtcttcgccaccctttgccaatgcaccgggagacaacagcgcttcgccagttggagcaccagcgttcaaccagcgccgcttcttcttccattcgtttgacaacgacggcaacgacccagtggaccaatttttggattttttgctgcaccatggtccaaagaaggcacacaccgtgtgcatcgcccacaacggtggaaagtacgatttccatctcgtacttgaggcactacaccgccgaaaccgtccacccaagcatctgtgcaccaccggattgaagatctactcgatgcgtctgtccgggcgtcaccaacggcgagtcacattcaaagactcaatcaattacttcttttgtgccttggacgcgttggtgaagagcttccaagtgccggaccatctggccacattgaagccattcttcccttatctctacatacgacgacaacatctgtcgcagcgcctcatcaatcttccgtctcaagagttttacgcaccggatacgatgaaggcagagaaacgggcgcaatttctccgttggcgttggcacgccgacaacaacggcaatggattccagctacgcgagcagctcataatgtactgcgtcaacgacgtggccattttgagggagtcggtcatccgattccgccaactcatcgccgacaatactcaaggcctcgacccattcctccacgcgtcaacagctgctggtcttgcgctggcaacttttcgccgctgtttcctgcccgccaatcgtctggttcactcacccgagggcggctacttgcgcggacgccgtgcttcggcagaatcgcagcgctacatccgcttcttcgagctggagcacccggaggcgcaagtgcagtgcgccagctggtcggtcggagaggcgcacattgaggacagtggctaccgcgtggacggactttggcgacgagaagcgcctctccgtcccctggccattgaatggcttggatgctattatcacggtaaaggcttttttccgtttccaaaatatcttaaaattgaggctgtcccgcgtgctttcccgaccggcagcaacaattggcggcagggcggacagcggaagatctgtacgaacggacggagcggcgcctctttgagctggagaatgaccacggctgcgaaatccacaaagtgtgggcctgccagtggacggagcggctccgccacgatccgaacctgaagcgccgttacgatgctgtgttcgtcccttgcccgctggacccgcgcaacgacgcactgcggggagggcgcactgaaccgttcaagctccaccacgtgtgcagtgacgacgaggagataatgtgcattgacattgtcagcctctacccatacgtcatggtaggtttttcttttaaacattcgcatattcatgatgaataccagaaagccaatcgcttccctgtgggcaacccacgggtcctgacgcgcgaggtgctgctgcgtccgccaacggtaccgctcccgtggaatgcaccggaaaacaacatcttccgggggctgctgctcgcccgggtgctcgctccacgcaacatccgggtgccgttgctcggctaccgcacaaaggacgggcgattcaccttccctttgtgcgcgtggtgtgccgaccgtcggcagcagcggccgtgccgacatgaagacgacaagcgctcgtgggtgaccgcctacacccacgtggagctcaacaaagcgctccagcttggctatgtggtcaccgatctttttgaggttgtccactcattaaaaaattttgtgtacgaaaacacaaattaggtctgggactacgaagagtgggacggtacgctgttcagcagctacgtcaacaccttcgtcgggctcaaagtgcaggcgacgggctggccagaaggatgtgtgacggatgagcagcaaaaggcatttgtagacgattttgagcggacggaaggcatccgcctggactcgaccaaaatggagttcaaccccggcctgcgcctcatcgccaaaacattggccaactccttgtggtaaatattttgggttttaaatttaaaaaaaaaaatgacatccacagggggaagctagcgcagcgcgtgggccagacggagatttgctacacgcggactccggctgaattccacgcgctcctcgacgacccaacggtggacaagttggactttgtccacgtgtccgaccacatggaccgctgcgtcgtgcggaagcgaccggaattcgccaaagccccgctgaccaactgccttccggtcgctgcgtttgtcacctcatacggccggcttcatctttacgactacatggagcaggtgtcagccatcgtcggtgcggagctgctctactgtggtatgtttatttgtcacgaatggtttttttggacagccctttgttttagacaccgactccatctactacgtcaacaagatgggtggtccgtgtgtagcagagggcgaggctctggggcagatgaagcgcgaacacaccgaccgacggatcgtcgagttcgttgcgggtggccccaagaactacggcatccgccacactgcgcgggacggcaccgacgagcgcgccaacctcaaaatccgcagcttccgcctgtcctatactgcgcagcagctgctcacctttgaggcaatgaagaacctgacgctggccacgtacaacattgacggaccaatgtgagttttgcaattaagcattaattttgtaaataaatttaaaaaaaatttagcgatgatgccttggacaatgacgacctttacgtgtacgggggcggcgaacatcgtgccatccgcgtcaacttcccgcaaaattga

SEQ ID NO: 67447 - DNA, 696 bp, Heterodera glycines
  Genomic contig location: Contig_ID=SeqID_1083; Location=2610..3305; Strand=+
  SCN-specific regions: Sequence locations=1-108,257-259,281-479,502-696
atgaaattccgcctattataccttccaattttattttttgtgattgaaatcaatcaaattaaaatagaaaataaaaaactaccgcaaaaatcatttgatgaaatatttggagaaaaatgggaagaaaaagaaggaaaacaacgaaatgagaagaataaaagagaaataattgaaaaatattataaaataaaagagaaaataaaggaaaaaggaagaaaatactcagaaaaagaatggagaaaaattgaagtaaaaatagcgaaaaaattggggacaaatcgcacatatattcaaaaatggaataaagaatttggtcttcaaaaaaagaaaagctataaatcaaaaactgatgaagaaaaacgtcaaattattcaaaaattcattaaaatgaaaaatgaatttaagcaaaaaagaaaatattcaagaaaagaatggcaacaaaattatgaagaaatttgtaagaaaattggcgtaaaccgtggaacaattaagaaatggaagaaacaatttggcattagctgtaaaataacggagaaagaaaaaatggaaaaaatgaaaaaatattggaaaataaaaagagaaaacccaaaaatgagtgacaaagaaactgctaaaatattgcaaattgatagaacgaccatttcaaaatggaagaaacagtttggaggagagattttggaggatttaaatggatga

SEQ ID NO: 67448 - DNA, 662 bp, Heterodera glycines
  Genomic contig location: Contig_ID=SeqID_8252; Location=3927..4588; Strand=-
  SCN-specific regions: Sequence locations=1-153,176-438,461-662
atggaccagcagcaaaaaattaaaacaaaacgaaacaaatttaagttagaacatgacggcgcactctatgttttcgaccaattgagcgcagatggacttaagaaattttggcgatgtgagtttcatggcccgtcagacaaatgcaagggtatgttaatatattatttttaattttgcaaatcttttaaaattcagggcgtttgcacacggatttaaataacgttgtgcagaagttggtcggagttcattcgtgcgacatgaatgctgcgcatgtggaatgtcagcgacttgtaactggactcaagcgacgtgctgctgagacgtgcgaggcatctgcgactattcgtgctcaagtgctgcaaaacacatgcacacctgtgttagcagcttttccgagcaaatacgccacaaaaaaggtgggtttatatccaaaaacaattttgttattattttcttttttaggtaatcaaacgtttgcgccgtgatgaaaatgcaccgcgagtcgaacctctcaatttggagcagttgtaaattccaaatacctatcgtatttacaagcgaactgaaattgacgaggaacaatttctattggcggacaccggcgtttttcaaattcaaggacaaaatggacctcaacggtgagacatcatttatacattaaa

SEQ ID NO: 67449 - DNA, 197 bp, Heterodera glycines
  Genomic contig location: Contig_ID=SeqID_8252; Location=6..202; Strand=+
  SCN-specific regions: Sequence locations=1-197
  Gene Ontology: Mol. function=general RNA polymerase II transcription factor activity; Biological process=transcription from Pol II promoter
agagatcggtgaaattgccggcgctaccgaagtgaccgttcgtcaaacgtaccgtctcctcctgcccaaggctttggagctgtttccgcctgactttcgcttcgagacgcccatagatcagttgcccacttcctgaaaaggcgcaatttgggcttttcttttgaatgcgtgtcaattcgttcattttttccgttcat

SEQ ID NO: 67450 - DNA, 1738 bp, Heterodera glycines
  Genomic contig location: Contig_ID=SeqID_8252; Location=2902..4639; Strand=+
  SCN-specific regions: Sequence locations=1-84,111-515,537-978,1002 -1227,1250-1512,1535-1738
ttcttgactttttaatttttttatttcttgcggctagtatcttctacaatactttgtcagtttggtcggatgtgcatcaaacggaaaaaataattaaaattttataaaaacacataaatagtgaaatgtccgcatcaattgccttttgctcacatctgatcgtgtcaatgaagcgccaaattgttggatgagtgcagctaaattgccgctgaagtttgcgatggaatgcctcggcgaagttgttggtacgatcagcaccatctaaggtgcgctgatgaacattccattcgtgcgggtggaacagaggcgccgtcattggaacattgaaacgcattcggccatgtagttgtccaaaaacctagaaaaataaaaaaatcataaaattcgccttcggacttaaccaattgaaaacgccgttaagttgtggtggaatttgtgctcgaagaacattaaggccattttgaaggtggtgcacaggcagaaaggccaatgaagtgatcatcttagacttctcggcgaaagcaggatcagtgttgtaagcctaaactactaagaaaaaaatttatcatctgaaaaattcaattgacatgtgtgaggccaaggattctgatctgcctcttcatgttgcggacaaggtgaaaaaaacagtagcggtcactgcatgccggaagcactgtgcggaccgcaccgacaattgccaactcgaagtccatcgaaattgtctgcggcgcgaaattcggccatcgttccaaaagaagctgtaacatgcgcgtataaattgcggcacacttaaatgttaaaagacagtagcaaattggaaatacccaaccatctctcctaaaaagattgaacattgtgataacacaattaactttactttgccaacaacacataaatttggctgaaaagcggtggcgtcaatgaaaacgtgccgtccgcgtaaatgtcactcatctgatgggcccaatccgccgtagaagctcttccaaaaatgagaatccttaataccggttcaatgatcagcatttaatgtataaatgatgtctcaccgttgaggtccattttgtccttgaatttgaaaaacgccggtgtccgccaatagaaattgttcctcgtcaatttcagttcgcttgtaaatacgataggtatttggaatttacaactgctccaaattgagaggttcgactcgcggtgcattttcatcacggcgcaaacgtttgattacctaaaaaagaaaataataacaaaattgtttttggatataaacccaccttttttgtggcgtatttgctcggaaaagctgctaacacaggtgtgcatgtgttttgcagcacttgagcacgaatagtcgcagatgcctcgcacgtctcagcagcacgtcgcttgagtccagttacaagtcgctgacattccacatgcgcagcattcatgtcgcacgaatgaactccgaccaacttctgcacaacgttatttaaatccgtgtgcaaacgccctgaattttaaaagatttgcaaaattaaaaataatatattaacatacccttgcatttgtctgacgggccatgaaactcacatcgccaaaatttcttaagtccatctgcgctcaattggtcgaaaacatagagtgcgccgtcatgttctaacttaaatttgtttcgttttgttttaattttttgctgctggtccatattatataatttaaatagccttaatttagtttataaactcattaaaataaa

SEQ ID NO: 67451 - DNA, 405 bp, Heterodera glycines
  misc_feature (401)..(401): n is a, c, g, or t
  Genomic contig location: Contig_ID=SeqID_38726; Location=1115..1519; Strand=+
  SCN-specific regions: Sequence locations=1-150,175-405
atgagccaaaaccgtgacgaaaactcgcagccacctgtacccgatggaccgtacccgctggcacaagagcgcaatgagtttgtggaagatgaagcaccggtgctgcttgagatgttggatcgtctgtcacaaggagtgggttttgttttgaattatttaaattttttaatttttccattatggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgttatacaggnttga

SEQ ID NO: 67452 - DNA, 930 bp, Heterodera glycines
  misc_feature (8)..(8): n is a, c, g, or t
  misc_feature (16)..(16): n is a, c, g, or t
  misc_feature (82)..(82): n is a, c, g, or t
  Genomic contig location: Contig_ID=SeqID_38728; Location=39..968; Strand=+
  SCN-specific regions: Sequence locations=1-109,131-673,695-751,785-930
atgtgggnaatggaanaccaaggggatatggaaatggagatcgggggaaatgtggaaaatcagagggtgaggaatgtgaaanatagggggtacaatcataactaacttatgttttccagggatggctttctcaggatgaactggtgatgcgaagctcgtcagacgagttggacaagctgagcacgtgccttagtgaggtgggctttcaattgcttattgattgatcagtccgtcctatcaaatagtgattattcacgtcatattaaatattgactgaccagtctatcctgtcaatattgatccatcagtctgtcctattgaacaattattgatcatccgtcttattaatattattgatcaacctctttgatcagtccatccatcaaatagtcaccttttaatattgattagttaatttgattgatcagtccgtctttgattgatcagttcattctattaaatattggttgatggtacgttctatattgatttattagtccgtcccattaaatattgaccagtccgttctaatgattaatcaatccgttacattattgattaatcagtccgttctgttattgattgataaacaaacaaatcgttttgcaaaattggcttctcttatcgaattgtcttgtcaaatatcaaacaatcagtgccttttctccgttcgttttggtttttcatgtgaattcactcgtccgtcccttcgttgagtctgtcaaaatggcattggcatttattcattcttttggcattttgttttcctttttccctcccttttaggcttcctccgaaactcaggagcgtcgtcgtccctctctgatcagtgacattgtgcaggcgcagctcgccctttggactttggtgctcaccgttttctattcctacgcttggcagcagcaccgcaaaaagtttctcctttctctg

SEQ ID NO: 67453 - DNA, 539 bp, Heterodera glycines
  Genomic contig location: Contig_ID=SeqID_38729; Location=76..614; Strand=-
  SCN-specific regions: Sequence locations=1-110,133-283,312-539
atgtccaacacaaaggcggccggccaaagcgccgccggtgcatcagaaattgcggaccaagttgaacaaaaacacaatgcgatgaaggtgagaaacaatttaaaatgatatgtatagaaaattatttaattgtgtaaatcaggggacggtccccaagattttctacttgggttttaagggggcgggaggtaacaatgaaaaaatagatcagtctgctgtttagttttatgcatttggcatgggttttcggatttccgaaaattaatttatcaaattctttcccaaattaaattttttgtttatttttaaatgtggttcagagaggatcatttttatgaaacacctaataatgcctactataattaattttttaatttcagtccacttacgacaaagttctagctttattggaagagaaagaaggcggaaatgaggagcggaaacagcgggcggaagagttgcgcaagcgcacaaccgaattgttggcaaagattaagcggagtcgggaagagaaaatttgtgagctatttttttattaa

SEQ ID NO: 67454 - DNA, 508 bp, Heterodera glycines
  Genomic contig location: Contig_ID=SeqID_38730; Location=85..592; Strand=-
  SCN-specific regions: Sequence locations=1-149,171-361,424-508
gcacatttgggcacagttttggggattaaaatttaaagcatttacccaataacttaaaaaaataaaacaattctatcattaactagcagttgttagacttgaattttttaacgcttacatacattaataaggggggggggggtgtcgacaaaaaattttttggtttaattattttattgattgatggctgcgcatttgcaaaaaatattgggcaaatggcaagaaatttaaaaaaaagtatcaggttacgcatttatttacaggcataaaagaatgcaaaattctcttaattcttccttaattgtcctcctataaaaacattaaaaaaagagaaaaaatccaaaatatttctagtttttccaaaattatttttattttataagatttttaaaaattttctatttgaaaattttttttttttttgagttttgagggtaagctatatgacgggtggtgggggctatctgctcccgttttcccctccgttttttcaccccttctcatttgc

SEQ ID NO: 67455 - DNA, 784 bp, Heterodera glycines
  Genomic contig location: Contig_ID=SeqID_38731; Location=217..1000; Strand=+
  SCN-specific regions: Sequence locations=1-26,48-511,555-784
atggaagaaaattttggtcagccaagtgtgagaagcagaatgttggcacaaggccgtgcactgcgagaaagagttggccgtgaaggcaaccaaaatcagattttggctgaaaaggcattccgttttgaatttgaaaggcagtcagcgcactcaagttcggatgagaaaagtttgggaagatccgggtatgaaggccgagcagagcaagagcaaactttggttgaagggctaaaagctgaattgctgagagtgaaggacgaacgagacgtggcagaggcaaaagtcgaaattttgctacaaaaattgtcggacaaagaacaaatcttcaatttcctaaagaccaacaacgttaaactgctggtggaaagagagcaaattcgttgtgaattcttgtcaatggaagatgagttgaagacggtaaaagaaaaattggaaatggcagaacaggaaaatggacatttttcaattctttctgtccaacaaaatttgatggcgcaggagcagagtcgaaaaataatggctttgatggaagaggttgaagaaatgaaggctaaaaacagcggtgaacaggaggaatttcttaaaaattccgaaaaccgaattgctgaacccaaaaaatccgtctccaaattgccactcaaactaaacattgtcaagaaaaggaaccccaaaatcgccaaaccaaagaaaatttcccaaaaaccggaggctggaaaatgcaattttcttccactgaattcaatcattttccggaaacctcctccgcaattcaaaccaaattacc

SEQ ID NO: 67456 - DNA, 585 bp, Heterodera glycines
  Genomic contig location: Contig_ID=SeqID_8253; Location=1119..1703; Strand=-
  SCN-specific regions: Sequence locations=1-25,47-66,88-498,521-585
atggacaacaacagtgccgacccggtcaccaaacaacttctgcaaatttgtgttgcacttttgcagcaagttcaaaatcaacaggccgtcatttccgagcaagaccaccaactccaacacttccgtcaacaaaaaatgatggaggaggccatccaggatcacgagcggcgccgaagtgtggtggtgcaaggactgcccgagccggccggagacaaaccatcggaacgagtggctgccgaccggagcgaattgtcgcatgtactcgacgagcttggcgtcgagtgcccgatttctagctatagaatggggcctccataccaagctggttcaggtcaccgcccgcgcttaatcaaaatcattctcccggcctcaaaattccaaaggcagctgctggcggaatggaacaaaaaacgggcccacatcaagcaaagtgggaagtggcaacacctgaacattcgaccatcgctcagtccggcagaactggaggagcgcagggcgatgcaaaaagaatgcacagagcgaaggaaggccgaacccaacgccgattggatcatttacgccggaaacattgtcaagcggtcggag

SEQ ID NO: 67457 - DNA, 358 bp, Heterodera glycines
  Genomic contig location: Contig_ID=SeqID_8253; Location=1797..2154; Strand=+
  SCN-specific regions: Sequence locations=1-25,48-53,76-291,313-358
atgggaagaaggacgctttccaaacatgacaaatttgaaagaaatgtcacattctttttggcggttcttggactttcaatcgcccttttcatctatgtgtcggccaaaattgacactgttgcgtcggatatgagcgacgagatcattacacttcatgccttgcagtccaaatttaacgagcactacaatgaaatgcttaaatattacaattctcgcattttggctgcccaatcggatttcaattctcgttacgaccggcttcaatcggaatttattcaaattcaatcagaattttggaaaaaatcaaacaagttcacggagcgtatagtcaatttggagttggagttcaagaggtaca

SEQ ID NO: 67458 - DNA, 1730 bp, Heterodera glycines
  Genomic contig location: Contig_ID=SeqID_8254; Location=23..1752; Strand=+
  SCN-specific regions: Sequence locations=1-116,148-282,306-317,366 -562,629-807,853-960,989-1086,1108-1109,1150-1241,1263-1282,1311 -1344,1366-1469,1500-1730
atggaagatgggctgccgttgccaatgccaccatcaaaagccaaagtcgccgcccgacagaaggccaagacttcatcgacaacaacagcagcaaaagtcgtcgccacccaaaatgcctgctgctcatcatcatcatcaacagcagcaaatgttcctcagccgtcgtcgtcgtcactttccgccgccgaagaattcgctaaacaaaaaaagcggaataagaacaacaaaaacaaattcaacaaaaaacaggcaagctttaataaaaagtttaaatttcatagcatttaaataattaaaaatattaacctttcatagtcttttaaaattattataaaaatggttttaataattatttttaaaaatatcttccaaatttcttttctttttagccgccgcccccatcaatccgcattcctaagggcaaaacgccgaagaaggtccgtccacgccgcccggaacccgaccagccggacgaccaatatgagcttcgggcggtgttggcgaccgccgaagtggtgtccgggggcacgacacatctgtgtctgtatgtggatttccttggtataaaaattttttttgaatttttacactaaaatttctatttaatttcgatttaatttttaaatttcagattatcaagggcaagaggactggtgtttgtcaacgaaaagcgacgccctagaactgacgcacttccacgacattgactcgacaatggactctacgctccatgcaattgtgggccgaccggtggcgccatttctgcaacaacggcttaatgctcgcccactttttcatcaacgtaagaaaaatttttcaaaatttaaaatttttgaaattttttattaattagtgcgtcagcagcagcaaaatggtccgcaagtggtcgagcaacaattgccatttgtgttttcatcttctgtcgatgtcacgccagcgcaaagggcaaaggtggattggtctttctctctctttctctttctctctcacatttcataaagtctgggtgttgatgggcaggccttccctcgtgttggtccccccttcaatgcttatctcggagctgtgaaaggcggtaggcaggccttcctccgtgttggtccccctattgttttttgcttctcatttctctctttctctctcacatttcataaagtctgggtgttgatgggtaggccttccctcgtgttggtccccccttcaatgcttatttcggagctgtgaaaagcggtaggcaggccttcctccgtgttggtccccctattgttttttgcatctcgtttctctatctctctctctctctctctctcacacacatttcctcgtttctgtgttttgataagcctgaccaaaaatatttaaaaattcaggcaaatgcattgtttgaagcgttcaaagtgcgagaaggattgaacgaagagtagaaaaaggaggaaaagtgcggaggaagcagatggcgaacaacaacaaaaaatggcacaaaaattttttaaattttcattttgtatttccaaaaattaaacggaagtgtcacggggtggctgatttaaccatttgtttttttttttaaattttttcactcaattaacttaatttcacacgttttttattaaactttttgaactttacgggtctttattgagataataatgcaaaggttagaaaatgtcgtccaattaaaaaaaaaggtttacataagatgattaggttaatgaattaagtgatcgata

SEQ ID NO: 67459 - DNA, 633 bp, Heterodera glycines
  Genomic contig location: Contig_ID=SeqID_8254; Location=881..1513; Strand=-
  SCN-specific regions: Sequence locations=23-126,148-181,210-229,251 -342,383-384,406-503,532-633
aaaaaatttttgtgccattttttgttgttgttcgccatctgcttcctccgcacttttcctcctttttctactcttcgttcaatccttctcgcactttgaacgcttcaaacaatgcatttgcctgaatttttaaatatttttggtcaggcttatcaaaacacagaaacgaggaaatgtgtgtgagagagagagagagagagagatagagaaacgagatgcaaaaaacaatagggggaccaacacggaggaaggcctgcctaccgcttttcacagctccgaaataagcattgaaggggggaccaacacgagggaaggcctacccatcaacacccagactttatgaaatgtgagagagaaagagagaaatgagaagcaaaaaacaatagggggaccaacacggaggaaggcctgcctaccgcctttcacagctccgagataagcattgaaggggggaccaacacgagggaaggcctgcccatcaacacccagactttatgaaatgtgagagagaaagagaaagagagagaaagaccaatccacctttgccctttgcgctggcgtgacatcgacagaagatgaaaacacaaatggcaattgttgctcgaccacttgcggaccattttgctgctgctg

SEQ ID NO: 67460 - DNA, 913 bp, Heterodera glycines
  misc_feature (840)..(840): n is a, c, g, or t
  misc_feature (857)..(857): n is a, c, g, or t
  Genomic contig location: Contig_ID=SeqID_38732; Location=77..989; Strand=-
  SCN-specific regions: Sequence locations=1-20,42-274,296-550,572 -789,811-870,892-913
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaattttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttttacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaataagtatttctgggacttttcagaaatcagaattaattctccnatgtggccccaatttangcccccagcacagccccttgctctcccagttttaagtcttggatttgtcaaataaa

SEQ ID NO: 67461 - DNA, 309 bp, Heterodera glycines
  Genomic contig location: Contig_ID=SeqID_38733; Location=565..873; Strand=-
  SCN-specific regions: Sequence locations=1-309
atgtccagagtcacgcagatggattgcatcagggtgtacgcgccgttcagccaaagtgggtccgggacgcacatcgagaacgtcgtttacctcgagctgttggacttggagacgcagcagccgaggacaccgaatcgtggactgatggacgtggacaatgacccggacgcagcaataccggacgtgggcccaagagtaccggacgtggacaatgacccggacgtggaacgagataatggaaacgcagcgggtgcaaacgatcaagaaccaaatgattttgatagttcttttgatgatttttttgattga

SEQ ID NO: 67462 - DNA, 438 bp, Heterodera glycines
  Genomic contig location: Contig_ID=SeqID_38734; Location=50..487; Strand=-
  SCN-specific regions: Sequence locations=1-438
aaaatggtgtaagtaaaaatcgtaattacgctcaaaaagcttctcaaacaattttagcgcttccaattcctttctacaatcgcctttatacatcccattatgagcgctaaaattatcagagtgccgaaaatcgcatgtgatctaagcctagaaaaaatggtgtaagtaaaaatcgtaattacgctcaaaaagcttttcaaacaattttagcgcttccaattccttatacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 67463 - DNA, 187 bp, Heterodera glycines
  Genomic contig location: Contig_ID=SeqID_38735; Location=1078..1264; Strand=-
  SCN-specific regions: Sequence locations=1-31,53-100,140-154,178-187
atgttgtatttggatgtcaaagaaaaaagctatcgtggaaaaagagctggcgccgaaacgcgagcgccgaaacgcgtgggtcccgtttgtacagtctttctaaaatattttatgaattttaaaaaaatactatttttttcagaaaatttttgtgttttaaaagtaggtatttaaaataacaaataaa

SEQ ID NO: 67464 - DNA, 274 bp, Heterodera glycines
  Genomic contig location: Contig_ID=SeqID_38736; Location=12..285; Strand=+
  SCN-specific regions: Sequence locations=1-62,104-274
atggtaggggacgattgagtgcaggcactctcgactgccaataaaattgattttgccttctcattttttaaattatttttttttactttttctaatatttattcccatttcagtgcagaaatcgtacgtggcaacaaaagcgggacagtaaacaaagaaaagaggaaagattgaacgcagcacgtgcgcaaattgatgctgatgtttataatggaaaatttttttttcgcagataacttttttgattttttcgcattattgatcaatttaaaaa

SEQ ID NO: 67465 - DNA, 138 bp, Heterodera glycines; identical to SEQ ID NO: 50950
  Genomic contig location: Contig_ID=SeqID_38737; Location=375..512; Strand=-
  SCN-specific regions: Sequence locations=1-138

SEQ ID NO: 67466 - DNA, 778 bp, Heterodera glycines
  misc_feature (57)..(57): n is a, c, g, or t
  Genomic contig location: Contig_ID=SeqID_38740; Location=383..1160; Strand=-
  SCN-specific regions: Sequence locations=1-424,446-645,667-778
atgggaaaagaaagacgaagcgaacgggtcgaagaagagacagagcaaaactcagcnagatgagaaaacaacgggcaaaaggcccatggaagagaaagggacgaaaaaggacggggagagggaaagagcggatgagggacagagacggacagaaaggcgaaggggtaggccatgaacacaagtcaattcggtaatagtgccgattgtaattattgctaaggcattgacagaatcgtacaataatatgagcaattagaattttcgaaaaatgtccgaatttgggtacatggttcgaaattgagccgaaaaagtcagattcgtgctaagtgcctcggattaaccctgaaaatatttttcgaaaaatttaaagaagtcgaaacttcaaattttttgagtttcgcagttttgctcttaaaatggtttaaatgtaaggaaacaaacaaaatcatctaagtttcaataaagaagacttttaaaccattttttagataaaaaatgctaaatgtgaaaatgaaaaaattagatttttttcgaaaaaaggagactaacatcgtcactattaccgtcaattctacccaattcatttcagataacacattgaataaccctgagtatcgaaacggagaatgtttcaaaattgaatcgcactccttgccctcttccaatgtttcaaagcccaaccaaccgccacattttgcctcttcgtcacttctaaagccagtcccaatgtcgaagagttcgtccaattctttgcacgttggcatcgcatcaactcaaa

SEQ ID NO: 67467 - DNA, 733 bp, Heterodera glycines
  Genomic contig location: Contig_ID=SeqID_38741; Location=299..1031; Strand=-
  SCN-specific regions: Sequence locations=1-105,130-224,246-254,276 -383,405-429,458-698,720-733
ttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagaatttgtattcatcgccctttttgatagtaaaagcatcagagtgcctaaactaacatgtaaataaaatttggtgcgtttcagaaccctttctgaaaaataatctttttgaattaattatgcaaaaaacaaataaataatgaactctcttccttaatattttcctgcaccgtcggttttgatagaaaaagcatcagagagccttatttaacttttaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataa

SEQ ID NO: 67468 - DNA, 1273 bp, Heterodera glycines
  Genomic contig location: Contig_ID=SeqID_8255; Location=69..1341; Strand=-
  SCN-specific regions: Sequence locations=1-488,510-572,594-596,619 -819,843-931,965-1273
  Gene Ontology: Biological process=mRNA splicing
atgtcttccttctacatcaatgaaccagtgacaaatgggaaggtaattatttcttgctgattgtgatatgcttttatttaagttgtatatctttaggtctgtcttcaaacaacaatcggagacattgacatcgaattatgggcaagggagtgtcccattgcttgtcgtaactttgtacaactctgcttggatggctattataatggttgtctatttcaccgagtcatcaaaaacttcatcgttcaaacgggggaccccaccggcacgggccaaggcggcgagtcggccagcggagagctgtttaaggtggccttttacacttgtttctttgtacatcttttttcaaaaacttcgattttgtctgttttagagtgaatttcatcagcgactcaaatttgaccggcgtggacgtgtcgggacagctggcgaaaagaatttgaatgggtctcaatttttcattacacttgacaaagccaccgaattggacgggaagcacacagtgtttgggaaggtgggcaataccaaaattacaatgtaaaacaaactgacttttattttaggtggtcggaaacacaatttttaatcttttgaagcttaacgaatacgaagttgacaaaaatgagcgtccaatttacccacataaaattacgagcgccaaagttttggtgaatccatttgatgacattaatccgaggaaagcgacaaaggacgatgagagaaaaaggtccaaaagggagaaaaacgcaacaaatgtcgcaatggcagcgaccaaacggaacacttcgcttttgtcatttggagacgaaattgaggaggaggacgaacaaagtgaacatctgaccaaggtaattcagagctgacaataatatttgtactttttatttttctaaatctcttttaatgcgaattaatttttagttcggaaattcagttaaatatttaataaaaaattaagatttattttgaatttctttagaagtttaaagggaaaagtgcgcacgatgtgttggaggatgagttgttgagcagagagagggcagtgaaagcggaggaattgacgacgagcggagaccaaagagaggcggaggaagcggacgaaagaagccgagaagagcgactggacagagtcaaacggaagttgcaggaccaaagggaggggaaaagggcgaaaagagcggcggggggaaaggggacgacgaggggagacgaagaggaggatttggaacaattggtggacgatgagaaggaggcgcaacgacgggaggaaatgtga

SEQ ID NO: 67469 - DNA, 1697 bp, Heterodera glycines
  Genomic contig location: Contig_ID=SeqID_8256; Location=390..2086; Strand=+
  SCN-specific regions: Sequence locations=1-54,78-103,125-355,377 -951,973-1028,1057-1305,1327-1697
ttttcccggcggcgcctatcggctccgccggacccccctcccctcgcccgttcaccaaacaaaaaatttgttaaaaatctgatttttgatcccgaacgcaatgaaatttacgatttaaagaaatttaacaaaatgttcttatttttgaccctggatattcgtcccctattagcgggtcatcacagaaaccgttggacatacggtacttatcctttttgtcatccctctgaattttttttaccttgttccccccatttttgaaaaaaatgaaaattttaaaaagtcgttaaacccagggctcggatcgacaatttttcaaaatcagaacagattttgttttgcgaaactgcctccaaattagttatttttaaaattattcgatcaataatgtattatttttttcgcctccgattgtcgaatttaacgatttttggggaggaaataagcaaatcgtaaatttcagtgcattcgggatcaaaaaataagatttttaacaattttttgcgggtgcagttttttttttttttaccagactctagtgttcggtaattgactaagtctatcgtatggtgcacagttgggctggcgtaattaattaaatttggctttagactcatctatacttttaacccaatcttcccaacatggttgatggacaaattaaaactgcgcaagtgcaagaaaatgcaatgaagcgaggatttgtcaaacaggtcgcagtaggaaaaccatgagaattcgctgataagctcgtgttttatttaggttttgagtggcgattccgttgtgttacagcttccgccttctgtccaaggcgcggctcccacggaattgactgtttacttggccaatgtgtcagcaccacgtttggctaaacggcccactgaaaacactgaggcaactcccgacgaggtgccatcagtttataaaaacaggagcataaaataagacattatggcacttcataaatatgtgtaattgagtaagactattattatttaattcgaaattatgacaattttctaattagtccaaattaccattaaacacagccttatgcctgggaagcacgcgaatttttacgcaaaaaaattgttggccaagctgtgctttttatgcgcgaatttcaagccacttcaggcagagaacatggcaaaatccttctcgggtcatccggcacaagtgataaaaaaaatttgaaaaaggcaatttagtctttttttagacattgaaagtgccgaaaatgtttccgaaagtggcgtttcggctggttggttggaagtccgacccggcaaacaaattgagttggaaataattcttgttttttataccttctttcattcagcgattatggtaagaaactgctcgacctacaggaacaggcaaaatcggctaaaaagggtcgttggtccgaagaagagagtgcaaaacatattcggaacattcaatggaccatcgaagaaccaagggaattggtggccttatactctgggaagcaactggacgcggttgtggagcaggtcagatgggggatggagggaggcgaggacgggtggaactgacggaaggccaacccaacatgccaatgttgatcgagaagtgttttgcaactaattcaggtccgcgatggcacaactttccgcctatttttgttgccgtcctttgaatatataaccgtcgcacttagtggaattaag

SEQ ID NO: 67470 - DNA, 250 bp, Heterodera glycines
  Genomic contig location: Contig_ID=SeqID_8257; Location=1..250; Strand=+
  SCN-specific regions: Sequence locations=1-154,176-250
gtgtccgtttggggtactcaaacaattatggggagcaaaaatccaacgcagaattaaagtacaggctatagggaagctattccggaaggattcggtctccccataaatctgggcgcatcggttcagggggactgcctcgaaaactcaaaaaaaattttttggataaaaattatttaaatgatctgactagataatatttaaaataggttatttctcttcctttcagtatccctgcaaagtttggtgcgct

SEQ ID NO: 67471 - DNA, 130 bp, Heterodera glycines
  Genomic contig location: Contig_ID=SeqID_38744; Location=924..1053; Strand=-
  SCN-specific regions: Sequence locations=1-130
tatggcgcggaaagacttccgatttccgacatttttggggtaggaattccgacttccgaaatttttgatgaaaagtcggaaattttttaaatttttcttttcaaaaaactagcaagttttgtacaatttc

SEQ ID NO: 67472 - DNA, 897 bp, Heterodera glycines
  Genomic contig location: Contig_ID=SeqID_38747; Location=64..960; Strand=-
  SCN-specific regions: Sequence locations=1-207,231-597,619-690,717-897
cacattcaaatcaaattttgttgttgacacaaagggttagaaaaactcagttttttcttttttgcaaatttctgaattttcaggcgcgggtgccggccaactgactgtgcgagtgaggggccctaagggggcatttaatgtggaaatgcagcgggactcggcacaggaacggaccatccattgcaagtgggcaattttggcatttccaattaaaaatataaattatattactctgctgttctttctaaggtatgaacctcgtgagcctggcgattaccaagttgaggtcaaatggcatggacatcacgtgccgggtaggatttttttttttggcattttttacatttacaattatttgcctccgggtgcaaattagtgacaatagacccatttacgggaactccaagtccttgtattcccccccccccctaaaaaaacggaccgggctgggacctcggtaaaatttattaggtcttcggcatcctcccttctgtcatttttttccatttctacaaaactttatttgtttctcataggttctcctttcttcgtgctaattgtggacacggaacaggaacttcaacgattcttggcggtatttaaattaaaaaattcccaatttttcgcaacttttcagggcggcgttccctcgccgacgcccccgtcgccctttgtgccgcccggttggatggcgccccctcctccccctccgggggtgctccctttgcccccaattatgccatcaccgccggttggacagcctattagcttttttcacccccttttttcgatgtttttcagccacattttcgtggtgctcctcacatgaagcaaatgcaaatgttgccgcccccgtcgccggcacaccaacacgccatttacggaggaaggcaccat

SEQ ID NO: 67473 - DNA, 49 bp, Heterodera glycines
  Genomic contig location: Contig_ID=SeqID_38750; Location=597..645; Strand=+
  SCN-specific regions: Sequence locations=1-49
attgaaagccatccattgcctgccagttctcggcacagcaaagcactaa

SEQ ID NO: 67474 - DNA, 449 bp, Heterodera glycines
  Genomic contig location: Contig_ID=SeqID_38751; Location=384..832; Strand=+
  SCN-specific regions: Sequence locations=64-135,203-338,374-449
gcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 67475 - DNA, 770 bp, Heterodera glycines
  Genomic contig location: Contig_ID=SeqID_8258; Location=384..1153; Strand=-
  SCN-specific regions: Sequence locations=1-137,165-167,189-477,500-770
atgccttcgatgctgatggacgacgaacatttgttgtccgcttggactgcccgggcttctcactggacgagttttgctataacaatgaaaaaactggggaggtaataatgtttttttaaacgtgttagggcgccgctgggaaaatttttgaaatttttcagtaatttgttaaaaattaaagtcaaaaaagttgctgaattgggttccgggggggtggaccgggtcgaatggacgccgatgctttggccccctcagccgcccccccccctcctgtctcgcccttgcttgtattcaaaccctatttttaaacccgaatttgtttggccaggtgttggcatttgcattcaaacgctcccaagtgttgaaggcggaggaagacgacgacaaaatgacagacggtgaggaggagaagtcaagtgaagcggaagcagcagcgccggaggggaagaggtgccgaagtacgacgacgacaacggcgccaccgccggagggggaggcgaacgatgatgaagcggtggtgatctgatcaggagttgaaaaacgcctgaaatccgatccgggcacgcagttcccgcaatattattccggaccctgaatttttcaggaaatccgggctttattcgtcatccaccctcacttcctaggaaaatgtgataggatttggattctcattttgttcctttttcaattgacagcccccaataattttccggaccacgaaaaactgatattattgaagccaattttcaatgtgtttttttttaaataaa

SEQ ID NO: 67476 - DNA, 704 bp, Heterodera glycines
  Genomic contig location: Contig_ID=SeqID_8260; Location=1..704; Strand=+
  SCN-specific regions: Sequence locations=1-70,92-379,401-422,451-704
  Gene Ontology: Mol. function=dihydrolipoamide dehydrogenase activity; Cellular component=mitochondrion; Biological process=growth
gggtgtcaactacaaagtgggcaaattcccgttcgtcgccaattcgcgtgccaaaaccaacaacgacgtggaaggctttgtgaaggtgatcggcgacaaggacactgatcggctgttgggtgtgcatatcatgggaccggttcgtttgcttcttttaattaaatattgcattcaaaaattttggcgttttgtccctaactccaacaaattttttttttttttttgctcagaatgcgggtgaaatgattgccgaagcgacgcttgcgctggagtacggtgcctcctgtgaggacattgcgcgggtgtgccatccgcatccggtcagttggttttgtttgcgtgtgccttgccgtccagggaagcggcaatatttgatccgaaattgtccttctattttcttttttggtgaagatcgagaagacaaaaaaaatttaattttgaaaattttttggagtggggcggctcgagagagagaaataaagtgcacccaaataaattcccacaatttaacaacttatcttggaccatggaactcttctaacgcttttttgataagtccggcttggcccaatggagcctgccaattcgttttccatttcctacgtccctctcatccattcattctcttgctgttttagaccctttccgaggcgttccgcgaggccaacctggcggcatactgtggcaaggcgatcaacagcatt

SEQ ID NO: 67477 - DNA, 236 bp, Heterodera glycines
  Genomic contig location: Contig_ID=SeqID_38755; Location=1..236; Strand=-
  SCN-specific regions: Sequence locations=1-236
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgagcttaacttgccagatcggacgggtgcgcatgattccacagtgccaagcaccccaccaaaagcaaaacgatataaccaaa

SEQ ID NO: 67478 - DNA, 132 bp, Heterodera glycines
  Genomic contig location: Contig_ID=SeqID_38757; Location=291..422; Strand=-
  SCN-specific regions: Sequence locations=1-132
atggcgtcggatggacaagcgatggccaaatggcttttcactccccgcatggacgatgtgccaaaagtgttgcgatgctggttgaacaaggatgacggggatttggcgtcaaagattgaagccttcaaagcg

SEQ ID NO: 67479 - DNA, 618 bp, Heterodera glycines
  Genomic contig location: Contig_ID=SeqID_38759; Location=241..858; Strand=+
  SCN-specific regions: Sequence locations=1-35,57-176,198-351,385 -442,485-618
atggctcagtcgccggccgcgcccgccgcagcggcagccgccagcacagcgagcgcaattctcagcgcaaaagcggccgccgccgctgctgtggacgacgaattgggcagcagcggcggaagcggcagtcaaacgctggtggaagccattcaggtgaagcaaaatgggagaattaattagtcattttatttatttatgcaaaagagaaaaaagtccacaaaagggagtaatccacttactctgcggacatgtcatagattaatgtcgtcctcgagtaatatggatcaacaattaaacaaaattaaggaatcacaacaaaattaaataaaagaatgaggtcaatcaatcaataaaaccaaatcacatataaaattataaatagctttaattaattaatcaaaagagacaattcacttttccggtcattttattcgttaaggagtttaattttagttttaaattgatttaaagaatttattttaatgatttctttatcaagttgattccacaattttgtagccctccccgcaaagggaataaattttttgcctaatttatattttgtgttaaacctataaaaggggacattaaagcgtttagaaggtttgaaaattttaa

SEQ ID NO: 67480 - DNA, 754 bp, Heterodera glycines
  Genomic contig location: Contig_ID=SeqID_38760; Location=305..1058; Strand=-
  SCN-specific regions: Sequence locations=1-458,499-754
  Gene Ontology: Mol. function=UDP-glycosyltransferase activity; Cellular component=membrane fraction; Biological process=steroid metabolism
atgccgagaccaatttcgaacaaaatcataaacattggcggactcgtggaaatgaaagcgaaagaattggagccggtaaaatcgtctacctaaatgacaattaaaaggaaataagaaaatgtttaggaaataaaagccgtcgtggacaattcgcaggccggcgcagtgattatttccttcggcactatggtcgacatcaaaacaatgaaaagcgaaatgaaattggcattttttgaagcatttgcccgctttccggactatgaatttatttggaaaattgaattatccgaagaagaagccaaaatgtttgccaaatataaaaatgtgcacccggtgaaatggatggaccaaaaatcgttgctgagtgagtgagtcgaaaagcacaaaagagttgagagagagcttctaattcaggggtagtaaggtattttaggtttttgccattttgtctttgactgtattttttctttttaattaaatttcatattttaaattaaagtgcaccccaaaatgcgcgccttcgtctcccattgcggtttgaacagtgtcagtgaggcagcgcgatttggggtgccaatattggccattccgctgtttgccgaccaactgtacaatgcgattttggcacgagtgaaaggaattgccatccaattggacgttggccaactcaatggggagggggccgagcaactgatcattgaaggacttgacagggcaattacctaattaatcgggacggatctaatggattaaa

SEQ ID NO: 67481 - DNA, 266 bp, Heterodera glycines
  Genomic contig location: Contig_ID=SeqID_8261; Location=321..586; Strand=-
  SCN-specific regions: Sequence locations=1-266
atgagtgagtatcggtcggcttcgaagcctttttctttggctaatccatttttcaatgtatttgattcgcaattttgataaactgatcatttgataatgtttttttttcatttttttgattggttgattttgactgattaattatttatttcattaatttcattttcttaattgcattttatttgaatttcaacagtttccattggtcagattgacaaagcctattggaacctgcgcaagtgatacgtacggtattttcaaataaa

SEQ ID NO: 67482 - DNA, 1300 bp, Heterodera glycines
  Genomic contig location: Contig_ID=SeqID_8261; Location=643..1942; Strand=-
  SCN-specific regions: Sequence locations=1-163,185-334,384-427,506 -556,592-636,751-849,923-1049,1077-1269
atggacaatgtggatttgctgaatccgtcgtttatgcccctctccaaaatgagtcacagtgagagaaaatattgaataaaattgaataataaaatgaactgaaaattaaaatggataaaacgaaataaccaaaaaaaatttgaaaaaattattcaattaaatgcaaatgtaaaataattaacatgattaattaatgtgttttttttaattccaagtgattgttttattaataaacagttgacattgtcataagcgaaatgccaataccgaccggcttcggcacgcgtgcaaatgcgaacattttcaatgcctgcgcaactctcgcatttggtaataatgagattaattaattaattatcggaaaataaaattaatttggtacataatgagattaattaagcaattatcgaaaaataaaatttagtgcataaatattaaatatttattgtttaataattaatagataattttattttgtaaaattattatggtttatttatttaaaggttttttgaccaaatttcttcttcgtgcgttgaatggtgagtgaatgaagagtgaaagaagttaatgaagaagaagaagatgaaaagccaaagtggtggatgaattgaatgcataagtttggggggggggaaattaaattttcattatttaacaataaaattttcaaatttttcatttcatttttcattttaattatttattttattccatattttttaaaatcattttcacatttttaatcaactttttagcataccaaaaaaacattaagcagaaaatgaactttgttctcccattgtctgtcatctgctgcttcttcgctttgccatggatttgctacggtaatttttaaaatttaaaaataaaaaataattaaatttaaataattaaaaatgattttaaaattaaatttaaagggacccattgcaaagttgggatctacgaaacgtcaggctatgctgctattgtggcgtccgaatgtgctgcggatcaacagttctgttctgcaatcggttgcgcactcggtgggtcactaattacccaattaaaattaattaaattaattaattgccctcttaggcactgaacacatcgtcattttgtgggcttgtgagcagcaaaatgacactcaagtgatcgtcagcagactttcttttggcacttacaaccacacgtgcttggctcagattgggcagaagggtgccaacatgtccaatgaagagttcgccttccctgagctgaacgactatatcaaatgattggtaaaaaaacaatttttaattaaaataataaa

SEQ ID NO: 67483 - DNA, 399 bp, Heterodera glycines
  Genomic contig location: Contig_ID=SeqID_8261; Location=2403..2801; Strand=-
  SCN-specific regions: Sequence locations=1-92,114-154,176-197,219 -225,247-247,269-364,386-399
atggccaatgagcacgtgaaactgcccgaggcgcaggagcccgacaaaattccgacccttccggcggtggcattgaacaaaagtgggcggcaaaatgccaaagtttttgcatggcatggcacatgggcacaaaaaaatgatagggaaaatgctaaagaaaaataatagtgtgggaatggcacgtggtattattccgtggatggaaaaatgatagaaattgaattttgatatctcaatttttaaattggaaggcatacagtgcaggaccggattcttccgaggcaacggttacggtaagacggaggtgaaggagtgcgttggcggagaatactgttacgcggtcagctgccaaattggtgattaatccctatttgtatttattattctaatattaataaa

SEQ ID NO: 67484 - DNA, 243 bp, Heterodera glycines
  Genomic contig location: Contig_ID=SeqID_8262; Location=82..324; Strand=-
  SCN-specific regions: Sequence locations=1-243
atggcaatgatcgccccctttgatcttttgccgccaattgccttgctggtgctgatcgccatgatcaatcaatgctcgcgtatcataattagtccaaatattaaagtaattaatcaactaattaagcattgacctgtaagattggacatgcaaatcacaaaatgggcgaaaaatcggcgaatgggaaatgtgaggacaaagtgccaaatgcgcagcattgcttttccgtgctttgcatggagc

SEQ ID NO: 67485 - DNA, 1204 bp, Heterodera glycines
  misc_feature (507)..(508): n is a, c, g, or t
  Genomic contig location: Contig_ID=SeqID_8262; Location=1244..2447; Strand=+
  SCN-specific regions: Sequence locations=1-130,167-236,415-640,662 -709,731-840,862-1012,1034-1088,1110-1204
atgccaggaaaattcaattttcacttgccaacggaaaagaaattattgaaaatggaaatttattatcagagtaagtgtaattatttaacaatctaaatttataaaaattaggaaaaaatcaacgatttggaaatttttcaaaatatgaaaattaatttaaatttaagtagtgtatttacaatatttcgctgaaaaataacagaaaaatactaattaaggaatgaaaatgttaaatcaaaattattgaaaatattttttgtaatttatttttaaggcaatttttaaatttttaaaaaatataaaaaataggaatgttaaaatgacattcattgttttttacttttaatactgaaaaaattcaataactttgtaattttttgaataataaaattaattaaaatttcaaaattaaatgaacgatttttcattgaaaaaacaacagaaaaaaataattaaagaataaaaaatgttaaacgaaattttttgaaaatatttttcttatttcanncaaagatgtttaaaatgatattcattatttttttataaatttgtcgtcatatcacaaaacttgttctattctttaggaatttgtcagacgaatacatttttcgcgcattgccaattttcgaattaaaatttacaaaatcgaacaaaacaatcataattaacacaggtatttttattattccttgctctcattaaatgccaaaaataatttcacatttaaatttagtctcgccaaaacaaatgaaattgcgctcagaattttttgccgaatcaaagcttggcccatttttagaagaatttgccggcctttggcttttggcggcggacatttggccaaagtttggccaaatgccaacaaaatttgtgtttatggtggcgaatggatgccaattaattcgtgtcgatggcccacctcaaaaatgcgcaactttttatcatttggcatttgaaaagccacgtgccattcgccaacaaatcattaagccactcgtaggaattaattgaattgtttgtttattttttaatgaaaaattatcccaattatggtctcttttaaagatatttctgaattttttcccaaccttcaaagaaatagttttaaacttgattagttattaacggagtttttcattttttttacaagatttttgggtttattttagaagaattattttgtcccattgtataaacattaaaa

SEQ ID NO: 67486 - DNA, 371 bp, Heterodera glycines
  Genomic contig location: Contig_ID=SeqID_8262; Location=2649..3019; Strand=+
  SCN-specific regions: Sequence locations=1-154,196-371
atgccatggacagtttattttatggcaagtttgaccgaatattctgaatacggcagaagatgcactgcttcattaatttcaccaaaattcgttctgttggccgcccattgttttgacaaaatgaaagaatttcagccatttttattgggtaaacaaaattaataattaattaaatgttttgaaataataaaatttggcatttttaaaggatttggctcaaattcgcgagtcttcaagagcccaaattatgacggttttgttgttaaaatgactcgtgtgaccaatttaaatgtgttcatccatccaaaatatacgaaaaatggccttggcttaaacgatttggcattgataaaggcacttaattaattaaa

SEQ ID NO: 67487 - DNA, 446 bp, Heterodera glycines
  misc_feature (438)..(438): n is a, c, g, or t
  Genomic contig location: Contig_ID=SeqID_8263; Location=827..1272; Strand=+
  SCN-specific regions: Sequence locations=1-104,126-269,308-446
atgaactttgaaattcaattacaaatgctgggtaagcgactgatggatgagctgcaaccatgccttatttgtgattagaatcccggacgaggacggctcccgaaaaattggacactaacagaaaataaaataacttatccataaaatttgcatgattatttcatagatcagatagtataataaagcattttcaaaattccaatttttttttgttttttgctttttttggacgccgatttcatcgaaaaaaataattaattttttgcgtgatttttaatagattatttactaataaaaaaataaataactttcggtgattatcgaggacaattcgtcaattagtaaaatgcaaataaattcgaaatgacaataacttgtacaattttgagatggaccaaaaaaaacaacaaaattaattcgtattttcagacaccttanaacattaa

SEQ ID NO: 67488 - DNA, 679 bp, Heterodera glycines
  Genomic contig location: Contig_ID=SeqID_8264; Location=1283..1961; Strand=+
  SCN-specific regions: Sequence locations=1-318,356-426,466-496,518 -568,609-679
gcacagcaatgtctccgttctgtgaattgggtgcgtcggctcgtaaatatgattgatgccgaccgactcgtccacgctgaggcacacgaatttggaggcattcaattgcctgcgcgaaaacttgaggcatttcgccttgttcgaggtgttaaattcaaaatgaaaaatttatttaccaccaattcattataaatatccaattaaacattctttagagttgctcgccgttgtcactgctcatcccaatttaccacagaatattcagcaaactgttggcttgcccatttccgctaacaatcgtgattatgttggtttagcaaattttaaatttgttttttaattaatttttaatattcccccttttggggctcaaatggccccggatggataagcatgaacatttatccttgtccaatgttggattgtttaataaaatttaagtcaaaaattgaaaaattgccatttatggaaaaatttgttaaacttagagattttttcctttaattaaaatattttctgactaatttgtaagtgaaattctcatgttttgcattaataaaagcgtttgaaattaaatcaaattattttatttttaatttacattattacaggttcgtctgtacccgtatgcataaagatcggatcctcggatcacgacccttattacaagggaaaatag

SEQ ID NO: 67489 - DNA, 562 bp, Heterodera glycines; identical to SEQ ID NO: 38762
  Genomic contig location: Contig_ID=SeqID_38762; Location=1..562; Strand=+
  SCN-specific regions: Sequence locations=1-562
  Gene Ontology: Mol. function=cation channel activity; Cellular component=membrane; Biological process=olfactory behavior

SEQ ID NO: 67490 - DNA, 133 bp, Heterodera glycines
  Genomic contig location: Contig_ID=SeqID_38770; Location=555..687; Strand=-
  SCN-specific regions: Sequence locations=1-46,68-88,110-133
atgtccagtgaacaaaatggaaacgacaaacaaatcgaaaacggagaacaacaaaacagacggagaaggagagacggggaaggaatgcgaaaaggacaaatgaaacagaaaacatcaacaaagttgtatttaa

SEQ ID NO: 67491 - DNA, 205 bp, Heterodera glycines
  Genomic contig location: Contig_ID=SeqID_38770; Location=183..387; Strand=-
  SCN-specific regions: Sequence locations=1-13,35-205
tagtttttgcatttcaaaagttcgctgtgaattgtgcactgtatggggcgaccttttctagagcatatgggcggcagaaaatattactcatgtgcgttcggctcgcaattaaacagcggagataaattctgattgggttttaggtcgaagatgcaaaacgtacctcaccaacagaagggagttgatttcgcacaccttcagaggt

SEQ ID NO: 67492 - DNA, 179 bp, Heterodera glycines
  Genomic contig location: Contig_ID=SeqID_38770; Location=1270..1448; Strand=-
  SCN-specific regions: Sequence locations=1-125,147-179
gacaaactgatgggactccgttcatcatcaggcgaagaacagtttagcactattcccgcccgattttatgaggtgctaatttattgagccaaatttacttggaatgatcttttggaccgatactcatgatatacaatttatcttttcgtctagtcattaattttttacatcaacttttc

SEQ ID NO: 67493 - DNA, 662 bp, Heterodera glycines
  Genomic contig location: Contig_ID=SeqID_38771; Location=79..740; Strand=-
  SCN-specific regions: Sequence locations=1-662
gttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttt

SEQ ID NO: 67494 - DNA, 413 bp, Heterodera glycines
  Genomic contig location: Contig_ID=SeqID_8266; Location=372..784; Strand=+
  SCN-specific regions: Sequence locations=1-26,50-131,153-413
atgcctattcaatgtttgtctgaacatttgttttggaaggaaacaaatgaaaaacacacccagtttccatccgtccaggccgcaaccctggataccagcgcaaaaggaccagtggaaagcgaacgcccacgcccacccaactgggaagaaaacccagtaccaggcaggactccacggttttcatggatggcccccaggatattcgaaaaagcgtatcaaatatcctataggggtttactaccgcgtcaaccaaatatgcaaatgtttcggcccttcaaagccgtagacacggtttgaatttcaaaaaaatacgagcgggcctcgtcagtacggcactcgtattttattattttttgttgctaagctcaccagtcagcctttggcgtcaccccggattgttgcttttaatttta

SEQ ID NO: 67495 - DNA, 896 bp, Heterodera glycines
  Genomic contig location: Contig_ID=SeqID_38773; Location=283..1178; Strand=+
  SCN-specific regions: Sequence locations=1-665,687-896
atgaattgtgccgccgaattggtgatcaagcctgatcagattggacaattacagcgtctgccaaccgtggcaattagcaaaacgaccaaaataccgaaaagcaatttaacagaaaggcatcgacgacgattggatgagggtaattaaaaattgagctcacatttatacacttaggcaatttttttggctcaagtacagtttatggatgcaatcgctttttatgtgtccaatcaataccccgtgtatgcatgacaatatccacaaagatttgctagaattcttcaaaattttgaatattctcataattaactagtcatattcacgtcatagctacatagatttgttaatacaacgaaatttgtcgtagtttttgttgtgttaggacaaattccgcaaaaatgtcaaggcctcgatcttcaatatccgattttgtcactgattaagccgtgtcatcccacagcaggtcaaccgaaatagagagttatccgaaacatgaccaccggatgaaactaattgattggacgcacaaaagtcgattgaacgcataaactgtacttgagctattttttatcaactcttttggacggatctattctggcattttgccgaaatttccttaattttgaattgtatacaaaaaaaaatacatggataattggaaatttaaaattagaaaacacaaaaagggtaattcaacaaatgctaaaaaattaaaaaacggggccgacggcacaaatttttcaaaccattttaacgctaattaaaaaagcactccctaaatgctaaacaaatttcaagaaggattcaatactggcgtgtgcactttcccaccatcacccagcagccaattggtgccggacacaattcctattacaacggttggcacaaaaaattga

SEQ ID NO: 67496 - DNA, 470 bp, Heterodera glycines
  Genomic contig location: Contig_ID=SeqID_38774; Location=223..692; Strand=-
  SCN-specific regions: Sequence locations=1-12,34-190,218-315,342 -353,375-470
ccgacccctcccttcacccctttctttccttcatcatttcccgtttgccctaattttctcatcatttcatccatcaatcactcctcgttcgctacttcgttcaatcctcaccgtcttccccatttgtctgctcgacggacattcacggctaacgttcagtcgcgacaagagaattattcataacttcaccttaaatgaaccaaattttcaaattttgaaatctttcgtagcactaaatttttctattattctgcaaaatttcaaaaattcgttaagtttcaaaaaagtcataatctaagaaactgaaaaatttgaccaaaatgaatcaaattttataatatgtatcattcgataacctaaatatttaattttttcgtaagattttgattattttaataacgaagccagagatttcgcggctgcttctcatagagcaattacggaagcagaaaaaattaagtctcgtcatc

SEQ ID NO: 67497 - DNA, 276 bp, Heterodera glycines
  Genomic contig location: Contig_ID=SeqID_38776; Location=1141..1416; Strand=+
  SCN-specific regions: Sequence locations=1-67,89-276
atgattcccggcttttcgaattgggtgagaccaattccgactcgaggcccaccaatttcttaatttcaccaatgttcatgttgtgtttaaggatgccgaatgcgagggcagtttcgccattgagccaattgacggtgccgaactgaggggccaatgtttggccaaaattgcgaaataccaaacgaagcgaaaggcattggacaaagcagtcggccaaaacttttttgttggcattcagacgaaactgtggcattcagacgggccaagcagaaacag

SEQ ID NO: 67498 - DNA, 230 bp, Heterodera glycines
  Genomic contig location: Contig_ID=SeqID_38780; Location=460..689; Strand=-
  SCN-specific regions: Sequence locations=1-159,181-230
gttattggcagttggaaccttcgaaatgccccgcaaaagcgctttccattcattgaattgaatggtgaacgaatttcggattcgcaaattattttgtggagattgtcggactatttcaaaattgaagtaattgcacgtattattgtcgttacttctatttcctattccaaggatgggttggacaacgaacaaagggcaaaagcacgtgcaattgaaagactaatcgaagg

SEQ ID NO: 67499 - DNA, 128 bp, Heterodera glycines
  misc_feature (14)..(14): n is a, c, g, or t
  Genomic contig location: Contig_ID=SeqID_38781; Location=33..160; Strand=+
  SCN-specific regions: Sequence locations=1-128
caggagaagtcccnggatcagagcgcctacatgtgagaagatgcaacaacgaccggcggatggatggacgaaacctgaagagcgagcgacctgtcagaagatgcaaagataaagaagatgtctcataa

SEQ ID NO: 67500 - DNA, 1662 bp, Heterodera glycines
  Genomic contig location: Contig_ID=SeqID_8268; Location=2501..4162; Strand=+
  SCN-specific regions: Sequence locations=1-105,127-402,424-1349,1410 -1426,1479-1634,1656-1662
atgggacgagtcaaaggtcagtggtcgtgaatgatcaaccaatcagtttgacactcatcttgtgcttcctttttggcccattctcttggcaaaacttcgcttccaaattagtcttggccatcattagcgattaatcgctgctaatccgtctccccatttgcagaagttgtgccggaagaagcagcggatttcttcgatcagctgacgggccgggacaagcaagtgctgcgcgaagtgttggccaaggcggacacttatcaaagcactggcgaagtgctgcagggtttgttatcatcggcggatgagaagcatttacgagaccgtaaaatgtcaacaaaaacaaatagcacggcatttcgacattgttttttcgacttttttccgacccttttgggccaaatttccatttcccccgtaattttcggtccccctatgtgtaaatcttcttctgtaaagatctgcgaaacggttcttcgacactgtacgacaaggctgtccaagtgagttggagcaaatttatgttgttgagtgtatatctgggcttattgcaaaaaggtggtcacttccgttcgtggcattgtcggcaaactcagtgtgcccgcgcggacattcgtcgacgaagttcggtggactgtttttttgttgtttggggtgtgggatactgtacggaaatgttaactgtagcaatcaaaattattaatgaacatcatcggactgctgtgcaacttaattattgaaatttcctgtttcgctttgttccgatataagcgctttatcactgatataataggttcggttcagtctaagcttatctgatttgctggtccattgagttggtctaccgactgatctgttcagcctaatttggtttgatcagtcagttcatagtttatccgtccgttttctgacccaaactcttttgctagcctatttccgctggtttatttttacaccaaatttctgtccaacttttcgggggcaaaaataggcatttcggggtcgggcagaagccaaacattctaatgtttcctgcccctcctttggcgtttcagtccgtcaaacagttgcgcaatgcccttgggggcggcttctctctgtccaatttgaaggcccaagctcagcaattagtcgcccgttatcgccaattggacgctagcacaaaagaggaactgcgcaatgcttttccaacgattgccttcgttttggacagtgagaaaattgaattggcatttcttaaaattcgcataatggcattggcacttctgctaaacgacggcattttcagacccggtcgtacaaacgatggcatccggactgttcgacattaagacaaaggacgaagggccaatgggagagcgagggagagaaagaaatggggagggcgagagaggagaggagggggatagagacaatgggggaatgacgagagggggagggagaggagaagacggaggaggaagaggaggggaggtagaggacgaagtgggcgagagagcggagcgacggaatgtcgtccaccgacggaagaaccgatcggcggtttccgtagcatcaatggcagcactcgcagcaacaagcgcagcactcgtaacaacaaacggagcaatgtcaacaatgatcaatcagcagagaagaagcaacttgggaaggagggacggatga

SEQ ID NO: 67501 - DNA, 1005 bp, Heterodera glycines
  Genomic contig location: Contig_ID=SeqID_38784; Location=237..1241; Strand=+
  SCN-specific regions: Sequence locations=1-69,91-461,503-778,810 -897,919-941,982-1005
atgggtgggaggtccgtgcatgaatttttttatgaattagcgtgataaaaattaatgtctttttattttcaaatttaggacaaacaatgttaaaataatttagattttgatccaaaaatttattttcttataagtttaaatctgatgacatttaacgaaatctgttttgaaattgcaccaaattttcaaaaaccttgagttcggaaactttgaattaacattgaattaccatcaaatatggagcagtttcactggcggaatttaagcctattttatcccagtcaaaatgaccgggcccggtcttagacaattaatcgagaacgggctacccggccaaaaaaaagcgcgttttacaggacgacctgcccggtggtttgtccaaaaaacggaatcgggaacgggcgtcctagtaaaaggccgctgggcgccgggtccttccgctctttcgtgactcttagtaatttcttgcctttttaatgcatttttaaaaaatcactctttcgatccttttttcagggcaaggaatacaaaagaatgttcattcgcaatgcaagcgatgggctcattcccatgagaaaaagggccacggggagggatggcacgcttttaagccggactgtgtgttgactaagccgaccacgcgcagcgaatgccaacggaatcggcattggatggcacgcaattgtcccgaggcgtgtggctgtgaatttgtgcgcgatttgttggacaagtgcaggtgggcaaagggtcaaaaagatgccaactaatttagcatttcattatattttaattttaattttaaatttttagcaaaaatatgcccgaggattataaattggagccaattgatgaatgagaaaagaaggaaataatttcgaatggataagatataaatgaaattttataaatagggctgcaaaaaatatgtacaaaaagtggtccaaatatgtacataaatatgtaagaaaaatccccaaatatgtacaaaaaaaccccaatatgtaa

SEQ ID NO: 67502 - DNA, 427 bp, Heterodera glycines
  Genomic contig location: Contig_ID=SeqID_38786; Location=229..655; Strand=-
  SCN-specific regions: Sequence locations=1-296,318-427
atgcacgcaatccggcacgttatttttccgactgcttgtttgctgccattgaggcaagtgaatcatattaaaaatttctaattacataaagaaaaaaaaataagtgttaaatttttgatttttgcttaagaaaatatttacgagaattttaaagaaaattttcagaagcaaaaggaacacgaagtgattcggcttgtggtcacactttcggagaatggccaaatgccggcaattggcactgaattccaaaaaaaacacggcctcccattggcatctttcattgtaacagaggcgaaaatggccacaaaaaacacactggccaaattggcaaacgcattcgtcgaaggaaagaattattcaaaatgagtcggggaaagtacggcactgacatggcaaatgccttccttttattcgcgagacaaataaa

SEQ ID NO: 67503 - DNA, 238 bp, Heterodera glycines
  Genomic contig location: Contig_ID=SeqID_38787; Location=58..295; Strand=+
  SCN-specific regions: Sequence locations=1-141,197-238
atgccatggattacggcaatttcaaggaaaatatttgaagcagaaatggagaaaaaagacgaaggaaaaaaggaggacgaaatggccaaagaaaagtcaaataagctgaagaagaacatgtccaaattggaggagattttgggaaagcaaagagccgaaaagggaaaaaaagaacaaagaaaagaacgaagaaaagtgatgagagaaattgcgaagccgaggccaaagagagacgaag

SEQ ID NO: 67504 - DNA, 306 bp, Heterodera glycines
  Genomic contig location: Contig_ID=SeqID_38788; Location=239..544; Strand=-
  SCN-specific regions: Sequence locations=1-306
tcagtcggctttatttatacagttgaacacaacacagagttggtaggaacgatgggattgataaatactttcgaaataaatttaacacgtctttgtgagtgtggggaattggtgtcggcgtaacattaaaaacgatgttcatctactaatgaaagaaggaaaatagtcattacacatgcccgcaaatattttctaagacccctcccccatcttcatctgattctcatatgaagaaaaagggaaaaggttcaatttttgcttgtgttttggtgtgatgtgtcatcgttcgctcttgcccggccgttt

SEQ ID NO: 67505 - DNA, 118 bp, Heterodera glycines
  Genomic contig location: Contig_ID=SeqID_38790; Location=677..794; Strand=+
  SCN-specific regions: Sequence locations=1-118
atggtgccgaagcaaggaattcgggcttcaccggacaaggtggaagcaattcaaaaaatgccgacaccggaaaatttgaaagaacttcactcgtttctcggcatggttggctattacg

SEQ ID NO: 67506 - DNA, 744 bp, Heterodera glycines
  Genomic contig location: Contig_ID=SeqID_38791; Location=32..775; Strand=-
  SCN-specific regions: Sequence locations=1-744
  Gene Ontology: Mol. function=structural molecule activity; Cellular component=membrane; Biological process=intracellular protein transport
atgaaagcagactcatctcgtgtgatggaatacattcaaaaattagacaattacgatgcgcctgacatcgcaaacattgccatcacggacaaactgtacgaagaggcatttgctatcttccgcaaatttggggtcaatgcgtcagcaattaaggtaacattttataataatcacatcatcattcgattttatttttaggtgctcattgagaatgttaaaaaccttgacagagcttacgaattcgcggaaaaagtcaacgaaccggcagtgtggtcggctttggccaaagctcagcttaacgaaagcctggtcaaggaagcggtggattcttttgtcaaggccgacgaccccagtgcgttcatcgaagtggcaaagaaatgcaatgaaactgaccattgggaggatttggtgcgctacctgcaaatggcccgcaagaagtcacgggagtcattcatcgagaccgagctgtgctttgcttatgccaagacagggcgtttaactgaattggaggaattcattacggagccaaatcacgcccaaatacaacttgttggagatcgttgtgcggaagatgggatgaacgacgcagcacgaattctgttcagcagcatcagcaacttcgcaaagttggcaaagactcttgtcgaactcggtgacttcccgggggctgttgatgcaggacgcaaagccaattccacaaagacatggaaacaggtgacatatgaattatgtttgctctcttaa

SEQ ID NO: 67507 - DNA, 1006 bp, Heterodera glycines
  Genomic contig location: Contig_ID=SeqID_8269; Location=882..1887; Strand=-
  SCN-specific regions: Sequence locations=1-12,34-159,181-362,386 -391,442-528,567-572,618-654,677-696,718-746,774-895,933-1006
atgctttttctcctttttatatttgtgttcttaatcataaacaattcaactgacaaaacattgtcagttaatctgtgtaaaaaatgtcgaccaacttttgctgaaatatttggcgaagaatggcaaaatgaaataataattggaggagatgaaaatgaaaatgaaactgatcaaaatgcaaattttcatcaaaatgaatcaacttatcagaacgatcaattagattttcaacaaaaaaaagaaattattcacaaatttcatgcaattagagaaggaattaagaaacggggaaaatattcggcaaaagtttgggttaaaactgagcaaaaaattgcgaaaaaattgggaattagtcgacagaaaatttataaatggaaaaaagaatttggacaatatttaaaaaataataaaaattattatgaaaagaaaaagaaggaatttattgaacgaattgacgagattaaaagaatgtcaaaaaaaggaacacagaagcaatttgcgaaagagttgggcattgatgaaaaaacattaagaaaatggaaaaaggaatttggcattgaaattggcaaaagtaaattttaatttaatttaataattatttatttttaattttttaaggatattcgaatgaagagaaaatgagcaaaatgaatgattatttgaaaatgaagaaagcaaatccgtctttgagtgataaagaaattgctgaatttttaaaaatcactcaacgcaccctactaacatggaaacaaaaattttaataattttacttattttcctgttagcctatgaattattgtgctttatttgtttttccccttttatctgttggcattttccttttaattgttttttttattcataaatgatgtaaaaataagaaaggataaagagctttaattaaaattatcataagaaaatatattaaaattcacagttataatgaggattggcatttgtgctctatttcacgttttctaaaatttattatccacaaaataataaa

SEQ ID NO: 67508 - DNA, 2929 bp, Heterodera glycines
  Genomic contig location: Contig_ID=SeqID_8269; Location=2512..5440; Strand=-
  SCN-specific regions: Sequence locations=1-219,242-1297,1329 -1346,1368-1494,1516-2005,2027-2398,2420-2929
tcaagccaaagtggcacaaaacccaaaagggaggaaggccaaacaacaagcaaggccaatcatcatccgctccggcacaacaatgttggcgatgtggttggacaaatcacagccactgggagtgtaagcataagtcagcaaagtgccaaaaatgttcccaaaatggacatttggaaggccaatgcgacaaggtgcaggaatggagacggagaaacaaattgccaattccaaaaaggaaaattggaaatttacgaattggaacggccatgaaagtgaactccgcttcgcttttcaaaaccgacgtggcggtagatggcaaagacatcaaattcgtactcgacagcggggctgaaataattgtgatcgatgaactatcacatgaagtcatcggcagcccccgactccgcaaatgcaccgaaagtggatgcatgttcgatggaacacaagtcaaattcgtcggaaagggagtcgcaaatttcaaattccgcaatatttgcattaaaagcgaatattatgtggcaaaaaggggatcgctaaatttgctaagtgtgcaaatgatggacgcttttggactcctgaacgaactcaaggccaaaattgatgcgccagtgaatttgtgcagagtcggagacgagacaagaggttttacaaaagctccaaaaccgtcacaaaattcgacagtcaaagcgcacatcgaccatctcaaagcgacatttcccgacattttcaaaaacgaattaggccgttgtatgaaatttaaggcgcatctgactttgaaagcggacgccgcaccggtctacagaaaggctcgcccagtcccatacaacgcgcaagaagcgattgatggagaattagagcgatgggagaaaatgggtgtgattggaaaagtcgaatacaccgaatgggcagctccgattttggcggtgaaaaaggccgacggaagcgcacgcctatgcatagactattcaaccggtctgaacaatgcccttcaagaccaccaacacccactgccgctacctgaggatattttcgcaaccttaaatggaggaaaatatttttcgcaaatcgacctcagggatgcatatctccaaatcgaattggatgatgagtcgagaaaaatctgctcgatttcaacacaccgtggcaactatgaagttaaaagacttccttttggcgtgaagtcagcgccagccatattccaatcggtaatggaccaaatcttggcagaatttgaattcgccacagcttacttggatgatgtgatcatcgtaagccaaagtgtcaaagagcacgctgatcacttgaagaaagttttggaaaaattccaagaatggggattccggatcaaattggaaaagtgttcgtttttccgagaagagatcaaatatctcggacaaatcatcgacagaaacggacggagaccggacccggagaaaatctcagcaattagtaaaatgcccgcacccacagatgtgccatcgctgcgttcatacctcggaatggtgggccactggcagcaattcgtcaaaaacatgcgttttgtacgaaaaccgctagacgatctgctgaagcaggacagcgaatggaagtggagtgaaaaatgcaaacaagcatttgacaaaataaaggaaattttgtcatctgaacttctgctcacgcattacgacccaacaaaggaaatcgtggttgcagcagatgcatccgaactcgggattggagcggtaatctcccacaaatttccagacggaacaataaaggcaattgcacatgcttcatcagctctaacaccggctgagaaaaactattctcaaatcgagaaagaaggattggcactgattttcgccgtgcaaaaattccataaaatgatctatggacgaaaattcacgttgctaaccgaccatagccacttcttgccattttcggaagcaaaaagggagtgcgccagtgcagtgccaaccgacttctccgatggtcgctgatcctcctcgcatacgattttagcattgagtacatcagcaccaatgattttggtcaagccgatgtgctttcaaggctgatcgcaaagggaaaaagcgacgaagaccgagtgattgcatctctccgatcagattcggaaattgacgacattttgatcggatcaattgaagcactgccaattaaatttaaggaaattgtcgcagctgcagaagccgacaaaaccattcaaaaagtcaaggaatttttgacgaatggttggccaaggaacgtccgagacgaaagtgccgaaataaagctttttcatcggatcaaagaacagctttgcatcacgagaaattgcctgatgtacgccgaccgagttgtcatccccgaaaaacttcggcagaaaactcttcattcattccacaagggacacccgggaatcaaaagaatgaagcagttggcgagaaattacgcctattggccaaatatggacgccgacatccaacagatggtagaaaactgccaaccgtgccaaatggaagcaaaggcaccagttaaaagcaaccttcaaccgtggccaaaaccatctgcaccgtggcaaagagtccacatcgactatgccggaccatttttcggcaaggaatatttaatcatcgtcgatgccttttcgaaatacccggaggtattcgaaatggccacaaaatcgacagcggcaacaatagaaaagcttcgatatttgttcagccgacatggcatcccggaaattttagtgtctgacaatggcacccaatttacgagcaacgaatttgccaaatttatggccgtcaacggtgtcaaccacctgttttcagcgccgtataatccaatgtcaaacggccaggccgaacggttcgtggacacgtgtaagagaacgtttaaaaaattgaaaggggagggagccccaagcaaggaaatcatcgaaactttcctg

SEQ ID NO: 67509 - DNA, 543 bp, Heterodera glycines
  Genomic contig location: Contig_ID=SeqID_8270; Location=57..599; Strand=-
  SCN-specific regions: Sequence locations=1-224,247-543
atgcagttaagccaaagtggcacaaaaccgaaaagggaggaaggccaaacaacaagcaaggccaattatcatccgctccggcacaacaatgttggcgatgtggttggacaaatcacagccactgggagtgtaagcacaagtcagcgaagtgccaaaaatgttcccaaatggacatttggaaggccaatgcgacaaagtgcaggaatggagacggagaaacaatttgccaattccaaaaaggaaaattggaaacttaagttcacttttgaaaaccgctgtaaatgcaccgaaagtggatgcatgttcgatggaacacaacatctcaaaacgacatttcccgacattttcaaaaacgaattgggccgttgtatgaaatttaaggcgcatctgactttgaaagcggacgccgcaccggtctacagaaaggctcgcccagtcccatacaacgcacaagaagcgattgatggagaattggagcgatgggagaaaatgggtgtgattggaaaagtcgaatacaccgaatgggctgctccgattttggcg

SEQ ID NO: 67510 - DNA, 324 bp, Heterodera glycines
  Genomic contig location: Contig_ID=SeqID_8270; Location=824..1147; Strand=-
  SCN-specific regions: Sequence locations=1-58,80-324
atggcacaagccaatattcaacaattgctggacgcaattagtcaactcgtcaccgcacagcagcagcaacaaaacaatcaaccgaatccgaacaataatgttccggtgccggtgctgcctgacatttcggacttcgaaccgaccgacgaaaagggacgaatttcagaatggatcgaaaggttttcttttgcaatggactgttcggcaccaaacgcaactgacgcagtgaaagtaaaggcattaatgaacaaattgtcggaaacggcattcagtgaatattccaaatcatgcctgccgtcaaaagtgaccgacttcgacgaatga

SEQ ID NO: 67511 - DNA, 829 bp, Heterodera glycines
  Genomic contig location: Contig_ID=SeqID_38792; Location=68..896; Strand=-
  SCN-specific regions: Sequence locations=1-27,50-829
atgggagaaatatcggcgcaaagtcctgcaaaaggagaagaggttggccgaacggactgagtttgagcgacaggcgggagagtctgctggtgagcaaccgatggcactgtaccggacgcccgacttcacctggtcaccggtgcacatccgtctgctgtccgacctgctcgagtccattgagagtgtggtgcaggaatggaacgagtttgtgttctataatagattcattagtccgaaactggggatttccaattaatcagggggggggggggttaattatggcaaattcgaaagcagtggcattttataattgcctaaatctaatcggctttaagttcgagcacaccaattgcggaccatctgaacaacgcggacaaccaggtgttcatcgccaacaccatccatctgctcagccaactcggcgacagtctgacaatggcatgcggtggactgcttccactgttggccgccgcaacggcaccgaatgtaaagttgaaattcatttttaactaatatttacaattacaattgttgtctcttttctctgatagcaatgtttgtttcagagcgaattggaaatcaacgacaccacccagcaagagttggacattgaggacgccgcccgttttattgccacttttgccgaactttccgatggtttttgtgttcgcctcgggcgtcagtctaaacgaagtgcggccaaatttcattcattttgattttcttttaatcactggcaaaatcaaaaaaaacctttccattttcagttggagcaggagaaaacatgccatcgggtggcttttgcgccatcgctgagacttggtactga

SEQ ID NO: 67512 - DNA, 398 bp, Heterodera glycines
  Genomic contig location: Contig_ID=SeqID_38793; Location=216..613; Strand=-
  SCN-specific regions: Sequence locations=1-3,26-226,268-283,305-398
atgtttgaatttgtacgaagtgtaagacagcaaatttctggcctttcactatctgacactctcacaaaaaatcgagtgaacaaaatgattgattgatacatacagtatgaacaattttgtcataaatcatttgaattaattaagcaaaaactgttgatgagaagccatgtgaaaaaaagaattgcttgttcggcataagaattgaatgtatgtaatggcattttcgtaaatttttaaaaatttaattttaataaatttacatttttagagctgggtgaaagataaagtgaaacagaagaaactgattgaggacaaaaaaaaattataatatttctaatatgcatttttttttgtattccgattattttaatcataaaaaggcaattttatgtattaaa

SEQ ID NO: 67513 - DNA, 150 bp, Heterodera glycines
  Genomic contig location: Contig_ID=SeqID_38793; Location=707..856; Strand=+
  SCN-specific regions: Sequence locations=1-33
atgtccaagccgaacaagtgttgtttgacggtagttgttgtcgtggttgtcggagttgtcgtggttgtcggagttgtcgtggttgtgggagttgtcgtagtcgtggttgtcgaagtcgtcgtcgtggttgtagttgtcggagtcgtcgtc

SEQ ID NO: 67514 - DNA, 316 bp, Heterodera glycines
  Genomic contig location: Contig_ID=SeqID_38799; Location=330..645; Strand=+
  SCN-specific regions: Sequence locations=1-187,220-316
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattgacttgtaaataaaatttggtgcgctttagagcattttctgaaaaaatatttatgaa

SEQ ID NO: 67515 - DNA, 403 bp, Heterodera glycines
  Genomic contig location: Contig_ID=SeqID_38801; Location=229..631; Strand=+
  SCN-specific regions: Sequence locations=1-403
caaaacgctcttcgaataaccctaatctctgtccaacaagcaattcgatgtctgacatctacggcttcatcaacaatatctcagatcgtatatcacgacgcgtacgtcgcaagcgcccaacggagtctggggtttctggtgaggaccgagtcactttttcgaaagttcattttctttcggttttcaggtgtcagcggcgcaccgccggagactcggaaggacgacaaggcgaagggcggcggctgctccaaaaagtgcgcttgcatcatcgtgtgcagcattctcacgctcattgtgctcgtcatcggtggactcgtcctggccgctgtcctgacgcctgaaacattcaaaaatgctcctctgttgagcctcatcgcgggcaaaaagaatgggggcgcggatg

SEQ ID NO: 67516 - DNA, 1745 bp, Heterodera glycines; identical to SEQ ID NO: 8271
  misc_feature (89)..(89): n is a, c, g, or t
  Genomic contig location: Contig_ID=SeqID_8271; Location=1..1745; Strand=+
  SCN-specific regions: Sequence locations=1-140,168-454,476-529,558 -635,702-1745
  Gene Ontology: Mol. function=calcium ion transporter activity; Cellular component=plasma membrane; Biological process=signal transduction

SEQ ID NO: 67517 - DNA, 1729 bp, Heterodera glycines
  Genomic contig location: Contig_ID=SeqID_8272; Location=664..2392; Strand=+
  SCN-specific regions: Sequence locations=1-567,589-1130,1154 -1189,1217-1250,1272-1398,1423-1729
  Gene Ontology: Mol. function=calcium ion transporter activity; Cellular component=plasma membrane; Biological process=signal transduction
cttcttctcgccattatggagtcgcggcacgactcggaaaatgcggacagagtgttgcgaaacatggcacacattaacgggggcgggaagcagctgctgaaagccattgcacaagcttattgcatgccgaacacgcaaaacttcgaattgtttcgcatgcgacagaaattgctgtgcaacgaacaaagtgggagggagaagaacgacccaaaagcgaaggaggggcacaaaagcggcacattttggcggacaattgccacaaaagtgccatttgtcggtccaaaatttgccgaaaagccccaacagcaaaatcagcaacaaatcgcctctccgttatccaagccgacgaatttggcctttggcactttggccgaccctcgcgaagtgagcagaaaattcaagcacaaaaaattggatttgaaattgtcaggttggacacaacatttatattttggcacaccaattggcacggcatagcgccgaattggatgtaatgctaaggccggagaatgccaaggacgaaaacacacgcgaagcattggcatattatcgaacgcacacgggccaaattgaggtgaaaatgagaaattcagcagcaaaatgagtgacgggccaacctacaatcagtgccactcaaagaataaaaatctttggcaaaatgtctttggtaaatttcaaagatcgttcgagcggaccgcaaaatggagcgcgtcatctttccgattcacaacatttgcgcctatctgacctccgagaccaaagagagtgtattcataaacacggaaaaggacgcgcaggggtcgaaagtgacggactttttcgaacgatggccctccctttacgaggaaatgaaatggcagcgcaaattgcagggtgattagtgccactctgatcagtgatcacccatcattgtctcttccgatcagatcgcctttggctgagtgcatgcacaaagcgtttgcccctgtggggccgaatgggctttttcatggccgttctgatcaatctgatcctcgccgttgcatatcccttcgatcatgaggactcatcagcagctcgtcctcgtatgttgtgatccttttgatcgtttccccacctctgatcacttcctcccgctttagtcgcactttctcccagcaatcccttcctttacatgtcatttgctgccgctctgttccacctctattcgtcctcctcctcctcgtcctcctcttccaactgctggtccctccctcgctcccccccccccactttgtgccaccctttcccctcccctcaggcaatgtcttggcctttccctatcctcccaactcggcattttcgctctgatggttagctccacgctgttgctgatcgccctgctcggtctcctcccctccctctatccccccccccgaaatgaaaatttttaaaaattttccagcaaataatggaaattttttcgaattcccccccccccaaacgaaaatttaataggcaattttcgtaacaaataacactctaatttcaaaaattttcccggcgacgcctatcggcaccgccggacctccactttccactatttttacaagttttgtgccttaaaacggtcaaaattgggtcatttttagtgaaaaagtgcagtttttaatgaaaaaaagttattggttaaatagcaaaaaaaaaaaaaaaaaaggtcttcaggtcgggtccccccccccccggaaaatgtttctagatacgcccctgc

SEQ ID NO: 67518 - DNA, 855 bp, Heterodera glycines
  Genomic contig location: Contig_ID=SeqID_8273; Location=283..1137; Strand=+
  SCN-specific regions: Sequence locations=1-313,335-441,463-564,593 -666,730-855
  Gene Ontology: Mol. function=inositol-145-triphosphate receptor activity; Cellular component=endoplasmic reticulum membrane; Biological process=signal transduction
atggttagctccacgctgttgctgatcgccctgctcggtctcctcccctccctctatcttcttggcattttccaggtcattatcgcaattggtccccaaaaatggttgaatttcttcggttcagttggccaacaaatgtgtccatttggccagttatgccggcaatcggggaattgttgagcgcaattggcacgaccttctgacggactccacaatgctttaccatggcggctatttgctgtgctgtttgttcggtttggtcgtccacccgttcatttacgctcttctcgtaataactaattagttaattaatcattgtccaatttccctcttgtttttcagctgtttgacgtcgtggccagcgaggacactcttcgaaatgtcattcgatcggtgacgcgcaattggcagtccatcattctgaccggcttgctggccctgatcctggtctaccacttctccatcgttggctatttgttcttccaacgcggtgccctccaaaatttgccaattgaatttcttcaatttattccttcagactttcgcttggaagtgcacaaactcagtgcacagcgtgcagaggaggggcaaaagccatgtccaaatgatttgccgtgcgaatttcgttttcattgcgacaaaaaaagtgacggcgaaaaatgcgacggaagggaaaaatggcggagaacggcggaaaaagaaaaggaggaggaggaagaagaagaggagctgaagattccctcctgcgacaccctgctaatgtgcattttgacaacacttaattggggtgaccatttgggaggggggaaaactcattcattaaatggtcgtaaattcattcaaatgagcatttag

SEQ ID NO: 67519 - DNA, 76 bp, Heterodera glycines; identical to SEQ ID NO: 53797
  Genomic contig location: Contig_ID=SeqID_38802; Location=55..130; Strand=+
  SCN-specific regions: Sequence locations=1-76

SEQ ID NO: 67520 - DNA, 356 bp, Heterodera glycines
  Genomic contig location: Contig_ID=SeqID_38811; Location=293..648; Strand=+
  SCN-specific regions: Sequence locations=1-78,100-125,147-356
atgatgagtcattttgagatgatcggaacagataatcaaatgtttccgcaaaatgtgcgacttaatccgggcttggcgctctgctcttccgcccctttcggaggtgccattcattgggtgccgaattgccttttcttcctttctaagggcacatcggcacatcgcttccctccgccgtcactgtctctcccgccgcagtcgcatcggtcggtggcggtgagctccaacagtttgcaattccgcgcatatcgcaacagtcgcaagctcagcccgtgcaggggttgcaatttgcattgggacagtcggcgatatttggcggagaatcggcgagagacggtggaggacagcaaacgcag

SEQ ID NO: 67521 - DNA, 3089 bp, Heterodera glycines
  Genomic contig location: Contig_ID=SeqID_8274; Location=194..3282; Strand=-
  SCN-specific regions: Sequence locations=1-119,192-349,374-376,411 -491,514-525,547-573,622-1600,1635-1755,1785-1798,1829-2119,2141 -2146,2189-2191,2216-2549,2571-2847,2926-2928,2955-3009,3032-3089
atgtcaagcttattgtcggaagtttttttgaacgaattaataattgttatggtcggaatttgcattcttgtgctttcagcactgtgtttggtggtcaatttggcggtcattcgggttcgaattataaaattaattttatttttgcattttccttaaataaaatttatataaattattttttaaaataatttctcaagataatcatcgtggacaatgagctgttccggttgagctgctacaagtttatgttggcactttgcttcgccgactgtgccctttcgtgcgtccatttcgtcaccggcttcttcacaatttctccaaacactttccatttagggatttgccaggcaattttttaaacaaattttaaaagctgtttaaaagaaataaataaatttaaaaatttttttggcgctttgttcagccgcttggcgcaattgccacgccgagttacgtattttacacaattgtgactattattttggcaattaatcgtttggttgtgttgacgtccgatcggttggataatttgctattctcaccaatttgcataaaggtaaaacaatttaaaggtaattatatttaaaatttttgtattgattatttttaatcatttaattacccattggctttagctgtggtttctgttgccggctttggtctcgcttagttttgcgttggcactttcctccccgtgggccgcaattgcctattggcccgaccaattttcgtgggcttacgacgacagtcggccgctgagccattgggtgcaaattgtggaggaaatcatcgaattgggcggcattccgacggccggcctcatttacgccgcaattttcttcacaattctctacaaggtggcccaattataaagttgatcaaggagagtaattagcattactttcttaatgcattaattagtcaccattatccccgaaattatttttaattaaaggatgttggttaaattaattggtaaaccgatcaactttttctctcggatttattcattccctttcactctcagtttccctctgctatcagttgcaacggcttccgatcattcagttcaatcccttgccatcatttgccttttctcatcaattttaatcgttaccgatcacttactttcttctgaccaactatttcaatcccttccgatcactttccattttgctcagtttctgtcttttcggatggatgttccgtcttctaatctaccgatcactttccgtcttctgatcagttccaatgcttccaatcacttgccgttccttcagatcactttctttcttttgtattctcaatcccttatctttagacacttcaattcttctgatcagtttaaattcatttcaatccagccgatcatttccctcttgaataattttaatcattaccgatcatccgtcttctgattagtttcgatcacttcctttccctgctaagttcctccttcttaagcggatcaatgggctcgttttgcgccagaccggcacagttgctgaagtgaaagtgctcatccaagcgtttgtcatcaccatttattgcaccgttctcaactatttttggcacaactctgaagtgatcttttaattccttttttttgttttttatttattattttattttatgattttcattttcagtggcttttgccaaacacaaaaatggcaaaatgtgcgctgaatttcatgtggattgccaacggggcggtcaatcccatcatttattttgccgtcaacgcgtaagaattgtccctacttttttattatacattttttattcgcaaaaatggaaataatttaattaatacttttttaatttagtgcaattcgtcagcgaattagcgcgtcttttggcgtttcgtctcccgcaaacactccgcaaatgttcccccatatttccactactgttcttccaccgcagcatcgtctgtcggtgccatttccaatgcaaaataattttttgtctacgaccaatttgccaagacgagcttcacggaattaaaggcttatataaatataacgatcatttaaaatagggttcggaccccgtgggcgggggtggcttttcacgggggcgggggtcagagtcgcggagacgggggcacgaaaattccgcccccgctggggcgggggtttgatttgaattaattccaaaaaattcacaaaaaattaatttttatgaatgtgtgttggctccacattcctttagtcaatgtttcgcctcgattcaattcctttggcataaattacacagattttgtctaaaaatgaccaaatttagggattttgggcgaattttttaagaaaaaataggttttggagggccggcgtgccgatatgggcgaattttaggcaatcgtaattaatttctaacagctattcaccaaaaattatatgttctttgagcgctcattgattagatcgacgattttgggaggggtgagagcggcaatgttgttaaagctatgctcccaagcagctgatcaccgatcgcaacagagaagggcggaattgctaaaaaatcttccttaatttgtttccaaattcatttaatagatttttcggtgattttttggacgggggatctttgctagcaaataaaggttttttgtattttgctcatttatttgatcgctaattttgcgaggggcggtgggagcgaaaggcaatgctgctaaagcaatcgccccaagcagctgatcaccgatcggaacggagaaggtcaccatttggacgtacaaaaaatggctaataaaatagagtgtaatgcgatcattttgtcattttcaccccgggattgagccaattttcgccaattttattactatgcgacttccttattaaattctatttaatttaattatttttaaattattttaattcattttaaatttatacttattttaatttaattcaactattttttactgagaataatattttattatttcaggtccaaaatgccttggttccggcatagcgcaaggcaaggtcgccgtcgccaataacaacaacaacagcattagggatcggtgaacattctttttttggatttaaaaatttctgtgtaaatttaataaa

SEQ ID NO: 67522 - DNA, 627 bp, Heterodera glycines
  Genomic contig location: Contig_ID=SeqID_8274; Location=3625..4251; Strand=-
  SCN-specific regions: Sequence locations=1-62,94-108,132-195,217 -229,254-390,413-445,467-627
atgtcttcttttgtgtcccttcttctgctgatcggactaattccgctgcatttaacccatggaaataatgtaaatatttaaaaatatttttatcgaataaacgtttgctttttaaaatttaattaattatagcgaatccgaagggatgcgacggaagaagaagcggagaacaaaagtgcagcaaacaattcgaccgaagaggaaacaagtaaaatgcaacacttaattaatttaattattcatttgattttctaattttcaaatttatccttttctttccgatgaacttttgaccaccacgacggaagtgccgaactcgaccactgccgaagacggcacggacttgtttgatcggatgctcctttcgggaatggacccgtcactggggccgatggaggaatgaaaattggaggatcaatttggagaacccattttggcatttcactttttgtaaaaatttgcatttttataaaattgaactttttgttccaagtctcatttgtttaattctgacaaaatgacgaatttacataattgccatttggcggtttcccgaaggattcgatctccccaaaaatctgggcgcatcggttcatggggactgcccgaagaaccaaaaaaaataaa

SEQ ID NO: 67523 - DNA, 447 bp, Heterodera glycines
  Genomic contig location: Contig_ID=SeqID_38813; Location=359..805; Strand=+
  SCN-specific regions: Sequence locations=1-356,392-447
atgtgcagcactgagcggtataccacagctccaacgtatggaagcaccccaaaagcatggctcgtgaggcagctgccccgtaatgttgggcagcgtccacaagtcagctcgaacgacctgtgcccgtcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataa

SEQ ID NO: 67524 - DNA, 580 bp, Heterodera glycines
  misc_feature (56)..(56): n is a, c, g, or t
  Genomic contig location: Contig_ID=SeqID_38813; Location=639..1218; Strand=-
  SCN-specific regions: Sequence locations=56-57,82-84,112-119,195 -266,334-469,505-580
attgacggaagggcaccaccaggagtggagcctgcggcttaatttgactcaacacnggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 67525 - DNA, 381 bp, Heterodera glycines
  Genomic contig location: Contig_ID=SeqID_38816; Location=66..446; Strand=+
  SCN-specific regions: Sequence locations=1-329,351-381
  Gene Ontology: Mol. function=protein binding; Cellular component =endomembrane system; Biological process=receptor mediated endocytosis
atgagtctgaatgggtcgtcacgagagaacgttacaaatacgatgagcaattcaatcttctacagcccatcgatgggaaaatatccggtattttggatgcgatgcttaatgtatcgaacttcatcccattaaggacgcgttgccaaggagcatatgctaaagtcaaaactcccaaattctgtgctcggaaagatttggaaattgtccgacgtcgacaaagacggacatttggactcggatgaatttgccctgtccaactatttgatcaatttaaaactcgaaggccacgaactccccacagagctgccaaaacatttggtgcctccctcaaagaaagcgatggctggcgatgcgtcgtcttccgacaaccaaatttaccct

SEQ ID NO: 67526 - DNA, 211 bp, Heterodera glycines
  Genomic contig location: Contig_ID=SeqID_38819; Location=66..276; Strand=-
  SCN-specific regions: Sequence locations=1-127,197-211
atgccgtcgaattttattaagtatcagagttttttaagtggaaataaaaatgaagtattgacaattaaagaattgattgattgccgtttaaaagtttgtgaaaaaaaatattataccattaaggcggatataaaagatttaaaaataaataaatacaaggtttgattaattaaaaattaaacaaataaaattttttcaggcatgttggtaa

SEQ ID NO: 67527 - DNA, 427 bp, Heterodera glycines
  Genomic contig location: Contig_ID=SeqID_38819; Location=604..1030; Strand=-
  SCN-specific regions: Sequence locations=1-2,24-217,253-281,303-405
atgtcacatgaaaatgctggaaatagtgtattagaatttgtatcagctggcagtaagcaatattcaattaagtataggaatgacaagaatggtcaaatatggtataaaacgaaaattcgcggtaaaatatgttatgttttcttgtttaattgtgctttctttagggataacttttaataagaagaaccaaattgatcatgatgaatttaaaaacatgattataaattatgaaaataataaaaaattaattttcgattatgacaagtttggaccaacaagagaaagttatattttatcaagaaatttacgaaaagaatataaacccattcaaaaaaaaggcattattggaaacaattttgaaattattccatttggtttatggtgaactaagtataacggtacgttattaaaaaataatagtaataaa

SEQ ID NO: 67528 - DNA, 507 bp, Heterodera glycines
  Genomic contig location: Contig_ID=SeqID_38821; Location=153..659; Strand=-
  SCN-specific regions: Sequence locations=1-76,99-108,130-227,249 -387,467-507
atgtgccggctgcgctggtggcccaacttcctctctattcctgcattgcaattgtggtgagttgagtgattttgatcagtggcaatttgaatgacatcattaatcattcttcccctctttcttttccttagactcatcacggccacttgaactctggccattactgctcgtttgtgcgtgacggcttcactgacaattgggttttctgcaacgacgacaaaactctcgtaagaaaacaatttcgaatcaattaatgccggcttttcatccattctttttaggccactgaaagctgcaatgtggacacgcgaaatgcctacattgtgttctaccaacgcgcaaattcagtcgctgccaaatgagatgaaatgagaggataaacattgttgtatatatgtgtataattgttgttgtatatgtatgtatgcgtatattatcgtatgtgtatattcatttgtatgtatgttcattagtattaatgatgtgttgatgaattaaaaaaataaa

SEQ ID NO: 67529 - DNA, 393 bp, Heterodera glycines
  Genomic contig location: Contig_ID=SeqID_38821; Location=388..780; Strand=+
  SCN-specific regions: Sequence locations=1-24,46-143,165-174,197 -300,322-393
atggatgaaaagccggcattaattgattcgaaattgttttcttacgagagttttgtcgtcgttgcagaaaacccaattgtcagtgaagccgtcacgcacaaacgagcagtaatggccagagttcaagtggccgtgatgagtctaaggaaaagaaagaggggaagaatgattaatgatgtcattcaaattgccactgatcaaaatcactcaactcaccacaattgcaatgcaggaatagagaggaagttgggccaccagcgcagccggcacatcgggcgaaaagtatttgctcaggctgaagttgtccaacgggaacgaaacgggcacgtgctgtttgatgtattggcgctcaaatggttcatagatgaagcgcttgaagcaaatgatctgtga

SEQ ID NO: 67530 - DNA, 1649 bp, Heterodera glycines
  Genomic contig location: Contig_ID=SeqID_100; Location=4169..5817; Strand=+
  SCN-specific regions: Sequence locations=1-187,209-360,390-511,549 -722,744-803,831-1039,1061-1070,1092-1649
atgctcaagaaggtgcgctatatgccgccaacggattacgaatgggttccggtaaggagaatgttgaaaaatttgtgcctgtttgagtaccgaggttgggcaatgggggatgcctattttgcgggtccggaattacataaggtaccattttttgtggattttagggccttttaaccgacggttaatccagcttttaagataaatttttggcactattcaaattaacacgaaaacaaaacaaaaaaaaacacgaccaaaaaataatttgacacattttaaagtaccataactttttctagcagcacccaaattaaacattgttgggtccatccgatagccacaagaattcctctattagcctaaaaattttaaaattaaaaaaaaattatgcccacaaaatttcaaaaaaaaaaaaaaattctttgaacatttttgaccataactatttgaaactttttaaaattgccaaattattttttggttgtgtctttttttatttttgtaaaaactgtaataaacccaaatttttgcaaatattttttcacatttatatttggcaattaaaccaaaaccgatgtggggttttctgccagaatttgtcaaaaaagagttaattttgatgaacttttggtggaacatttggcacatttaatgactaattactttaattgtggacaaaaaaattttaatgtttaaaaaatttgctattaaaaatggactatcccctgaaaagtccaccatttaaacaaatgataaaaaaattaaacattttgttctgctctttaaaatttccatttttcaattaaaataaacaaaacaaaaattttcatcaaatatttagcccaatggccaacaacagttagcgctgactgatggttctgccgtggcgatggaccacctccaatgggagaccatccgggagcgggtgatcaaggcgggcactgtgccaagactggtggacagtctgatcgacgaggacggacacatggacttgaaacaggttttttggaaatgcggtggaatgttgagggtttatacaaaacattggccctgatttaaattggggtccatttttggttaaattttgtttctggggttttttgaggttcgctgaccacaaatccgacatccactttggcgccaattctgatgcttaacccgaactaactcgaacaaaatttcgattttttttgttttcgaaatcgggttaagcatcaagaattttgctgaaatggatgatttcctgttttttagccgaaaatatttgctattctggggtcttatattaaaaaatttaaatgagtattatccaacaaaaaaatttttgaagcggaaattttaatcatttaacaatttttcgcaaattacatcaatatcgccatctctcaacataacaaatgctggcaattcaattttgactgccaattcataaaaacgaattttaatttttgtcggagtcaaaaattaaaaaaaatttccctccccccttatttagttcaaacgttttcttcgccatttgtcgcgccttttccaccgtggccaaagtgttccgactggtcaccgatttgtacacaaaaagtgattgggcaccggccgacgatcaggagaaaattcggcggtatttttgcggaaaatatggaatttgttta

SEQ ID NO: 67531 - DNA, 1862 bp, Heterodera glycines
  Genomic contig location: Contig_ID=SeqID_100; Location=13182..15043; Strand=-
  SCN-specific regions: Sequence locations=1-45,67-73,97-202,224 -248,276-329,351-423,445-471,493-519,541-547,589-616,645-780,802 -921,943-1023,1045-1070,1092-1117,1139-1166,1195-1224,1246-1273,1302 -1496,1536-1575,1619-1695,1861-1862
  Gene Ontology: Mol. function=DNA binding; Cellular component=nucleus; Biological process=histogenesis and organogenesis
gaaaaggaacgggaaaaggaacgggattttagaatttgggaaaattatgaaaaggaacgggaaaaggaacgggattttcggttttgggaaattattaaagggaaagggaaaaggaacgggattttcgattttggaaaattattaaagggaaagggaaaaggaacgggaaaaggaacgggattttaaaatttgggaaaattatgaaaatgaacgggaaaaggaacgggattttcgattttgggaaattattaaagggaaagggaaaaggaacgggattttagaatttgggaaaattatgaaaaggaacgggattttggattttgggaaattatgaaaaggaacgggaaaaggaacgggattttagaatttgggaaaattatgaaaaggaacgaaaaaggaacgggattttcgattttgggaaattatgaaaaggaacgggaaaaggaacgggattttagaatttgggaaaattatgaaaaggaacgggaaaaggaacgggattttagaatttgggaaaattatgaaaaggaacgggaaaaggaacgggattttggattttgggaaaattatgaaaaggaacgggaaaaggaacgggattttcgattttgggaaattattaaagggaaagggaaaaggaacgggaaaaggaacgggatttttgaatttgggaaagttatgaaaagtaaaggaaaaggaataggattttcgattttgggaaattattaaagggaatgggaaaaggaacgggaaaaggaacgggattttagaatttgggaaaattatgaaaaggaacgggaaaaggaacgggattttcgattttgggaaattattaaagggaaagggaaaaggaacgggaaaaggaaagggattttagaatttgagaaaattatgaaaagtaaaggaaaaggaataggattttagaattttttaaaattattaaaaggaacggaaaaaggaacgggattttagcatttggtaaatttttgaaaggaaaaggaacgggattttagaatttgggaaaaatatgaaaaggaacgggaaaaggaacgggattttcgattttgggaaattatgaaaaggaacgggaaaaggaacgggattttagaatttgggaaattatgaaaaggaacgggaaaaggaacgggattttcgattttgggaaattattaaagggaaagggaaaaggaacgggaaaaggaacgggatttttgaatttgggaaagttatgaaaaggaacgggaaaaggaacgggattttcgattttgggaaattattaaagggaaagggaaaaggaacgggaaaaggaacggtgattttagcaattcgaaaaattatgaaaagggaagtgaaaaggaatggattttagaatttgggaaaattatgaaagggaaaggaaaaggaatgagaggaaaaggagtttagaatttggtaaaattatgaatgggaaagggaatgggaagagggaacgggaaaaggaataggattttagaatttgggaaaattagaaatgggaaagagaaaaggaattggaggaatggggttttagaatttgggaaattggtaaaaggaataggattttagaatttggtttaaattggaaaggaaaagttaaaaggaatgggattttaggatttgggaaaattatgaaaggaaaagtgaagaatgggattttagagtttgggaattttaggaattgaaaaggaaaaggaaaagaaaaatgaaaaggagaaggaaaagaaaaagggaaaggaaacggcaaaggaaaaaggaaagagaacgggaaatggagagggaaagggaaagggaaaatgaaaatggagaaggaaaaaaaggaaagagaaagggaaagggagagggagagt

SEQ ID NO: 67532 - DNA, 252 bp, Heterodera glycines
  Genomic contig location: Contig_ID=SeqID_100; Location=7992..8243; Strand=-
  SCN-specific regions: Sequence locations=1-20,50-252
atgttagcgtcgcccggtgcccaaacccaaattttgttgtggggagaaaggcattttttttgcacgtgtaagttacttgtataaataaattttcaattcaattttgtttggaactcacatcattgacaccaatggcacatattctggacaaataaaaagggaaatttccgcaattgtacagacgccacaggtggaagtgacggacaacacgtggcaaaggcaaatgctgacaaaaaatggggcaatttttaa

SEQ ID NO: 67533 - DNA, 1154 bp, Heterodera glycines
  Genomic contig location: Contig_ID=SeqID_100; Location=10466..11619; Strand=+
  SCN-specific regions: Sequence locations=1-76,98-475,500-555,577 -893,932-1051,1077-1128,1152-1154
atggtttcagctaaattgccttccatcggtcgctattcctttgccatcaccggatacgacctcaaccaaccaacgaaaacaacaaaagcaacaacaaccggggttagtttctcacaaaatttgttcccttgagctaaattaattgcaatttttcaatttcctcagcctcaatggcctgctgcgcactgcacaagttggacgaggcggcacacccgtgtctgagcatgatcaactacgttgttcgatggcactgaacgacggcacagaaaaccaaattggttggcaaaaaagcacttacacacaaacaaacacattgttaccctttttgcatgctcataattaaacaaacatgcttttaaataaattgctgcacccaaatcaacggcttttgataaattgcattactacaccaaatatacacttacacatttttaaattatactgccttttaatttactctaaacaatgaaacatttataaaatatggcattttcagactgttacaaaagttataagtaaaacaaatatacagtttagtccaacaactcttaaagcaacaaacaaatgcgaatttttatgcacaaaatactgttttttacaaacaaattctctatcataaacgcatttctattatttttttaaaaaattgatacattcacattgttttttgtactatgagtgaattttgatattaaaattttgaaaaaaataagaaaatgccatatacgaatactttttgggcgatactatagatggtggatggtcaacctttttgaaaaaaatgttttgttttagaaagtcaagaaaaattgttatggagtttttttgggtaaggaacataaatcaaatattcattttgaacaatttcgaatgccggacccgcattttgaacaacatttcaaaaacaaaactttttaaatttattatttttgttagcaaaattgatcaaaatttgtgttccctgacccagaaaactcccaataacatattttcacgaacttttgagaacaaaaaaaattataaaaagattgcccaaacaccatcaatagtattactcttttttgtttattaaggcacgtgttaagggctacaaaacggttatttgacttaaatttacagccctactacaaatataaaaatatttttttttacaa

SEQ ID NO: 67534 - DNA, 478 bp, Heterodera glycines
  Genomic contig location: Contig_ID=SeqID_1085; Location=741..1218; Strand=-
  SCN-specific regions: Sequence locations=1-478
atggacagcgatgtgctgggactggtcgggccgtgcctgctcatggaaagtgcccagggcgtggccgatttcgtgggcgattatgccgaccaaatcacagccgggcgtagcgatggaaatgccctgggcaagtgccataattcattgcgcaaatcgttccctagctgctctgctcgatcactcacttgcgttccgcccgccctcccgacaaaactcgagcatccgccgccgtcaaaaaattcgatccgatcggtgtccggcccgccctcaatgaagcgaaggcacgttgcgttctgccaaatggccaatgcaagccgtattttctgccgtgtctgaagtgagaaggccgaccatttggccttgcccattaattgccgtgcccaccttttccggcacattttccgccatttcgtaattgatcggtcgccgtcggtcccatcgtttgtagaagggttccaaaagcaaagcaaagattaaa

SEQ ID NO: 67535 - DNA, 3870 bp, Heterodera glycines
  Genomic contig location: Contig_ID=SeqID_1085; Location=80..3949; Strand=+
  SCN-specific regions: Sequence locations=1-425,459-512,534-1325,1351 -2900,2922-3055,3077-3091,3113-3124,3344-3768,3790-3870
  Gene Ontology: Mol. function=metallopeptidase activity; Cellular component=integral to membrane; Biological process=body morphogenesis (sensu Nematoda)
ttttcttttccatgtccaccattgcatttctgattatcttcagccttttgctattcaatcgttcagtcgaagaacgaacgcgaaaggccagcaaaagcgcagttgaacaaatcaaaaagattttcaacgaaaaagcgacgcaacggtaaaaaagaagagaaaaggaaaaggaaaagcccactcgcctctattgaaatcggcagaatcattcgctttcagtgcctttgcacagaatgacgcggcactgatggcggatgagccccggcggggatttgtgccgagaagggacccaacggcaagaaggcaccacgacgaattggcggtgaacggagaggacggcgactattttgagggcgatttggaattggcggaatggcaggcggagagactgtggcacaaattgggagaagcgaaagcgaacgcaaaactgaagaggaggaggaggaagaagagaaaaatcgcaaaagtgaatgggaaaaggggaaagaataacgttttccaaaatttaataatggggaaattgaaatggaaaatccccgggaaaagtcaaaacgaaacgacgagcagagaatgggacggcatttcgctttaagtgatggcacagacaagagattgggtctgaatttccatgcttctcatcttggcccctttctcggctccatttaatctttgctttgcttttggaacccttctacaaacgatgggaccgacggcgaccgatcaattacgaaatggcggaaaatgtgccggaaaaggtgggcacggcaattaatgggcaaggccaaatggtcggccttctcacttcagacacggcagaaaatacggcttgcattggccatttggcagaacgcaacgtgccttcgcttcattgagggcgggccggacaccgatcggatcgaattttttgacggcggcggatgctcgagttttgtcgggagggcgggcggaacgcaagtgagtgatcgagcagagcagctagggaacgatttgcgcaatgaattatggcacttgcccagggcatttccatcgctacgcccggctgtgatttggtcggcataatcgcccacgaaatcggccacgccctgggcactttccatgagcaggcacggcccgaccagtcccagcacatcgctgtccattacagcaatatcccggccatccgatggaacaatttccaaccaattggcgacgaccaagcgcaaactttgggtctgccatatgacgcgggtcagtaagtgttcagtggcccgaccagcagaaggtcacttggaagtggggaaagaaacggcaccaccaaattcaattggccattcttggcacatttcctctctctctctctctctctttctcccatggcttacttcgtttggccattggcatggcatgggcaaaggcatttgttaaggctcagtgatgcattacggcccttttggctttgctgccgaccaatttaggccaacgatttcgacgttggacaaacattggttagtttttgattggcttatgctttctttgcctttgctttgtcaactttgggtcactctttcgttaattaaattcgattttctaattgcttttttgcccaattgtctgatcactgatcgattgtctgtcccttcctctctttcctttcttttccttcttttccccctttttggcagtttaccatcggtcagcgtgaggcgccttctttcctggacatcgaagcggtttctgtttttctcctttggaagcagcaattaaacccccggggcaggggacagtcccaggggaaaagcaaagcataaaaggggcccccgaagggataaaagcttaatcacctctcacagattaatcgtgcctacggctgcactggtcagtgcccaaccgatctgtggtgtttgcatggcggttacacggaccccaacgactgttcgcgctgcgtttgtccgatcggatttggcggcacattttgcggggaagtgcagccgtctccatgtggcggagtgatcaaagtatggggaggctgatcaaacggataaaggaagtcccaatcactcgttaaaatcattctcatcatggtcatgacaaataatcagttttcattccgatcggccactggtcaaattttgttcaaccattttagctccattttttgtaccgatcattcaccccattgattgctgcttttcattgatcaccccccacaggcttctcccatggttcaaaccgtcgcttctcccgacttcccccgcaattttccgtccgatttgttctgtgtttggctttttcgttcgcctccccagggccaccttttcattgaatttgtcgaggagtccttcggttatccatgcgaagatacttgtgacaaggctttcgtggaactgaaaatgggcccggactttcgtgttacgggttacaggttgaaaagttggaaaaattttgcttttttacttttaatttttcaattcgaccgttagattttgctgttcttcgcctccgttaatgacttttcaatcggttggcgaagaagcagtgatcattcactatggaggaacccaaacggagcaacgcgcgggtttcaggcaaggaaaaccaatcgattgggcttgtacagacggatcagcggtgctgatcagcgattttgatcagattgcgctttttcaatgatctatgcttttgatcactaacattgaccggtgtttaggttctgatcagaaatatattagcaagaacacagtcaaatatcagtcattcagtcaaaagaatcaattattggaagtgataattgccacgacccaagcttagggcacgcgtgtggagtgaaaagaaatggtcggtaacaacagaggaggaagaacaaatcagcaccgaaacaaaatggggaaatgcagtgaatggagccgaagtcagtggcacagaaagggcgagcacaacagaagcgacaatggcacagacaaacggagacggacagaacacgacgacgcgtgagaagccaatgccaacttcgcagccacccccagaagtgccaatgacatcttcgtcctcctccttcccttccgttatgccaatgccattctcttcctcctccccctccgttatgccaaggccattctcttcctcctccccctccgttatgccaatgccattctcttcctcctccccctccgttatgccaatgccattctcttcctcctccccctccgttatgccaatgccattctcctcctcctccccctccgttatgccaatgccattctcttcctcctccccctccgttatgccaatgccattctcttcctcctccccctccgttatgccaatgccattctcttcctcttccccaccgcctcctccttcctctaatgagtgctctttatgcctacaatggtccgaatggaatgactgttcccaaatgtgcggcggatgtggtcgtaagacgcgtcgtcggcactgtccttccgctgtttcatgccaaagggaggaaaagcggatttgcaatcgaatggcatgccccgaaggcaccaattttctgttcaataacggcgagttccacctgttgtggaagggctgctgtgtagggctgttcctgaacaacagcacggcaaagggtgatgggtgagtggggggggggggggggaggacaaacaaacgatggccggcgaacgagccgaaggatccgccaaaactcagcaaaatctcactgccaatcatttcatagtttcatggactaatattcccctctttttgagttcgtccgtccgcggagagtgcggtccgttggaaaacagtgaaaacccttttttacgaattatttcgtctctgctgagttcgcacgacggacaaaaagaaaagacgaaaagaaatggggggaaaagcaaaagtggtgaa

SEQ ID NO: 67536 - DNA, 1194 bp, Heterodera glycines
  Genomic contig location: Contig_ID=SeqID_1087; Location=641..1834; Strand=+
  SCN-specific regions: Sequence locations=1-235,257-371,402-488,512 -769,794-1194
atggagcgaaagaagtcgacgaagttggcgaatgtgagtttttccctaatgtcactgcattttgtccaacatattcctttttcccacaggtaaaactgccaacactttgacggattttctccccgaatttggctccgtttttcccgatggcactacaaaaattgcctcagggctccatcaaatgtttggccaattctatcaacagtcttccaacttatttccctcgtctgccgaagacaaaacatctcaaaatgaaaaggcaacagaaaatgagcgtttgtccgtgggaggaacttcttcttcccgagaaaacatttgccaaagatgggagcgaagggattcaccagcaaaaatggtctttctaaaaggggttttatgtgtattttaaaaatgttttcagtctcttccgctgaccgaattcagctgttccgtggagggcgacgaatttgcacatttggcggaccaatttgccaatggtaaaatggaggaggaaaaggggagggaaaaagtgcgagtggagcggaagagaatcgttgtacgacgcaaaaagctgaaaaacaatggtcgacggagaagggaccgcgaagaggaaaagggggaactaaagtgggaccaaaaaaaaacaaaaaaacaaaaacaatgctttaagaggaaaacgacggaagccatcggtggatgaagaaaaacggcacgaagaaagagacaacgaggacaacgcgacactgacagattgggaacagcagaggacgaccaattggacaacgccggagggcgtggggacggagggaaggggcggccgatggacgccgggggcagtgcccgacgagcgacagcagcagattctggaaggttggaaggagaagcgagaaagtctgctgccttagttcatgtgaccctttgtccgatttagtgttgggaattgtgccaaaatcgatggcatcttccgaaaacggctctaaagaaatgctaatacttcaaaaactgcaaaaccaaccaatgaaagacgacaatgaattggaggagggaccaaatggaagtcaaatgagtaaaaacgtaaatgaaaggacaaaggacggcgaaattgacagtgaaccattggccgatttgaaagtgcacaatgccaatgggtactctttcccgccggcaaaccgtggacaatttgtggaggacgaggtgggcagcagttactcgtaa

SEQ ID NO: 67537 - DNA, 365 bp, Heterodera glycines
  Genomic contig location: Contig_ID=SeqID_8275; Location=204..568; Strand=+
  SCN-specific regions: Sequence locations=1-365
atgtcctcttccccctcaatgccatcaccacacgaactgatcagacaattgatgccgatgagcaatgatctccaaaacagactccagcagcagaacggcacggccattgctcaaatgccgccgaacggattaaatgtttgtttgaataaaaattcgaaaaaacaaaattcaaaaatcaaaaaaaaatttagattttctccgcccctcaaaagccctttctgatgccgccgcctcttctgccgattggcccaatgcaaagtttggcacacctccaatttctcggccttttggccaaggcccaacttttggcacaatgccaaacggcggcacagcaaagcgtgccgggcataaataaggcaaaaata

SEQ ID NO: 67538 - DNA, 367 bp, Heterodera glycines
  Genomic contig location: Contig_ID=SeqID_8275; Location=636..1002; Strand=-
  SCN-specific regions: Sequence locations=1-165,206-247,326-367
atggagactggtatattatttttcaacctcctcagaagggggtatataattggaggctggcagattaatggagactggcatataaaaagagtatatacggtggtaagtaaggagaagaagagcacagctgaataggaaggcaataatttcaattggaaattgcccaattttttaaaaagatattaaatatttttaacaaaaatttgcattggatatggggatggtgaaattatttaaatttttcccgatttaaaagattaaactattattttaaatattttcagcaaatttcaatttctattattaaaattattttaatatttttcagcaatattttaatttaggttttcacagctgtaaaaataaa

SEQ ID NO: 67539 - DNA, 651 bp, Heterodera glycines
  Genomic contig location: Contig_ID=SeqID_8276; Location=22..672; Strand=+
  SCN-specific regions: Sequence locations=1-163,185-651
cccttcaagtgcaagtactgtaaccgtaccagcaagtggaaggccgacctgatccggcacgttgcgagtaagtgccgagatttgaatgtttgggaaatcaaatccatactcccgaattcgagactgatcacaagaaccaagtttcagcagagatcttatatttgaaatttgccaattatgaaaatgaatagcaaagggacccatttttggtccgaaaatttttggcttgaagaaccctgttggattacaaaagtttttgaaaataacatcctaggaatattattttagaagagaatgatcccaaattatcttaaaaaacaatgcgccactcttcggcgccaaaattgcggtgcccgatttagctatcctgctaaataccattttatcccaataatttgtttgattcaaaaagtgccaaaaaaaatttcaaaattttcagaaacccacggcattcgtgtggtgtccaagtacagtcggagcaaagcgttggagctggacaagcagcaacagaagcaattgttgatggtggaagaagcggtagaggaggaggaggaggacggcggaagagcttttgattcatcttcgtcatgctgtgacagtgaaacgccgacaaaggacgagaacaacaatcaaaataaggcaaaattttaa

SEQ ID NO: 67540 - DNA, 997 bp, Heterodera glycines
  Genomic contig location: Contig_ID=SeqID_8276; Location=1176..2172; Strand=+
  SCN-specific regions: Sequence locations=1-261,285-495,530-575,602 -781,803-808,837-997
atggcacgcaacaagcagctggtgcaacgccaacaacagaagcggcgaattgatgcgatagtggagagcggcgatgaactcgctggtgatcagcgaccggtgattgacaactcgcaacactctgccgaactcgctgatcttttgtcgctgaaacgagagactgaactcgctgatcacctgtcgctgggcttgcagcacaatgccgaactcgccgatcagctgtctctgaacagagaggcagaagtcgctgataagctgtcgctgggttcccactattctcctgcactcgctgatcaattgtcgctgggcccccagcacactgccgaactcgctaatcaaatgtcgctgaagagagaggcaaaagtcgctgatcagttgccgctgggtcctcagcacactgccgaactcgctgatcagccgctgtcgttcccgaactcgcacgcttctgctttcgctgctggctcagtcgctgaagcgtcgaaactggcacactcgctacatcagcaacagcagcagcgtttgcagttggacgcgtcacttgcactgcttcagcagctgctgaatattttgccgccggtggcaccgccgccgccgccacccaatggcacagaacagtcgcgggacggcaccgctgggagcatttttcggcctaaaatggcatgaaaaattgacgaatataaagatattgaacacccatatttgtctggcatttcttttttgtattgtcgcgatgcgacgaattttctgtccttttaacgtgacattgtagggccatgccgggatgaatgtttaaaaaattgaaaagatgaaaatttaaactaatttttaaaatttatggtttttaaatcgaaaaattgtcaaaaattttttattgggctgtaattttgccttaacaagtcggcatttatagagtttttttttcgggggagagaaaatcgtgccgggtttttaggctttgctaggcttaacaaattttcgcttgattaattaaaattta

SEQ ID NO: 67541 - DNA, 915 bp, Heterodera glycines
  Genomic contig location: Contig_ID=SeqID_38824; Location=174..1088; Strand=+
  SCN-specific regions: Sequence locations=1-750,779-788,810-915
gtacatcgatcactccgtcatcgcttttcttcgttcaaatcatcaaatttttgacaaaagaggcatcgatttacatttgtgtattccttattcaaacaccacggatggccagcggatttgggacatttttggtcgtgaaatttggccaattttttcgacaaacattcatcacttgcgctataccggtggtgatcatttggacaatttgcttcgtcgcatttcgccgacaattctcatcgatcttgatcagttgacttcaatccattcatttgatttgttgcccgctgcgattggtgatggttttaatgtgccaaatgaaacaatttctgctggccaagcattgtccaaatggttgcacacaccgagaaaagatggccaacccaagcgattgcataatttcaaggaggtgtggcccaacatttttgtgatttttgtttttccaatcaaattgtttagcattttctccgtgccaatgccatttcttccgtcacttacgaaattcattttcctattcatgcgccgtcaatacaaatggtgccatttgaatttcttaacgaatggacaaaggaaaagctgacaatgaccaaagcaaatgaaaatgaattgggcaaccgatggataatgaaacgatgcaaaattattggggagaccgcggcggttcagcagcagaagaaagatgacaattgtaacaaagtggccatttggctttacatttgcaatgattgcattgggtgagcaattaaaaaaggcatttaattttgtttaaataattaaaattccgcctaatttagcccattgtctcctccaccattcgcagaagaatccggacaaagcatcacaaaagggccgtcttctgctgacaaaatgagtgatggacaaaacaacaaaaacagtgatcagatgcagaagaaatga

SEQ ID NO: 67542 - DNA, 304 bp, Heterodera glycines
  Genomic contig location: Contig_ID=SeqID_38825; Location=437..740; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttatcaaaaaaagagatagccatttttctgggatagagtataaatttaaaaattccctcaaaaataaaaggtctattgcgcaccgccctccctatcatg

SEQ ID NO: 67543 - DNA, 355 bp, Heterodera glycines
  Genomic contig location: Contig_ID=SeqID_38828; Location=648..1002; Strand=-
  SCN-specific regions: Sequence locations=1-355
ctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaa

SEQ ID NO: 67544 - DNA, 868 bp, Heterodera glycines
  Genomic contig location: Contig_ID=SeqID_38829; Location=122..989; Strand=-
  SCN-specific regions: Sequence locations=1-51,131-219,242-265,287 -523,545-556,578-747,777-868
  Gene Ontology: Mol. function=protein binding; Cellular component =basement membrane; Biological process=synaptic transmission
atgcacagtcatcgcattgagaatattgtgttggaaaatgtggggctaaagttaaaataaataaataattattaaaaagaaaatttgtttttttaaattttagtaaattttatcattaaaaatttttattctgtaaatttgcagagttttgaaaatcgcacaagcagctggtggcaatccgagaatggagtacaggtcagttcaatgcaaattccactcttttttaatttaaaataattgaaatgtctaaatgtatattggcgttttcaagaataaatgcatatttaccattttcgcgtttttaaagcatatgtctcgtttttttggaaatttttacaagatgaaaaaacgaaaaatacacccctaaggaccgactttttggaaataaaaaaaatacatttagtgcatatttggcaattttcgagtttcagtgattgttccgacgccctcaaaaaatttcggaaatcggatgaaaaaaatttaaaattgcaatttcgctataatatcggtaatcagcaagccgatacatcatacatatattgagatattttacatcaattaattaattattatttttctaattctgcagaatgtttcaattcaacttgacctggaggcagaatttcacttcacccatctgatcatgatttttcgctcctttcgtccagcagcaatgttcattgagcggtccaaagattttggcaaaacttggtaaaaacaaaagttagcgttcacttggtgaaattaagaaacacatcaccaaaaatataacaattgtaacttttatgtatttgccattttaggactatttaccgttatttcgcttatgattgctcagcctcgtttccgaagtaaacaaaaaaataaa

SEQ ID NO: 67545 - DNA, 937 bp, Heterodera glycines
  misc_feature (893)..(893): n is a, c, g, or t
  Genomic contig location: Contig_ID=SeqID_38830; Location=28..964; Strand=+
  SCN-specific regions: Sequence locations=1-32,74-106,217-240,263 -427,450-675,707-904,926-937
atggcaaaaagtcaaatcgcgtctctagttggtaattaattattgaattatttgattttttttttttttttttggttttttcctgagggatctcaaaaagtagatcaaattttttcaaaattctattttaattttatttaaccctatttttaaaattttttacacaatttaaaatttaatgtaaaaatataatttcatataaaaacaaattaattagttaatgctttttcagcacctagagaaatttaaaatttggcccaaatgttatggcatcccactaattatagatttttcataaaaatcctttaattaagtgtaaatatcttcctaaagtctatatttttttaaccgagcagtttcctaatctgcaaattttagaggcagaattttcgggaatttttacggcacccagttacccctccgctgtattaaaaaagcaaaataatatttcaatcaatttaccggttcttcgagcagttcaacaacatttttgcaccgctgttccaaccgggacagtcgctgctccaactgttccgtgtgcatgtgttgttggagcagtaacagggcgaacagcaacaggaacagaaatggacaaatgcgatgcacacaatcggtggagggccaaaggttggccaattttgaatttggcgccatttcgttggcatttgtgtggcattttggtttcatttttgtggcattgtgtttggccgacttggacgtgttgaaaaatgtggtcgaatttgttgtggatgatgaagaagcaaatgaagagctgggaaaatcctgaaatttttaaacaaattcagattgaattttgggtgaaaaaaaaattacaattttaatttttggataaattttctaagtcatttttaaggatcttctttttaaaaatnaaaaactacatggcctgtgtgtggggaaaaaattgctacaaata

SEQ ID NO: 67546 - DNA, 78 bp, Heterodera glycines
  Genomic contig location: Contig_ID=SeqID_38831; Location=635..712; Strand=+
  SCN-specific regions: Sequence locations=1-78
atgcccgtccgtggcaacaaattttcccggatatttccttcccacccgacttcgtcaaagagcgcgttaaactcgacg

SEQ ID NO: 67547 - DNA, 1351 bp, Heterodera glycines
  Genomic contig location: Contig_ID=SeqID_8277; Location=1039..2389; Strand=+
  SCN-specific regions: Sequence locations=1-166,188-601,623-718,741 -950,990-1351
  Gene Ontology: Cellular component=nucleus; Biological process=RNA processing
acagaatttccgcagaatggtggcgatgtgcacgtaaaaatggaaattgacagcgaggagcaggcgggcgaacaactgcaatttttcgccaaatatttgacaagtcaaaaagtgagcggtgggagaatgccattcttttcactcgacgcattaggaaaattaaacctctgtctttttgagttttgaaattaggaaaacaatttctgtcttacaattaacatgaagctaatggctccgtctttgggcaactgtttgggtttttatgttgtttctttcagttgttccctttgcaattggccgactcgcagttccgtcgctattttttactccaatatttgatcattgccaattaccttctgctcaaagtcaaactgaaagagtgcgtgtttttaggcataatcaaaaaataaatattgtgaaagtataattttttcataattttgcatttttcaaattaagtacctcacaatttcagcactttcacgctcaccacgctccaggaagaagaggtgcgcgagctgaccgacaaatgttttgcacttttgcgtgagacccatcccaacgggtcgctgttcgccgatgcggtgaaggtacaccggttttcactaaaactatataattttgaaaaatttacaaattcaacatcgtaaaaaataagaaactgaaaaacgaaatagaacttcgtaaaaatttttgttgaaattttaacatgttgtcgattattaatattatcttattttttgagccgttgtatttttttaaatttcagaaagtgctcagccgtgaacgcctttggtccacctggaagaatgagggttgccctgatctgatcacgcccctgctgaacgcacaaaccatcgaaaaatacgcagcatttaaacggtaattggacttattgagcaaagaaaatagagactgaatgaaatgaaaatgcaaacaatttttgatacaaaaattaatttttttttaatagaaatattttatttattctttcaacattttttcaatttttttcatacttaatgaaaaaaatacattcattaaatttgaataaaaatcttcaaagaatttttaaatcaaaatcttactccttttttaaatttatcgcaccattctttgcctctgtttgcagaaaggcggtggcccaatgcgtcgctggccaattggaccttggcaacaaagaaatgacgcgcttgtggaacattcagccgaacaatttgctggcctgccggtcacagaagcgcaactgcacgcccgaccttgtccagtttctgagcgacgcgcttgacgagttggacccggaacagcaggtggacgagcagtaccaaagcgtcaacgacgagaagtacca

SEQ ID NO: 67548 - DNA, 904 bp, Heterodera glycines
  Genomic contig location: Contig_ID=SeqID_8278; Location=106..1009; Strand=+
  SCN-specific regions: Sequence locations=1-162,186-220,248-364,387 -406,449-602,728-746,772-904
  Gene Ontology: Biological process=N-linked glycosylation
atgttttacgatttgaagtttaagagctccaatgttcaagagtccaacagagtgccgaccgtggccaatgcttccgctgtttccacttcaactgcatctttcctcaagaagacaattaaactgactgcggaaaatttaccggttaacaattgatggacaaaatgaaattgagaaaaagaagaaaatatttttgtttttttcttgaaaatttatgcttttgaaaataattcaaaattagaatttgttttttaccaaaacttttctgacaacatttttcaaaatagcaaattctgagagtttttagtccaatcttttaaattagattttttaaaattaggttttgcgctttggtgcttttaggcgtttaaaaacttaaaagaaatgtatagtgttttaaaacttacctattttttatttgaaaaattttatttcccaatttctctttcagttattaaaagaacgcgcagagcaaattcaattggcaacaaagaaaattgaagaagcggcaaagaaaagcgaagaaacaacgaagaaaattgaagaaacaatgaagaaaattgaggattcagaggccgaacggaagagagagcacagcgccaacggagagaaaagtgagaagcgagagagcgaaacaaaaagcaaaaagagagaaagagaaaaagagagcgaaaacgaaaagccaaagaaaggcgaaaacgcgcggaagagagagtcgagaaagagagagttcaagaaaatccaaagttgaacacaaacaaacaaacacaccaatgtcatcgtaattgcattcattcctcaagtaaaatatgtatgtccacgcagttttcgtaccaaatgcatttttttgttgttgaagaggaattcaaaagggatacaccacaaaacgtcggcgcaaaaaaataga

SEQ ID NO: 67549 - DNA, 1662 bp, Heterodera glycines
  Genomic contig location: Contig_ID=SeqID_8279; Location=800..2461; Strand=+
  SCN-specific regions: Sequence locations=1-485,507-1287,1309 -1374,1396-1662
atgccaagtctgttggcagacgagaacgatacccatctttattatgtcagagcatactgtatgaaccgaggcaaaagattccacgccaactacggtacatttgtcgtgaatcggtcagcagcagccaatgaggacaaagtgaccattagctttgaacagaaagaaccctgtgactattatgccgcggaagttctgctgatgcggtccgggagtctctacggaatgggatgggtaaggaaaagggaaagaaaacgcaaaaattgaaaaattataccgaaaaaatattttgcagttacaaaattatgagattggacaccttgaaaacaatgggatgaaccatcggattctgttcggcaattatttccatctgaccattgggcccactttgaccactgaaaaccttttctatcacatccgagtgttttgcgatgcgaaggaaacgccaacaaaaaggaccaaaactgacggtgacggattaataattttggggttttccagaaacgatttgcccaaagaagccgagaaattctcgggtcaagtcagcaaccgaggcatttgcgcactatttttgattattttttgttttgtaatttagaaaacggtgtaacctccgatactttggaatttcctgaaaggccgtgccaatacaacgaataccatttcaaaacgttcaccaaatcctcaacaatggttgtgttcggcagtgagttgcggctgtgcaacacttatcacgtcaaagtgtgggcaacgccaacggaatggaaattgaaatatgtacgaacatacagtacagtaatgggctgacaaaacaagcagactgtgctttcaacaattgttactcaaaaaattatcaaaatttaacaaaaagttttcctaattttgttccaaaacaatcaaataacaaaaatgccaggctctaaccgatggggcggggcgaggacaatttcccattcgcccgaaaaaatgttaaaaatgggaaaatttctaaaaaaaaaccatcgcattcttgccaaattaatgcaaaggttcgaattgcggctagtgccgatcagtcctcccccgggcgagtgccgatcagtcctcccccgggcgagtgccgatcagtcctcccccgggcgagtgccgatcagtcctcccccgggcgagtgccgatcagtcctccccgggcgagtgccgatcagtcctcccccgggcgagtgccgatcagtcctcccccgggcgagtgccgatcaattccccacctcgggcgagagctgactccccaggcgaatgccgatcagtctcccaccccaccccctcgttttctttcaaatgccctctcttcagcccgacgagcgtccaatggtccatttcgtgtgcagctcctacgggaatggtgaaaagcgggaaattgtgttcaagagaaattttcacctacaaattacgcccgcccttggcgaaggggaggaggaaaatgtttattatgccgaagttgaatgcaatgggaacaagtaccaaacattcagaacattcacaaagtccaaaacggacgtggtgctgcacgtttccgactgcaaaagttacgacttttcggtgcgcaaagtgccgaaagcgttgtttaaaccacaggacaacatgagaaaagtgcgttttcaattaattctatcggaaattgcagtataa

SEQ ID NO: 67550 - DNA, 514 bp, Heterodera glycines
  Genomic contig location: Contig_ID=SeqID_38832; Location=249..762; Strand=+
  SCN-specific regions: Sequence locations=1-386,408-514
atgagagccctctggcgtttggcgcgggccttcccgggcacactcatccgctgcatttgcttctacgccgcccaagccctggagatcgaacggttggtggcccaacaagaaatcccggacattttagtgacgacagcggacgcgacacagggccacgagtcgtcacttgccgtcgtcgtcacaacatgctccgtcttcgacagtggggccgactcgcagcccttctgggcggacgctgctcgcgtggacgtcgccatctctcgtgccagccatggaatgatcatcattggcgatttgctgctgctcaaccggacggagacgtggcggcgctacctggaccaagcgacgactgagacaacagtggtcggtccggagtacttcgacttcgagcagttcaacaaccccgacaactactacgacaaggacggacagctgatctcagccaacggcggtgcggtacggtcagagcatttctacagcaagtacggtaagaatgtgtggtacaataactccg

SEQ ID NO: 67551 - DNA, 1066 bp, Heterodera glycines
  Genomic contig location: Contig_ID=SeqID_38834; Location=264..1329; Strand=+
  SCN-specific regions: Sequence locations=1-235,312-877,899-1066
atgttcatagtttgcgccactataaaaacaaggattgttttttctttattactgctattattaattaattaccctcaatgttttgtgatgggccgacatcgaatcattgcggcagaggacatggaaacagtgctaaatcgcctgcgcccttctgtggaccgatttgatgccaattttcagcgcacatttaacgaatacggacgtgtggactccgtgcgtgaagtcagttcaaaaatttgttttatttttttacattgtaaattattttaaattatttaatttttaatttaattaataattttcttttctttctcccttatccatcagaagggatttctgaagatttttgactccattttccaattgatttttttgggcaactgaatttcattttaataattttttgatacttggaattcttttttgaaaaaaaaaagtttggacatggaatttcgattccgatttttaattgaaacaacccctcatggccataggaactcaagaacacaaaaaagcagggttttcaacatttttgttacaactttttgcaaacttcacaaaattttggaatgttggcagaataatagaaagaacatttaggattgattatcccatgattcaagaattaaaaaacccaaatccccaagtgataagccaaatttatttggttttctgctgtttctttcagtttcttgaggacagtgtggtgccacggtttactgtggaggagcacggtcgtgttgattttgtggacgcttttcaacaattgcagttacgcattcaacaattttttgacaccaaaattcgcgcactccaccgtttggtgggcgccgctgaaaaggaggcacaaaaagtggacatggacaaagtgatgggtccaacgttgggcagtgagggacgctgccgggaccaaatgagggcattgaacgccagctcagtgcacaacccaagcatttggaagaaaagcaatggaaagacgaattcgggaatccatgttggcattttggggatgaaagtgcttggggacgataagcaattagggcatggaatattcaagactttttga

SEQ ID NO: 67552 - DNA, 453 bp, Heterodera glycines
  Genomic contig location: Contig_ID=SeqID_38835; Location=805..1257; Strand=-
  SCN-specific regions: Sequence locations=1-453
atgtacattgagacagcccaacataacttgggcaaagagctgacggaccaaagtgtccgcgcagatctgattgcagagagacaaactctctgcaaaacaatttctcttcttgagaaatacaatggaaaatgggaagccattttcctgagagtgaagggacaagctcttcaagatgaagagcaaaattacagagacttcaaaccagaaggcaaggccttcatgcattgggtcgaccaagcccgagggcttgtcgacaccattggaggggctttaggcctctcggagctgggggatgcaattccccagccaaatcagccagcacaagttgtgcagcaggcaccagtggtgcatcagcgtcatgatgtgacgcttccgccgataacattgcccaaattctcgggggaaccccgagaatggcctttgttttggaagctatttgagacttccgtttaa

SEQ ID NO: 67553 - DNA, 1207 bp, Heterodera glycines
  Genomic contig location: Contig_ID=SeqID_38836; Location=1..1207; Strand=+
  SCN-specific regions: Sequence locations=132-168,333-562,584-636,678 -1039,1086-1177,1201-1207
  Gene Ontology: Mol. function=protein binding; Cellular component =axoneme; Biological process=N-linked glycosylation
gaggaagaggaaaaagagagggaaaaggaagacagggaaaaagaaaaagaggaggagaaagaggaagaggaaaaagagagggaaaaggaagacagggaaaaagaaaaagaggaggagaaagaggaagaggaaaaagggagggaaaaggaagacagggaaaaagaaaaagaggaggagaaagaggaagaggaaaaagagagggaaaaggaagacagggaaaaagaaaaagaggaggagaaagaggaagaggaaaaagagagggaaaaggaagacagggaaaaagaaaaagaggaggagaaagaggaagaggaaaaagagagggaaaaggaagacacgcaaaacgagcacgaggaacagagagagcaacaccagcagcaagttgggcatggtcatggacaggccgcagaatcagttgagacacggcatggccaattcgaaatgagtgccgaggaaagggaatgtctcagctttttcggtatgacttttgactttttgactctttaacgaataacggttcatctttttttttttgatcaaattgtcttcaatgcttctgctgatgaggaaggggaaagtgatgatgatcattatcattatcagctgcgcaatgcgccttcgacttctcatagcgtaactttttcattttaattcaaattaaaatgaaagttttgttttttaaagcaaccaaatttcaccgacattgatcaatatttgcacttcaaactccattctgatcagcgttctttggcaaatgcccttttcaattgggagaaaatgtgcaaaaaagcgacggacgaagtgatcagttcgccaaaggtgaaaaacaaatgtggccattaattgttttcaatttttcagattttgcaaatcatccgcgaatttcggaccgaatatttgctgcaatttgtttccgctaattttgcaattgaatgaacaaattaggcaggaaactgacattactggcacttagcattaaccgtttagttatcgattgattgatttgattagattagcatagcacgttgcccgaacaaatttgtaaattttttattagaaaaaatttaaaaaatcaaatgaaatttaaacttcttcaattttgtttttgatactcttgttatttaaatacatatgtaaaaaaaattgtttttatttatgttagaaaattatcgcgaattttaatttagaatattcgaaattatcataaaaa

SEQ ID NO: 67554 - DNA, 60 bp, Heterodera glycines
  Genomic contig location: Contig_ID=SeqID_38837; Location=318..377; Strand=-
  SCN-specific regions: Sequence locations=1-60
ttaccgtatatgctctaattatagcccagtctctattaatcccgcagtctccaattatcc

SEQ ID NO: 67555 - DNA, 77 bp, Heterodera glycines
  Genomic contig location: Contig_ID=SeqID_38838; Location=1..77; Strand=+
  SCN-specific regions: Sequence locations=1-77
ttcacatgacactgatgcccctcaatttgggatgtttttgtatgtcaaatttggcccatttttgcgccaaacattcg

SEQ ID NO: 67556 - DNA, 305 bp, Heterodera glycines
  Genomic contig location: Contig_ID=SeqID_38839; Location=42..346; Strand=-
  SCN-specific regions: Sequence locations=1-305
atggcttttcgctgtgatggagcaaattactacaattattttattgttgatgaaaaagctatcaataatgtcacatgcaaagggatcaaaaaggatgttttaccaaagttgcctgagtattttttctatgattcgtctcaattcgcttcactgtaattttacacgtttaatgagtgttcatttgattatattccatgttaatttaggaaagtttcgatttgccaaaaaaatggtttctttaacttatttaaagaatattatctggaagtcactgacatgggcaatccgactgattcgaaggctca

SEQ ID NO: 67557 - DNA, 488 bp, Heterodera glycines
  Genomic contig location: Contig_ID=SeqID_38840; Location=299..786; Strand=+
  SCN-specific regions: Sequence locations=1-113,135-196,225-364,390-488
atgaatggggtcacgaggacgttgaaatgggcaaatgtttggagaaaattggcgtcaaggctggcgattcgcgtgatgccgaagaccaccatcgctttttcccatttgtgccggaaactcatttgtccccagaccatatggacaaatcattttggttctggaaatacatttactatccgatggaagaagtaggacgaaaaaaattataatttaatttaatattagattttgggatagctattttaaattagaacaaatcgtttttttattactttgtaaattgtacatttaggggcccaactgttgcagtgattatgccatttcttttcactatgttcagccgaattcgatgtatagcgatttgaattatttaaataattaattaattacaggtactcacttgaatatttggtttaccatttacatctattcggcaatgaaattgaattaaaggacaatttcgaaaaaaacaggctaatttattgaaa

SEQ ID NO: 67558 - DNA, 531 bp, Heterodera glycines
  Genomic contig location: Contig_ID=SeqID_38841; Location=1191..1721; Strand=-
  SCN-specific regions: Sequence locations=1-190,214-223,255-428,465-531
atggaaccggccgccgttgttgtggtgccatcatcgtcagaaactgtgccgagcaacaccaccaaccaaattgccgacaaacgagatgacactgccacaacatcgtccattgacaaaattgtgagtgccagtgacacggcactgcgcgtcactgtgccgtccgcaattgtgacgtcgacgacttcatcgcaaaatgccaccaccaccaccacaacgcgacgagttaataataatttaaaaaaaaattaaattttgtggcatttggtcccatgccaccttaaactctcaaactgattaaaaaaactcagatgctaagccccgaggaatgggaggtgcgcatgcgcggcggcattctcagcaaagcgttgcgccgctacgccgccgacggacacttaaaaggcgacgatgtgccaaagtgaggaggagacttttaaaaattgaaaatttaattttttaatatatttgtggcgattcgaatcggattttctttaatggcaaagtttttccttgccgatttcttgagtcaataaa

SEQ ID NO: 67559 - DNA, 546 bp, Heterodera glycines
  Genomic contig location: Contig_ID=SeqID_8280; Location=682..1227; Strand=+
  SCN-specific regions: Sequence locations=1-291,316-546
atggccgagttgcgctgccaattgcgtctttccccgccctcctccgccctcgtcgctcttccgccctttccttcgcctcgtccttgctacgacttcgccccaatttcttcgtcttctccgacttccgcggtggccaacggaagggaaggccttctgattgagttggtgcgtcagcgagaacaacagcaacaactctttcgtcccaccgcggtgctgccttccgaagttcagcttttgacctcggcaattaattcgttgtctaatgggtcgccccagggattggcactgcaaatgcagcagcaacaacagcaacaggacaacaacggcacaatgactgtgccaacgaatggaattggacaagacgcgcaacaacagcaaatgggccaacagctgaccacggctttcgacatgagagagcctcttgcggtggtgcagcaacggacgatgggaagcagcgaagaggcgaacgcaatgccaacggcggaaggggcggcggtggacagcgattgtgcaacgccggcgaccatttcacagcaaaacttgcag

SEQ ID NO: 67560 - DNA, 98 bp, Heterodera glycines
  Genomic contig location: Contig_ID=SeqID_8280; Location=2089..2186; Strand=-
  SCN-specific regions: Sequence locations=1-98
agaagaacgaaaacggaacggacgacggagaaaagccgaagagatcggaatttgacgaatgggtggaataaaagaggagaagacaaacgagagaaaga

SEQ ID NO: 67561 - DNA, 676 bp, Heterodera glycines
  Genomic contig location: Contig_ID=SeqID_8281; Location=449..1124; Strand=-
  SCN-specific regions: Sequence locations=1-463,485-676
aggtccgtcgcaccgatttgctggcggatccgcgcagcaaattggctgattggtttcgcccgggcactaatcgcccgcgtgggttttgcgttatttggcaaatcaagtgttaattgatatgctaattttcctttctgttaagcaattcctaccgacaaaggggggaatctttttttggacagagaccccaaaatgttccgtcatatcattggttatctccgcctgaaaaaggagcgatgcgccgcctctttgggtccattccttcttatcatatggcatattaattatcagctccttccacagcacttccagcaaagccagacgatttggccaagtgaacgaatggccccgtgattttgggcttaatttcgcttttagactaatcggcgaatgtgaggcgcttaatttggtcgaatttcgcgaattggcgttggaaatgcttcaaaaatacgtcagaacggaggaacagcattatgtgaatgaagaggggggggggttaacgattggccaaagaaaatgctaacaaaaaaaggtcacttcgtacgttcaaatggcactgcgcgactacgaagcgtggcaatttgagcaggaacaggcgagacaagccgagaatgggcaagggaggggggggggggtaaagcggggtacgaacccccagggaaatttcaatacagta

SEQ ID NO: 67562 - DNA, 183 bp, Heterodera glycines
  Genomic contig location: Contig_ID=SeqID_38843; Location=306..488; Strand=+
  SCN-specific regions: Sequence locations=1-107,134-183
atggagaaggcctgcaaaatttggagagattatatcgattttaatgcgctaggttcgatgaaactttttaaaatataagcctaaactttttggcctgtttaaaaaggaattaaaaatttttaaaaattttattcatctcccttttgatagaaaaagcatcagagtgccttgattaacctgtaa

SEQ ID NO: 67563 - DNA, 153 bp, Heterodera glycines
  Genomic contig location: Contig_ID=SeqID_38843; Location=715..867; Strand=+
  SCN-specific regions: Sequence locations=1-33,59-153
taagcctaaactttttggcctgtttaaaaagggattaaaaatttttaaaaattttattcatcttcctttggataaaaaaagcatcagagagccttatttaacttttaattaacatttggtgcgtctcagagcacgttctaaaaaatatttatg

SEQ ID NO: 67564 - DNA, 881 bp, Heterodera glycines
  Genomic contig location: Contig_ID=SeqID_38844; Location=28..908; Strand=-
  SCN-specific regions: Sequence locations=1-332,384-710,732-881
  Gene Ontology: Mol. function=cAMP-dependent protein kinase, intrinsic catalyst activity; Cellular component=cAMP-dependent protein kinase complex; Biological process=protein amino acid phosphorylation
ttccttgtcaattacttaattgattttacattttggcacagattacgggctttggcttcgcaaagcgcgtcaaaggacggacgtggacatgtgcggaacgcccgaatatttggcacccgaaatcattctgagcaaagtctgttttcttgattgtttttttaaatcggcaattgtgtttattctaataaccatttaattagggctatggaaaggccgtcgattggtgggctttgggtgtgctcatttatgaaatggtcgccggttatccaccgttttttgccgaacagccaattcaaatttacgagaaaattgtttctggaaaagtataaaccaataaaataatttaattttaattgttttaaattaattatttcaatttttttgtgttgtttaggtcaaatacccgccacatttctcctccgatctgagggatttgctgaagaatcttctccaagttgaccttacaaaacgttatggcaatttgcggggagggccaacggacattaaaaatcacaaatggttttcactggtcgattgggtcgccgtgcttcaaaaaagggtaatcaaaaagcactcggatccattctcaaccccccaaactctcaattctcgaccttaccgatcagtgccgtgccatttccccgtcaatttccttggcttaggtctgtccgccgagctttgtccctcccgccacaatgtgcggcaccagcgccgccgcctccgccgctccctcagccggcgatccgtgccgcatgtttgaagcgctttatccgaaagtgaagggacccgacgacacgagccatttccaagcggaaccgattggagtcggcgatgagctgagaatacagtgcttacaaatcggcatataagtttgcgaggac

SEQ ID NO: 67565 - DNA, 706 bp, Heterodera glycines
  Genomic contig location: Contig_ID=SeqID_38847; Location=354..1059; Strand=-
  SCN-specific regions: Sequence locations=1-89,111-706
atttggtgcgctttagagcacatcggttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactccggaaggattcggtctccccataaatctgggcgcatcggttcggggggactgccccgaaaac

SEQ ID NO: 67566 - DNA, 509 bp, Heterodera glycines
  Genomic contig location: Contig_ID=SeqID_38850; Location=92..600; Strand=-
  SCN-specific regions: Sequence locations=1-509
atggccaacacgttcggctacctccgtggctatgatgcgttgcacggcgtcggcattgtgctgaaagagaacgacaaccgtgccgacgcttccttcaattactgcatcaacggtcttctgagcaatctgcacaaaaatgtggcacaggtgtgcttttggcacaaagaccgaaactttaaatttttgagttacgcatttttggttcaaaaccggcttaaatactagtacaaggaaaccattgaaagtcatcaatgtttcaataaaaaatttcattttagagcaaaaatttgaaaaatgcctgcttcttagtcgattttgtttaaaatgatcaatttttatgatttatttctcttttgccggcggcaacaatcccaccccttccctcttttttcatgtaccttttctcaattttgcagaacatcgtttttctgatcacccattcgtcgggctcgggaaaaacaattgccctgttgcgcaggctgctgaaaccaattgaagaaaaggccggc

SEQ ID NO: 67567 - DNA, 596 bp, Heterodera glycines
  Genomic contig location: Contig_ID=SeqID_8284; Location=2196..2791; Strand=+
  SCN-specific regions: Sequence locations=1-219,243-376,434-473,505-596
atgggtggcacttatcaattgattgtccaaattgactccaaaaatgtgccgggttcaccgagcagggtgattctcacattttatcttaaattatttctattattccaagtccattcccatcaattacctgctgaattaatctctgtcgacgcgaaaccgctcaaatttggcgtgataaatgaggatattaggtgaaattgagaagaaattagttaaatcatttttaaatatttattttaattcgtttaatagaactataatcgacgcacgaaaggccactgctggacatttgtcggcacaatgttcaggaccgacacggcccgaatattgcgaattgatggacaacagagacggaacggtaatcaactcggacatcttttatttaattgaaattttatattttattaaatttttttagattttttaatttattcaactgaatgttaaaagtggaattaattgatttgaaattcatttattaattattaaaagtttataaattttctatgtttcacgttttatttaagaaatttttgaccatattttcccagtttttttattagaattaatttttaacggtttttttttacaaaaga

SEQ ID NO: 67568 - DNA, 69 bp, Heterodera glycines
  Genomic contig location: Contig_ID=SeqID_8284; Location=597..665; Strand=+
  SCN-specific regions: Sequence locations=1-69
ttttggtgactaactcacagaccactaagacgaaaaatccagcataattgtacttggagcccaaaattg

SEQ ID NO: 67569 - DNA, 265 bp, Heterodera glycines
  misc_feature (138)..(138): n is a, c, g, or t
  Genomic contig location: Contig_ID=SeqID_8284; Location=5545..5809; Strand=-
  SCN-specific regions: Sequence locations=1-265
gcagatttaaagctatccattgcctgccggttctcggcacagcaaagcactaatagggtgtttgactcacttcaaaaaataattccatacccaaaagtttttacaaccacatattgccaatctaatctcttgcagatntaaagctatccattgcctgccggttctcggcacagcaaagcactaatagggtgtttgactcacttcaaaaaataattccataaccaaaagttttttacaaccacatattgcccatctaatttcttgc

SEQ ID NO: 67570 - DNA, 771 bp, Heterodera glycines
  Genomic contig location: Contig_ID=SeqID_38852; Location=224..994; Strand=-
  SCN-specific regions: Sequence locations=1-278,317-417,442-771
  Gene Ontology: Mol. function=oxidoreductase activity; Cellular component=membrane; Biological process=electron transport
attctgcagaatgtttcaattcaacttgccttggaggcagaatttcacttcacccatctgatcatgatttttcgttcatttcgtccagcagcaatgttcattgagcgatccaaggattttggcaaaacttggtataaaaaacttaacaggcaatattccgccagatttacatattcatcaaaatttagagacaatggccaaaaatataattgttgccttttcaggaccatttaccgctatttcgcctatgattgctcggcctcgttcccgaagtaggcaaaaaaaaaattaaataaataaatattataaaaaaaatcgagtttcagcattcccgaggggcctcccagaaagcacaatgatgtcatttgtaccaaaaaatatagcagttttgaaccggcaactggcggagaggtgcagaatttttttaatttttaaaaaattgccattcattgccataaaacaatatacggtatttcttcgatatttcgactctcccccccccccctcccacggatttaagacccccctttgagggggtcgaacaataaagagccgggtctaataatagaataaatacggtatacaaactaacaataattattcagttggtttacaaagtgatttcgcctcacattcccacggaggacccatacgcaccggagattgcggaactgttaaaaataaccaatttgcgcatcaatttcaccaaattgcacacacttggcgacgacctgttagactctcggccggacattgacgaaaaatattggt

SEQ ID NO: 67571 - DNA, 457 bp, Heterodera glycines
  Genomic contig location: Contig_ID=SeqID_38858; Location=193..649; Strand=-
  SCN-specific regions: Sequence locations=1-60,84-148,170-285,307-457
atgcagaagtgcaactgtccatgttggtcagtaatggctatcaaattatcggtaaatatttaacaataataataataataatattcacatttatctttatctttattttttattttggaaacgaatttttcatatcgaatttataaggaaaatttaaaaaaaaattaatgacaaaaatttatcaaagtaaagaataagtcaaaaagagattataaatcaaattatcgaaattagttgctttttttctaatttttgaatttcctatttcgatacataaaattttctgattttgaaataatatttttattgcttttttagccaaacccaatggaaattttagccaattttttatttgaaaatttttctgaaggttttattggcaatagtcgaaactgtgccagcagcaatgatgacaactgttttaactgcagcactgactatgtgtggacattggtga

SEQ ID NO: 67572 - DNA, 217 bp, Heterodera glycines
  Genomic contig location: Contig_ID=SeqID_38860; Location=324..540; Strand=+
  SCN-specific regions: Sequence locations=1-170,192-217
gtctctgacaatataaacaccgcgaaacaactttctgcaacatttttatgcttttttctgtcaaatttgttgttcacaattttgtacattgtcatcacattgaatttggtcactgaagcctatcaaatcagtttggtttatgcctgtggaaattggagcatcgcaattctttgtgtggccactgaattcaccataatgacgtaatgaatttattaaa

SEQ ID NO: 67573 - DNA, 204 bp, Heterodera glycines
  Genomic contig location: Contig_ID=SeqID_38862; Location=126..329; Strand=-
  SCN-specific regions: Sequence locations=1-204
ctcgcatgtgtcggccctctcctctacagtgtgttgcacaaaggcgtcggtcttcgcattgaaaagccaccgctgatcctcgtccttttggccatgtccaccgtttccatgcttttgttggcactgttttgggaatggacaatgccaatttttggtgcccaacactctgtggccatccttttgctcacttttctaatggcattg

SEQ ID NO: 67574 - DNA, 472 bp, Heterodera glycines
  Genomic contig location: Contig_ID=SeqID_38863; Location=215..686; Strand=+
  SCN-specific regions: Sequence locations=1-210,237-385,446-472
aaccgcagtggtcgtggtaactttcgtctgcggtataacccaatggcggctgttgaactgaccctgctcgggaatcgtcttgaggacagggctcgtaaacaccgggtggccataggcgcatcgacgtcagcatcaactgtgaacgaagccaacgcgggcgagaatggtgagggaggtagcggacaaaaccagaacggtgagttttaaaaatgtgcataaaataaaataatatatagaacaatcaacaccgcgcacttcacgcgtgcctttgtcggccatgggtattaaaataatcacatttcaatttttatccccctaaaaaatagataatgttgtcgctggtcaggctgtgcatcaacctcagatgttggaaggcaaaatggtgaatttatttaataaataaattaataaattattttaattattttaataatattaaattttagtcgccttcttttgggcaaacaattga

SEQ ID NO: 67575 - DNA, 56 bp, Heterodera glycines; identical to SEQ ID NO: 52733
  Genomic contig location: Contig_ID=SeqID_38869; Location=785..840; Strand=+
  SCN-specific regions: Sequence locations=1-56

SEQ ID NO: 67576 - DNA, 955 bp, Heterodera glycines
  Genomic contig location: Contig_ID=SeqID_8287; Location=30..984; Strand=-
  SCN-specific regions: Sequence locations=1-676,699-867,889-955
atggctaatatgaaatacttgccgcctgaacttttggacgaaatggctttttacgtatatcctaaccaacatttttctaaaattctgacttcttcctggctactcttggaatttttgatgccccgtatcaaaagatggaaagaattattgaaattagtatgttatgtaatgcacaaacgcaaacaaaacgggaatttgaccaattaatgcactttttacgttttttcagcgccgttccgaggtgattaaaaagcacaaattggccaaagacgatctcccctggaccaattttgccacggtggcaaaaacagacagtgtttgcactgattttcttaacacgttcgccgaactgtttaaagaggcatgaatttgaccgttttccaaattattaccatttttctaaacgattaaaaaattcaggaaggtttttatgattccatcgacggaagtgtaagtgtttgaaaagcaacaagaaatgagtggtaaatgactttaaacacacggtttagatgttgaatttgttgctttccaatctccgcgagctttacctccgtgttaaacaaacacgtgcgtggttggcacttgtagtccaagccgaactttttccggctacaatgcttctgattgaagaactttgcgagtttatcgaatcggtttgcttgtttccctttccatgctttttaaaaaatactttttagccgggtctttatttcggagccgttcccgagtcaacatcagaggttttttaatgtattcttttttttgtcgtaacaagaattgttttaggaagatccttatcaaactgtcgcttgcgttggaccaacggtaataatttgggttatgtttctgggagacaaaagttgtttaagaaaaatgcggctggtctccagtcgacttcgtcatctttggctcccattccgccaccgaagcaaaaccgattgtgccatcgcgacag

SEQ ID NO: 67577 - DNA, 1046 bp, Heterodera glycines
  Genomic contig location: Contig_ID=SeqID_38872; Location=163..1208; Strand=+
  SCN-specific regions: Sequence locations=1-565,588-709,731-818,842 -1046
atgtcatgcgcaccggaccaggacgttcttgaatttggcgcttccgtcaacgcaaaatgcgaacgggcggacatgacactcagcaaagatgagataaaatgtctcattttcattacaggcctaagtgacgcgcatcgcgatttgcgccaagagtgtttgcgtcaattggagagggcaaaaagcgcaacaccgccacgaacggtcaaactcgaaaatttgcttgaggaatgccgttcgattttgtcgctgcaacactccgctgccgctctcacaagttctggtcaagcacatgccatccaatgcaaaccacaggttttgaaggaggataagccgaaaaacaagggttttaagccgaaaacccaattaaattcgggcaaaaatttccgtaatgagggaaataattcgggcaatgtcaattcaaatcccaagcgacaggaatttcgtgcccaaacgtgtggacgttgcggcaaagggcattcatatagggtttgccgataccctgccgatgtccaatgttttggctgtggaaaacggggccacgtaaagcaaatgtgcccaaaccgagcccagtcaaattccgtcgccgtcgcatcaactttcagcgtggcacaaacaaaccgagattggatttggatcgaattgcaaatcaatgacaaaccaatcaagttggctgccgactcatgctccaacttgaccatcattcagctgccaatttgggaaagtttgggaaaaccaaaactcaaaaatgctggtaagatggttggttcttattctggtgaaaaatttaagcttttgggaaatttctggtgtaaggggtcaatttcagaaatgtgattttaagtctttgttgttcagttgcaaacacaacagctccaagtatcatggggttggactggattaccctgtttgaacaaaagacgcagctgccaattgcgaccacactgccagtgttgttcgactccactcttcaccagtcggtcaacgcaattcagtctcccaaagacccaaccgatttggccaatcaaattaaagcgcaattcccacag

SEQ ID NO: 67578 - DNA, 704 bp, Heterodera glycines
  Genomic contig location: Contig_ID=SeqID_38879; Location=382..1085; Strand=-
  SCN-specific regions: Sequence locations=1-80,105-335,357-384,406-704
  Gene Ontology: Mol. function=ligand-dependent nuclear receptor activity; Cellular component=nucleus; Biological process=neurogenesis
agggcagttcggcaatgcctcggcactccttttggcactttctttggccattccctcgaaaattcgctccattttattcttccaaatgggtcagttttgacaaacattagttcaccacttcaacggcatgattcacatcatcaattcatttcctcccaattttaggccgactcattccgacccaaaatctttgcaaagtttgcggggataaaactttcgggcgccattacggtgcatgggtgtgcgatgggtgcagctgttttttcaagagaaggtgaaaaggatgactgactgatcacttatcagagtcatccgacgaactgatcacttctcctcccatttttatgtttagcattcgtcgaagtgctgaatataaatgcgttggtgagagttttgctggttttgtctttctgattaatgccgttttgaaagctcagcgggcactggcaaatgtttggtggacaaatgccgtcgcaattggtgccaggcgtgccgttttaacaaatgcattgccgaggcgaatatggccaaagaacgtacgaatggaattgataaagcaataaaagatttgttaaaggcgtgcagaaggagaggggtccgagaaaggcgaaacggagcaaaagcggaaaaagaaacgaagtgccaaaggaagcggaaaagagccaaagggaaagcggagagacggacggaagggggcagcgaag

SEQ ID NO: 67579 - DNA, 513 bp, Heterodera glycines
  Genomic contig location: Contig_ID=SeqID_8288; Location=268..780; Strand=+
  SCN-specific regions: Sequence locations=1-126,148-272,294-358,423-513
atgctgaacaattggagcaatgcgatcgggaacatcggtgtggccaaaatgggaaatgccaattggacagtgccattggcgcattgtattgccaatgcaaccgtggtaaggggaaacagtatttcaaaatgtcaaatcaaaatgccaaagacagacacaaacgtaagccaagagtcgatgaaaagcatcatttgctcttgcaattaatattttgtacactaccatatgcatcatttttaggctattttggggagttttgtgaggccaaattgaacccgtgcagttctgctttaccaaccgcaccgatttgcaaaaacggcggaatttgtcaagaaattggacccgaaaaagcgtaaacaaaataatttaatttaactttaaaaattgtttatatattgtatttttatttattttataattaacgcaaattaaggatttgccagtgtccagaaggttggacaggcgatcaatgtgataaagcagaggacagttgtgcagggaaggaatgtgtga

SEQ ID NO: 67580 - DNA, 3360 bp, Heterodera glycines
  Genomic contig location: Contig_ID=SeqID_8288; Location=965..4324; Strand=+
  SCN-specific regions: Sequence locations=1-99,123-159,182-268,309 -1218,1254-1523,1546-1615,1644-1813,1858-1976,2013-2159,2185 -2426,2449-2672,2694-2729,2765-2821,2844-3049,3093-3360
atggacaatgccaagccaaaggcaaagggcacaccgccaaattcgaatgtttgtgcagagacggatggacaggtgaagaagcacaagggcagccgaatgatggaaaaaagaaagaacaattggcatttttcagggccaaattgcaatgtgccaaccgatgaatgccaaaaatggaaaaagtgcctaaacaatggcaaatgcatcacactgattgatggggatgagttgccgcgaaaaagggtgtgtttatgccctgacggattttgggtaatttaaatccaaaataatattcataaataattctgtttcaattagggtgatcattgtgagaatattgtcaactattgtgaactggagggaatttgtgtgaacaagggcacttgcgaatccgtcgggccaaattatcagtgccattgtgacaagaaaagtgccaagttttatggtttcttttctctcttaatggaaaaaggctttcatataatatttgatttttacctttttttggtcgaaattgtgaacaaattgtgaaaccgtgtgaacccaacccatgcgcaaatggcggaaaatgttcgccaaattacgacgacgacaaaatgggcttcgaatgcgaatgcggcccaaattatgcaccggagacaaattgcactcgaaaattggtaattaaaaaggaaaacaaacagcgaataaatgggatcaattgtaattagacattgaaaaattaattggcaattgacagagtccgtgcgaacaatggccaaattattgcaatggcggaacgtgccaaattttgccaaactcttccgattcgccgcattgcctttgcccagccgattcaatgggaattcgttgcgaaacacgtaaaatatttaagctttccaatttactaatatatgattttttgccaggaaagtccacccattacgatttgcatttttacccatttttaaattcgtcgtccatttttcaaacaattcgttcgcccacttttccgtgtttcgcgctcattaaaaagccattttcgctctgtttttggctccgatttggtctaatggacggacaaacaaatgaagtgaaataataaaatactttaatccatttttgtataattattttataattgtttttgatttttccgcagttttccccggattctcatcgctctttttacatttctataaaaacttttgaaacgatcggagtgaaaaggtacggtatattaaaaagggaaaagttttcttttgaattttacagtcagcggacagatattctgctttttgatcagtttggcgtgacaattttcggcagcaaattgcaatttgacaatgggcgcccattgactgctcaaatttggcaccacgtaaatgttttttttcaatttgatacaaaaataacagattttggccattagatttgcttaacttacgacgtcaaaatcattcgactgtttttgaatggacattttgtccaagttcgttctgctgtcgttagaaattatccagccattttcattaataaaacctgtgaaattttgttggccaaaaatggcggaaaaaatccttttgttggtcagctgagccaagttggggtaaatgagacgaaattggggcaggatttgtaaaataatttaaatattttcattattagctgtattcgaaacatttcgaagacgcggaaattgtccgaatggcgtggagttgtcgcgaatggacacatcgccaagaaaaggcattcactcacttaaaacattaaatttacaaaacgaatttaagcgattttcactcattgaatgggctcaattcacgacagtcgatggtaaaataattatattaattatttatttttataacaatttatttagttttcaacaaggcccaaattgctctcattcccggaatttgcagtgaaagcgattgtcagccggggcggataagcgattgtggccaagggaaaaagcgtataaaatgaaaaaagaattcattaattaaaaataaataaataaataataattatttggatgttgccatttaaagtggtgagtgatacaaattgttaagttaaaacgccgccccatctgctgttctgtccccgttctcagtttgtcactgtccccgtgccccaccagcgcctaattcaaattcattgggagggtaaaagaaaactttaatatttaattttttaataattctcgaaggatccctcgagaaaatgtttcggcctaccggcacttcgcccattgttcgctttgagagcaattttcggcccggccaaacctttggctggggccaatttcacgtcgtttatttggcggaggattcgctcggaaattgggccatttgcgaagtcaaagagaaagacaatttgccaacccattttgatcacctcaatttacagttcgatgtcgtcgtttcgcccacaaaatgttctgatctttttgtgcccggctcatttaacaaattgacagtgcacaaattccgcgtcgaagaggcgaaacaagcggaaaaaagcgtaaaaagcacaaaacgattactaattatcacttatcagatggacccattgcttctccaattcattcagatcaacctcaaatgtttgaacaccgaattggtttccaatgtcgtcgcgaaaccgcccttttacatttgcgatcgcctggtcatatttaatgcattttgataaatattttttaatttattcatttaactcagtcagtaatttctcgggttcacccaccctttttaatatttatttttcctcatttttcagggccaatgggaccgtttggcaacttttgggcgcactttcgctttgccttcgtgcacgccaactgaaaatgcaatgcaggttaagaacaaaattaaatattgaacactaattactatataattggaatcactattcaattgtacaggaggttatcggcgatttgcatttcgaaggcccatgcgatagagcagcgaaatgcgcacggaaagtggtcagtgaggggggggggggaaggaaggcattggcaattgttaatcaatgcttttttgttttctatttttgggtgttaaaatattaaattttattttttatacaaatattttttaattctgtttttaatcaaattctctttttttcctttgtcttttgcaattttttctcaccttttttcctttttcagattcaaaccatcgaaaatgcgagcaaaagtttcggctccttttgtacgcgtcccttctgcgatggccaattgggcatcaaaacggaatgccttggcgaacggagcgccattagtggcgccaatccatcgacgacggcggcacaaaatcctccgtcggctggtgcgacaccgcttgtggacacgtacgagcgaaagcg

SEQ ID NO: 67581 - DNA, 755 bp, Heterodera glycines
  Genomic contig location: Contig_ID=SeqID_8289; Location=536..1290; Strand=+
  SCN-specific regions: Sequence locations=1-44,66-143,165-271,293 -375,397-505,527-755
atggccaatttatgccctacaggtaaattcatttcaattccctaattttcaatattcaagcattctttcagcggacgattgcaatgcatcggctgtccccccggcacttccactgaacagcaggtcgatggcatggcattctttatgttttcaaaaacataatttgtaattgtttaagggcaccaccagcgcggaccaatgttcggtgcgttgtgcggtgggcgaggaaatgggcgcgggggaacaatgcgaaatgtaagagcccaatttgaaaacaaattattttttctttctattagattaattaattgattattcggtaaaagattccaataaaaaagtcaaagaaattcataccttttggaaacacacaataaaagtggttcagcttttgcataatttgaatttcaaattttgaaggtgcgcccgcgggacattccgcgcggaaggaatgaacgcgtgccgacgatgcaacgtaaaaacaaattaattcaaatcaaatgtttattaattattcattttgtttaaatgttggccattttcagctcggcttcaccacccctgcgaatgggtccaattcggcgtcggattgttcgctcattttctgtccgcccggccatttccgcaacacaaccattggacctgccgatgacagcttcaatcagctgaactctgcgttcgaagctgtgtgtgtgccgtgtcccatcggatattatcaggcaaaaaaaacaaatgggaaagaagcatttaaatga

SEQ ID NO: 67582 - DNA, 392 bp, Heterodera glycines
  Genomic contig location: Contig_ID=SeqID_38882; Location=541..932; Strand=+
  SCN-specific regions: Sequence locations=1-3,25-235,299-392
atggaacacagaaatagtgaagaagcaaagaaacgagagtaaataagagagcgtaaggaaacaagtacttttcctttttttctcttctcactgctacaccccatccttttttgatttacattatcaccagcagggaaagtgtttttcttatctaaatcccttgcaataggttttggatatagaatttttggaacggggccatcgggggatggccctacaaaaagcatttgaaacgaataaattttattttttaattttggtttaaaattaacaaaaaaatgaatgatttttaaaatttcagagggacatttgtcggagtgctggtgaataatgccaggggcctatttcaatcaacatcaagtcaacgacttgatgacttgatcatcaagtga

SEQ ID NO: 67583 - DNA, 309 bp, Heterodera glycines
  Genomic contig location: Contig_ID=SeqID_38886; Location=303..611; Strand=+
  SCN-specific regions: Sequence locations=1-309
atgattatggctaaggtccaattcttcaattgccggactgaagcgcagaatgtgttcactgatagtctaaaaaaggcaaaaaacggcgaaaagattagggaaaagggaaaagccaaccaaaaggcaattagcgctgagggaaaggcgccgcaggcgaaacagtcgaaaggcctcccattcgacgctaacgatgcgattggtgttcaggcgaatttcttcggcattcggaaaggcaatgaaactgtgccgggaaatactctgagagagaagagtgatcggagtttaaacatccaaagttaccgtaattaa

SEQ ID NO: 67584 - DNA, 304 bp, Heterodera glycines; identical to SEQ ID NO: 51570
  Genomic contig location: Contig_ID=SeqID_38888; Location=62..365; Strand=-
  SCN-specific regions: Sequence locations=1-304

SEQ ID NO: 67585 - DNA, 304 bp, Heterodera glycines
  Genomic contig location: Contig_ID=SeqID_38888; Location=568..871; Strand=-
  SCN-specific regions: Sequence locations=1-304
aaaattccctcagaaataaaaggtctattgcgcaccgccctccctatcatgctcgagagcatttgtatgtgtataaaatttatcaaaaaaagagatagccatttttgtgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 67586 - DNA, 316 bp, Heterodera glycines
  Genomic contig location: Contig_ID=SeqID_38891; Location=239..554; Strand=-
  SCN-specific regions: Sequence locations=1-9,31-90,120-316
atgacttcattttccgccccatttcaacacttcgctctttcagttgcgaatgtccgcgcggatttatcagtcagtcggccaattgaaaggattaaattaatcaaaaattttaaaatttagcaaattcgagtgtgcccggtgaatgcaaccaacggctgaaccaatgcttcaacgcgccatgccttcacgggggcacgtgccatgccctcgagggcggctttagctgttcgtgtccgaacggatggaccggtgagtttcgaaattgaaaaaaaaacattttgaacatgtccaaattcattttcgtatcaaaaataaa

SEQ ID NO: 67587 - DNA, 974 bp, Heterodera glycines
  Genomic contig location: Contig_ID=SeqID_8290; Location=1032..2005; Strand=-
  SCN-specific regions: Sequence locations=1-389,411-520,542-894,916-974
atgggtaggatggtggtagcttttctaaccaccaactcccgtcaaatgaccatgaactacgttcttattgacagggtaaaaaagagggtcatggtcatggttgaatgaccaccaacttcgtggttgtttgaccaaagttcgtggtagctcttgttgaccgaagtttaccaccaacttcatggttatttaaccattaccaccttcttattgaccgggcccagacaaaaatagggcactacccccaagtcagaacatctaaaattttggactcgtcaaatcagaatatttctgataaacaccagaaaaaacccgctgaaaaagtgttacacaagcgatttaaagtttttttgcaaaatgttcaagttttacatacactctattttttacagttctgggtttgaaaaattttcgatacgcagcaccttgcggttttatgaaaccgatattgtatttttcaaagttttgtgcgtaattgtattcagctaacacagataaaaatgatacgtcaatgaaatatttgcgcaaagaatattgtgaaataattaatcggaagtaagggcaaataatattgtgaaatcaattaatcgaaagtaatatgtggaaaataatattgtgaaatcaattaatgggaagtaatatgtggaaaataatattgtgaaatcaattaatgggaagtaatatttgcgcaattaatagcaatcaacttcgtatttattcgcatataattaaatattgtgaatcataaaatgtaactagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaa

SEQ ID NO: 67588 - DNA, 192 bp, Heterodera glycines
  Genomic contig location: Contig_ID=SeqID_8290; Location=1..192; Strand=+
  SCN-specific regions: Sequence locations=1-88,110-141,163-192
aaactcgaacagaaattcttataatttaggcctttttctccaccagcggcgagtcaaagcggcgaaaaagatgagaaatgatcggctattttggagaatattgaatggacaaattggtctgctgatcacttttgatgctcatttttgcttgttaattttgatgtgtctttctgacgaaaaaattcatttctt

SEQ ID NO: 67589 - DNA, 403 bp, Heterodera glycines
  misc_feature (7)..(7): n is a, c, g, or t
  Genomic contig location: Contig_ID=SeqID_8290; Location=2086..2488; Strand=-
  SCN-specific regions: Sequence locations=1-127,156-295,317-403
atggtcnccttccgtgatccgaaaactgttgccgagaagcgtttcaatactgccttatgcaaaggccgttctgttattgagcatgcactcggaatttttaagcggcgcttttcgattgcaaagttgttaaatgattttttaaaataaaaaacgctatttcagaacatcatgtcgcttgaggcttagacggatcgcaactgccattctagcagcagctgttctacataatattgccattgaaatgcgtttgcctgaaccaccactggcgacggaagagtcaaatgaaaatgatgatttaaatgaaataaatgaggatgaaaatcgaaatgccattttaaattatcgtcaagcgcgccaagctggaattgagaaaagacatgaattggtggcccgttttacttaa

SEQ ID NO: 67590 - DNA, 80 bp, Heterodera glycines
  Genomic contig location: Contig_ID=SeqID_8290; Location=690..769; Strand=+
  SCN-specific regions: Sequence locations=1-80
tatttttttcctgagctccccgtggcctgaaacgcacgaaaaacatgtttttttgggctgttgttaagctacttttcgag

SEQ ID NO: 67591 - DNA, 287 bp, Heterodera glycines
  Genomic contig location: Contig_ID=SeqID_8291; Location=26..312; Strand=-
  SCN-specific regions: Sequence locations=1-287
atgctaaaattggagaaagaaggaaacgatgatggatatttcgtttgggtgttgaagcgatgcccaattggggggacgacggcggttcaatgggagcacaaaaatttgaacaatgtcaactttataatttttgaatttgggtgagtggcaacagcattttcattgtttaaggtaatcaaaatttcacttcatttaggcgattgtctccaccaaagacgggccaaatgaatgcaaaatatcgtctgaaaatgaatgccgggccaaacggacagcggaagaaaaagtga

SEQ ID NO: 67592 - DNA, 944 bp, Heterodera glycines
  Genomic contig location: Contig_ID=SeqID_38894; Location=116..1059; Strand=+
  SCN-specific regions: Sequence locations=1-115,148-168,190-254,279 -318,363-391,438-583,606-799,934-944
atgagtgggacgatcacaaggtgtgatcgggttttccgacgggggagtcggaggccaagattttgattgaatagccatttcattgatttgatcaaatttggtaaaaaatgtgatgatttatttaaaaaatttaatttgaaattttttcaaaaatgttttttgttttttctcagatggccacgtgctccatgttgcaaatattattggcttcgtctgatgactttttgtggcattttttaaggtcatcattcaacaattagatttttatgaaaattgaaattttggcataattttgccattcatttgtgtaatgcattcatttatattttatttacaattcttttttttacaaatattaaattcaaattgaagccttggctaaaaaccattgaaataataattaaaaataaaaatttaaataaataattaattaatttcttaatgaccaggcatgagctgccaccgaagcgttttttcagtgtgtttgacccatttgatgacgaatacaaacattggaacaaatacggctcaaaacggatggacgagcgattgaacagacaatgctattaccacaacaagcggcattattttgttggataaaatgccgaaaaaagaaaaacataacggcattattttcttcgacagaatgccaaaaacgattgattgatgtcaatttttttgttatgataaaaaggggatctacaaaaccacatcctgggctaaatctctttgcaaaaaaaaatagggctggtgatttaagccacgaaaaatcgccaaaaagtcgactaaaaaaagttttaaaacagcaaaaaaggcattaaaaagccataaaaagacgaaaaaaagtaaaattaaaaagaaatatccaaattaacaaaacaaattaaaaaaaagaataacggagaacgaaaaaatgtggaaattaaaaaaaaattgcaaaagaa

SEQ ID NO: 67593 - DNA, 499 bp, Heterodera glycines
  Genomic contig location: Contig_ID=SeqID_38895; Location=320..818; Strand=+
  SCN-specific regions: Sequence locations=1-107,134-263,292-499
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcagaaaataacttgcaa

SEQ ID NO: 67594 - DNA, 916 bp, Heterodera glycines
  misc_feature (834)..(834): n is a, c, g, or t
  Genomic contig location: Contig_ID=SeqID_38901; Location=183..1098; Strand=+
  SCN-specific regions: Sequence locations=1-49,96-229,297-341,363 -793,815-863,885-916
atggactttaataatctgtcttcaaattcgacaattcttggggatttggtaatttataacattaaaaataaaaaattaatattatcaattttttagttttacaccacttacaaaaatgccggactgagtgccggcctcgtcacaatggctgtgctaattgctttgtgtgctgtgccgggaaattgcatgaatctgttccttgtttatttgacaatcaaacgaaagtaagttttttaattaaaggaataaaattaaaattgattattttattaaatttttgattttaatttatttttcttcgtcatttttgttcactttcttttgcctattccttcactcaaatttttatcaaaattatagggatttgtcgaactcaattttaataccatattccctaaaatatagcctcccccaaaattctgcccgaccattgagaaaacgcccttccgaggggccaaatttgagttcgggaccctgtgactgaccatttttccgtttttttcaattattattttttattttcgcttttaaatttatgaattttaatgataaatcaaatttcaacaggtcgcttcgcgggagcagcaattatttgctggcattgaactcgttctacgagtttctgcaccaaacgggccattacatttttctgttcaccattctgagcggacgcaattttattccgttttttggcagtgccatcttccaactccaatccatttttggctataatgcggcaattttcacaatgattgagacggcggtggaccgatttttggcggtggtgacgccgaaattgtatgcttcagaaaatgaaagaatttatataatttntattggtacttttccattatgcggacacaccccaaaattatacaaaaagaaggggaaagggccccgattttatgcctcctaa

SEQ ID NO: 67595 - DNA, 359 bp, Heterodera glycines
  Genomic contig location: Contig_ID=SeqID_8292; Location=32..390; Strand=-
  SCN-specific regions: Sequence locations=1-12,42-359
atgaaccgacggtaaggaaatttttgaaaaattaaaattttcgtttccaatttttcagttggatttgtgcggatgtttggatggacattctgccatcttttgaccgtccccaactcggactcaaaatggcactgatttccgaccgtttcgacattttagtggacaaacattttgatggaaaaggcgaattgacaatttggaatgaccatcgcaattcgcaaggacacggaggacgagcaaattggaccaaaagcgaaactatttatgcaaatcaaggacaacaaggacaaatttttgtggaatttccgatgcaggaccatccgttgccaacaaatcccgattatggaccttatgattat

SEQ ID NO: 67596 - DNA, 155 bp, Heterodera glycines; identical to SEQ ID NO: 51421
  Genomic contig location: Contig_ID=SeqID_8292; Location=1196..1350; Strand=+
  SCN-specific regions: Sequence locations=1-155

SEQ ID NO: 67597 - DNA, 1021 bp, Heterodera glycines
  Genomic contig location: Contig_ID=SeqID_8292; Location=457..1477; Strand=-
  SCN-specific regions: Sequence locations=1-264,286-307,329-380,416 -777,801-811,842-1021
atggccataaaatatggaccaaaaatcgcaaaatatggacataaaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaattttaagaaaatttaaatttattcaatattctcgagaaattttggcgaaaaaatgattttttgaaaaatttttcgggttttgggctcaaaaaagctaatttagctgctgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccttcctagaagcttcaaaccaagctaaaaacatgtttttcgtgcgtttcaggcctcccacagtccaggaaaaaaatatggatttccatgtaattctattccctaataattagacgacattttcgttgcttttgcccgcttcttctttttctttcgctggtggcgacaatggcctaaaattaagatattttaaatatgatcaaagtgttattctataaattaattcacctaatttttcaggacttttttccattttttcgtgactttttggcgatttttatgacttttttagtcgactttttgaagatttttagtgccttaaattcccagccttatgcatcattgattgatttgtactttgctttctcattttaa

SEQ ID NO: 67598 - DNA, 773 bp, Heterodera glycines
  Genomic contig location: Contig_ID=SeqID_8292; Location=1943..2715; Strand=-
  SCN-specific regions: Sequence locations=1-547,570-773
atggataccggattcgtggtcagtgacctcgaaaacgcaaggaacttgtttttaagacaataaaattcgctgacgcattttctgctgacgctttttccactgacgcattttccgggcgccatttgatttacgctcccttttttgtttagacatttctccgtgccaccacttctgtcgcttacaatgttcggcttgaacttctagtggctaacgaaatgaatattgttgagccatttgagttggtgaacgaaatgacccaagaaaagttgacactgacgaaggacgaagagatttgtctgttgaaacggtgtccaattgttggggagacggcggcggttcaatgggaaaaagacgaaaatttggacaatttgaatggagtgatcttccatctttatcatgattgtattgggtaagcaaaaagattggccttacttttgaatagagtgccacgggaccgggaattttgggcaaacccgggaccgggaccttttcgggttgaaaacccaggaatttttgcctgggaaaaccgggaatagtcccaggggaccttggtactcaattgtactcagttgtccgctaccaggtcccggtcccgtggcactctacttttgaatagagcatggacaggagggtacagtagtgtcctccgtacagtactttaaatgttcattcatttcaaatttggtttatttaggccgctgtctccgccagatcaaagcgatgaaaaagtgttctcgactcccgggcccagtgatcagcggaagaaggagtga

SEQ ID NO: 67599 - DNA, 100 bp, Heterodera glycines
  Genomic contig location: Contig_ID=SeqID_8292; Location=3307..3406; Strand=+
  SCN-specific regions: Sequence locations=1-100
atgattaaagttttcattctcgtcttattttgtacattctcagtatcagccgaatacgatgactacattgatgatgaaatagaaggccaatcctcagcag

SEQ ID NO: 67600 - DNA, 276 bp, Heterodera glycines
  Genomic contig location: Contig_ID=SeqID_8293; Location=302..577; Strand=+
  SCN-specific regions: Sequence locations=1-193,216-276
gcatacggagataaaaattctaaaagaaaatggaatctgtcaaaaataaatgctattgaatactgtgggtccagtcgggtccatcatcatacccatattggtagcggtggtgttatcaatcatttattcaacaatattatacaattggatggtccgactcttctcgacttgcagtcggatcagagtctgattgcgtggagaagtggggaaggggataagagtcggattaaagggaccaccttctcgtcgacattaggttatgtcatatgtgattag

SEQ ID NO: 67601 - DNA, 1049 bp, Heterodera glycines
  Genomic contig location: Contig_ID=SeqID_8293; Location=713..1761; Strand=+
  SCN-specific regions: Sequence locations=1-137,166-509,549-589,619 -633,662-722,756-816,841-870,897-905,928-978,1026-1049
atgaacacggaaagtgagtactctttgttaattgacattatattgttatcaattattgaggacatcatcaaatgtaaaaaaccaaatttcataagcgggctcaatcctaagccaaatattaatctcttttcaattacgatagatattttttcaacaataaaaattaattagttttttacagagcctggcgggaacgggattccgcgggaaaacacgggaatcccgttcccgttttttttgccggacgggattttaacaggaacgggaaaatggctggaataccgttcgggaatcccggcccgtcattttcgttttcccattcccgttcccgtaagttttttatcaaaaacgggaaaaaagtacactgtaagaatgggagtctgagtaaaaattttgaagggaattgtgtgaaaagagattgatataggtatatatatatatattagagagcggcgggaacgggaatcccgcgggaaagtgaaaaattaatcatgaaaattagtcaaaggaaaaaaattttaaaaaaataattaatatattctttaaaaggaagattgccaagtgtgcaaatggcctaatggctactctccttgactttcccttcttctttccccttgttcaatccctctacagaaattaaattattttgaattttttttttgtatactcgtgggtttcctataaagaaaatatgattcctatagttttttttaaattgatacatattttatcattttttaaatgaaaatcctaccaatttagcttaataatcccaaaaaccaacctttttttgttgaaaatctgttaacaaattgcacccaaatttttaaaatttcccccggcggcgcctatcggcaccgccggacccccttttccccaaaagttttttggaaaaagtgcgccgaaaaaagtgatgagaaaagcaaactgaattctgatattattcgatcatttagtccgaaaatgattaattgtttgaaataattaaagaaatttgttttaaaattttcattaaatttaatttagctttaacaattggattttattaa

SEQ ID NO: 67602 - DNA, 632 bp, Heterodera glycines
  Genomic contig location: Contig_ID=SeqID_38902; Location=146..777; Strand=+
  SCN-specific regions: Sequence locations=1-17,39-398,421-632
atgaacttccgtggtgcaacggaagcatatgccattgttcattcaatgccatttgcccgtctttcacatcatgttgtcaaattggcaattcatttgccaaaccaacagcccattgtatatagggcattccagctggtgagcaaagctcaacaaatccagcaaggcgaactgccagaaacgcattgttcagcatattggaaacaatggcaaaatgagtggaagaatgacccaaagtttaaggacattctttttgaaaaagtcccagagcagttccgatgggcaaaggacaaatgggtcctgtacaaaaggcagcaaataaaaaggccacctatcggccgaattgttcctgtacccccatcggacccggaaaggttcgcgctctattcacttatgcgtcactttcctggagatccagatcatcttaagatggttaatgggttgctttgtacctcattcactgaggctgcaataatgcatggtcttcttgaagacggcaaaatttgggacaaaactctggcggaggcagctctgtcgcgctggccagatcagatgagatggctttttgtgagcatcatggtctatggccagccgagtaatgccatagaattgtggaacaagtacaaagaccaaat

SEQ ID NO: 67603 - DNA, 357 bp, Heterodera glycines
  Genomic contig location: Contig_ID=SeqID_38905; Location=197..553; Strand=-
  SCN-specific regions: Sequence locations=1-157,179-184,206-357
atgacgacaaatttgcctcaaggcaacgaagctcaaaatagtgggtcagattttgatccggtatacttttcgcctgaggagaaccaaagatgggcaaacttactggtcagaatgagagcattcgagcaggctgtctgccgacaatttcgtcaaattgaaacccaatttgctcaaatttcgaaccaaattcaaatttcaaacactgctgatcgtgtcagggaattagagtcttccttaaaggaactcgaaaatacaatggaaatggacacatttcaggctcaagaaaaaatgattgatattgaacaagaagttggtaaagtgaatatgagaattgattaccaggaaagattgactaaa

SEQ ID NO: 67604 - DNA, 303 bp, Heterodera glycines
  Genomic contig location: Contig_ID=SeqID_38909; Location=679..981; Strand=+
  SCN-specific regions: Sequence locations=1-303
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaggtctattgcgcaccgccctccctatcatg

SEQ ID NO: 67605 - DNA, 756 bp, Heterodera glycines
  Genomic contig location: Contig_ID=SeqID_38910; Location=22..777; Strand=-
  SCN-specific regions: Sequence locations=1-127,150-381,403-756
caagtgcaacagctcaaagagatcgctcctaaggctaagctgaagaagctcggtctcgcggacattggcccggagctcagcagcgaaagcgaaggggacgaggaggaagaggatgcggctcacaacaccgagcagcagcagcaggacgatgccaacgacgtcccagacgacctgaccatggacgaaagggccgatgctgctcgccgccgtgaagttctcgactttgagacaccagtctacgctcgggaactgcgggttttttttttggaatgttcttagacccttgtaattatctataaataaatatgtactaaatatacatttacaagggtgcccatgtaaatgtacgttttgtacatccttttataaaaaatttttaggaacagcagcagcaggcgccgcttctttcacctccgcgggtccgggccgctgccacgccgcctcgtcgatctccgcgggcctctgccacgcctcttccaccccgcgggtccgggcctctgccacgccgcctcgtcgatctccgcgggcctctgccacgcctcttccacctccgctggcctctgccacgcctcgtcgttctccgcaggctgccgctgaagcctcctacgacaagcaggaaaagtcgtgccgaaaatgccaccatttgggcgtccagtgttggggttgttcgggctggttccacaaggtcaaagcgaggggctgctgcaactacggcagcctcaataagatcgaacgcgaatcatggctttgcgtgga

SEQ ID NO: 67606 - DNA, 661 bp, Heterodera glycines
  Genomic contig location: Contig_ID=SeqID_8294; Location=1956..2616; Strand=+
  SCN-specific regions: Sequence locations=1-378,400-404,429-435,473-661
atgagttcagtcttttttctaatccctgccaatattcgtggattaattgtgaaaacagcgacaaattgcaaacaatttggctgggtcagcatgcgtttgcacattgttgcagtggctgcaaaccgtgcccatgccgtactcttcccgtttcattatgcacaaaaagtcacaaaaaagtgagacaaaaaacaaaaacaaaaagtgtgattttatatggccaagacaggacaaggatactgtattttggaacggtggtgattggtcaaatcccaaaaagtatcaataaggcaaacctaagaaaataatcaatggtaataattagagccacttttcctgaaattttcatagcaaatatgcaataaaaagccaagaatacacacctaagaatcgaccaaaaatttcagaaaatataaaatatacccctaaaaataatgctaataatttaagttaaattttcaatttaaatttttttccaagggcaatttatgaaaaaagagaaaaacatctaaaaatatgagcccattttcagcattgaagaattagtttctgacatcacatgaacccggatttgtatacaaattcaaattttcgtattccaattttcaattgtcttacattagcattgttgaaatttcagaaaaagttttcatttgaaaatcaa

SEQ ID NO: 67607 - DNA, 418 bp, Heterodera glycines
  Genomic contig location: Contig_ID=SeqID_8294; Location=4383..4800; Strand=-
  SCN-specific regions: Sequence locations=1-27,50-418
atgaataaaatttctttgatcccctcttcttcaatggcacttttgctggtggtggttgtcctgctaataatcccgtttgtcccttttacgctttcagaacaatgcctgtacgatagtgtgacggagagctgtctgaaagtcaattgtccatttgactgttatgttgctagtccgggcacgtgcggatgcaatgcgagagtaagcaaaaccatgggcttaattaggcacagaaagtttaggtcattatcgatttgggttcgaaaaaatcaaattcttcctattatttttccaaaatgttcagatgaaatttgacagcatttggaagcgattggtgtagtaaatggcacaaaatgaaaaggaattcaaatcgacggcttagaagatgacaaagattaaaaatacattcaatcacaataaa

SEQ ID NO: 67608 - DNA, 402 bp, Heterodera glycines
  Genomic contig location: Contig_ID=SeqID_38915; Location=1..402; Strand=-
  SCN-specific regions: Sequence locations=1-402
gctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccggttggggtactcaaacaattatggggagcaaaaatccaacgcagaattaaagtacaggctatagggaagctactcccgaaggatttggtctcccataaatatgggcgcattcgttcgggggggactgccc

SEQ ID NO: 67609 - DNA, 53 bp, Heterodera glycines
  Genomic contig location: Contig_ID=SeqID_38916; Location=624..676; Strand=+
  SCN-specific regions: Sequence locations=1-53
gtttgcctatacggaaaacaatagcgttacaatatcaccagaagaatgctgcg

SEQ ID NO: 67610 - DNA, 534 bp, Heterodera glycines
  Genomic contig location: Contig_ID=SeqID_38918; Location=143..676; Strand=+
  SCN-specific regions: Sequence locations=1-63,86-153,193-256,287 -371,397-489,511-512
atgccgaaaaattttgtattttcacgacatatggcaatttataatacgtttagatctcaacgattaatttcttttatttatttttcggctttctacaataaaatggacgcgatcaagaaatacgcgatcaaaaaattccatgatttgggtaagatttttaagaaaaaaataaattttcaaaaaaaaatttaagttaaaactgcaaagagcccacaattgccgaccacactgcccatggaaaagttggtttggccaattggaaaaaattttcttaaaaaattgggccagcccatcatggcaaattcagacagattggcgctatatacgattttaggcgcccaaacaatgactaactcagtttcttgggcaataacatttttcttactttattaaatacctacattcttggtataaaacgaaagctgaaagtctcgggaatttattaatacaagaaaagagcaaaaattggcattatgcaaaaaatacactgagaaagaaacaagaaaatcagcttttttcaagtataattattaa

SEQ ID NO: 67611 - DNA, 1199 bp, Heterodera glycines
  Genomic contig location: Contig_ID=SeqID_1088; Location=1..1199; Strand=-
  SCN-specific regions: Sequence locations=1-227,302-359,391-418,440 -497,560-700,747-783,805-914,936-1199
  Gene Ontology: Mol. function=myosin ATPase activity; Cellular component=actin cytoskeleton
ttagactcaacagagtacccggtgattgtgcagacgatgtggcctcgcggttctgcggacgttgacgccaacgcggacccgtccgtgccgcgcaatcggctcgttctgaaaagtaagaagcgccactcggtggaccaatccatggttgtaatggcgacggcatcggccatcgacacgtacgtttttggcttttttcaaataaacactgcttttaaagggcaataaagttaattatttttaatatattaaaaagcatatttaatttaattacaatttatatgaattttttctattaataaatcacgaatatttcaggtttctcgccaaatttcttgcccaaccacaagtaaaaagaaaggaaaaaaaaaattaaactttattttaaattaaggaccgtgaatatgcggacctttgtgtgctgcctgaactcactgagcagacattgctggagaatttgcgtgatcgttttaataatggtaattaattaatgctggtggatttaaatgttatttataattaattttttttaacaataatttattttttaaatataattataggtaaaatatacacttacattggcccaattttggttgctgtcaacccgttcagctttttccctatttataatccaaaatattcgcgtctgtattgtcagagtcgacgtttgggcatattacctccgcatggtacacataggaaatttttttaaaaaatttaatttaaattattttttattttaaatagtgtttgccattgctgacatcacctaccataatctgatcaaacaaaaagaaaatcaagtggtcgtaatttctggagaggtaaaaaatttctatacggcgctaatctctgacaaatacaaacttcaaacaaaataaataaacttcaagctgcatacattattagctcataaaaatttaaatacaagtagattccatggatgaaattgaattattgattttcaagcacatccttagaaataagtactattttatatttgtaggagaaatttgaatgtcattcttcctgattaaatcgaaattcatattatggacttatcgcttttttttgttaagtccggctccggaaagacggaatccgccaactttttgctccatcatttgaccacactcagtcagaagggcaaccaagcaactattgagcaacaaattctatctgctggccccgtttggagg

SEQ ID NO: 67612 - DNA, 8417 bp, Heterodera glycines
  Genomic contig location: Contig_ID=SeqID_1090; Location=2725..11141; Strand=+
  SCN-specific regions: Sequence locations=1-94,116-269,291-327,349 -441,463-798,830-944,966-1256,1302-1450,1472-1615,1644-2281,2312 -2728,2761-2816,2838-3178,3200-3613,3781-3793,3856-4003,4025 -4361,4405-4409,4437-4560,...
  SCN-specific regions: Sequence locations=...4582-4761,4783-4928,4950 -5451,5489-5829,5851-5852,5874-6151,6174-6342,6371-6518,6543 -6651,6674-6764,6786-6877,6899-6947,6976-7152,7205-7689,7738 -7905,7946-8091,8128-8417
  Gene Ontology: Mol. function=protein binding; Cellular component =axoneme; Biological process=N-linked glycosylation
atggatttccatttaccctgtgtcatcgtccatctcattctttgcgtttttgtgcttcctttttcatatagtcatcaacaacaatcaattggagataatcaagcagaaaaaactcttgagaatgcacttgggtaaacaaattcgattcaaattagtgttatacacagggttcgtagatgaaaattttcaaaagcctcatttggcaagcaaaaaagcctcattttgggtcaaaaagcctcattttcacaaatttattcaaaacacgtttaaaatgttcaaatgtgatatttttattgtccatgatcaattgcaattttttcttagaactaagcattttgtgaaattctgagcatgaaaaatcgaagttgatttttgcggcgctttttccaatttttttggggaacaggggggtccggcggtgcctatcggcaccaccaggaaaatttttgtaatttttaatgtgatttgtttaacagaatttgcccacaaaaatggccaaattttgcaattttatgcaaaaattttaagaaaatagaggatttttagggtccggcggtgccgatagggccgccgggggaaaaattgagaattttgaccatatttttagcagattttcattaaaaaattttttattttgtggttttttggaaaatttaacaaaaaaccacaaaaagcctcaaaatttctgaaaaaaccacaaaaagcctcaaagcctcatttcgaaaatttagcctcattgacctatctaaaaaccacaaaatgaggctaaagcctcagatctacgaaccctggttatacatatttaaaaataaaattattgataaaaattcttttgtaaatttgctaacgaaatcccatatcggtagatagtgggagatgttggttctattgcaatttaatgagtccaatcaatacaaaatctcagcgtttagacaattgccaaaaaagcatccaataaaaattgactggactcataaagatcgaatggactcataaaatgcaatataaccgtgatatgttaggataaacaaactttaaattacaattctaactagggttcggaccccgtgggcgggggtggcttttcgcgggggcgcgggatggcgggggtcagagtcgcgggggcggtggccgggtcacgacaattccgcccccgcagggatggggcgggggtttgatttgaattagctccaaaaaatttcaattccttttggcataaattgcacagattttgtctaaagaatgaccaaatttattgatttatgctaattttttaagaaaaaataggttttttggggggccggtggtgccgataggcgccgccgggggaaatttttttatgaattttgttagaaattagccaaatttttcagaaatttcattcttttgtatgaaaatacgctctaaaatcagaacatttcctagaaataagaacataaagaaaccctgcattaatcagataaaaataaattcaaatgaaaacgtcaaccggtgtcgaactcctaacaagaaatactgttagtgttgaagcactaaccactaaaacacaaatatattggaaattaacagcaaatatactttatttcataaaaaatttgtcaaagatggttaaaaattcaaatttgtataaattttttgccttttatcccacgatatgcaattcttagggggtgtattttcacccccgtgcccccgcgggggcgaaggtcgcgggggcgggggtcagagtcgcgggggcgggggttaggccaaaaaacttgtcctgcccccgtcggggacgggggtgacggggtccggaccctattctaaactaatgattacgttaaaaaaatcgtgggataactatttacataaaacttactaaattaaatctagtaatactgctgctaatcagccacgaaaacgaccaacaccgccgagttcgcctcctcgtgcatttgtggacgagtttgaaaaacggactgacaatggaccaagagcggaaaatgccgaaaatcaaccaaatcttttgaatttgaatcgtcatgagttcaaccagcttgacgaagttggcgcaacaacatttgaaccgttgatcagcagactgatcaactcggcccgttttgatttgccacaacaacttcaccaaaactcttccgctgctacagctaataatattagcatggtgttgcccattgcgcaggaaatgatgttcgaatttgtgccacactttgaacgggatttttacgagctgatggtgccccaggggtacaacgaggtgggatttgacaaatacgatttcaaattattgaaaaataaattaaattaatatcattttgacggaaacaaaaaaatcgagacggatgagaatcccgcttttatcccgttctcgtaaaaacccaatcccggcaaaaaagacgggaaacgagaacggcattcccggtttttcaagggaataccgttccagccggtctaattttctgcaatttctaatttaaaagaatgtaggaatcagaaaaaagagagtccaattactgatccaaaatgttcgatttttgtttcgaactaattaacaatgaatttatttccccataggctaccaaactgatcgctgttgtgtcattttttgacggacctttcacagtgtcaccacaatttgaagtggtcgaggacaaaaacaattggttcagtattggccacattattttaagccaggtaataagcactcaaaaaatttggataaaatttgtcaataagtgaatttttaaatttaaggaattaaattacaccctcagcgaagttcaaattctacttaaacctggaagcattgtgcagtgggaacagaatgagaatggtgactacaattttgagctacaggtagaagagtctcggtcatatacaatatttgtgtaaaaatttttttttaggcttcacatggccacataaaatttacatcgaaattacgcgcaaaggtgctgaagggtatgcgcgaaattacatcaatgtggacggaagaagctgaactgacaaaacctactgtaacgacactggttacggtaagtataaaaccaacaggaggaatggaagatactgtattctctaaaattgttcaaatcaatttacttactatgcgcttttttgtttaatgcatgcttttcaggaacccactaccgtatcatcggattcacaaccatttactgtatcgtttgacgattttactgatgagaaaagcgatagcagcagcagctacaatgaaactactgcttcctcttctgatgatgagccggctcaaatcatattggatttggatcacaatttgtacaatataaatactggttcatcaacagaaccaacaaaaacaattgaatcaaaagattccaaggatgaagcactgtttatgcttgatccaatcgagattgagctgaacaacagtttaaacagcattttgtcagcgtccagagagatcaaatggacaagaaggagggaagtgatgatgaaaatgaggagaaggaagtgaccaagacatcagtgaggacaaattttgtacagaatgaaatgggggaagatgaagcggaaaatgtggggatggaagggaaaaaagcggaggaagagaacaagaaaaaagaagagaggcaaaaagataaaggaaaggaagaagaagaagaggtagagaatgtgggaagagagcaggaaaaagaagaggaaggcaaagcggaaaagaaggacgaggaagtgggaaaagaagaaaagaatgggcaagagaagaaggaagaaacgaagagggaggaggaaaaggaagaaaaggcggaggccaaaaaagaagaaaatgaaaataaagaggaaaaagaaacaggcgaaaataaggaagagaaaaagcatcatcttcttgatgtgaacgactacattaaagccattcaaattgaactcgatgcacaattaatgggccaagacaatgacacaatttggcaaattgccgttccattcgcttcattgccttctttggcccataatccagttcccaatttggccatatcaattcctgaaagcaaaagccaacctattagccatgacgaaatggattatcttgtacggcttgaacttcattcatccaacgacactgtgttggacatgcgtcctcatcacattggaccaggagacagtgcacaattatggcttaacgaccaagaaaaagtggcaaatgagccactcgatttcacagtaagtaaaatatatctatcaccataatagggatatataaattattatggaattgggtatttggaagtgaattatctcggttgagtcattagtctcactcagtttgaaactactaaaagttgtttaggtttttgcgagtctcgaagactttggattttcaattcatattttaacatttaaattaaattttaaaataatattaaattagagttggaaagaaattaattcattttaaaaatataagaatatttccttttttacagttatttgcttccgttgttgattggaatgggcatcaaatcagtcaaccaatgagcatttttaaaggcaaatttgttgttgaggacccacccaagggaccaccaccacaaattcatcatcctgaagctttaacgggctatgaatttgtgattgatgaaaatgcaactgatgggacagaaattggacgcataaaattggaaaattccgatactaataatgcggatgaacatgccgaatttgagctgttcggccacggatcacatttgtatggacaaaaaacaaaatttaaaaaatcccgaaaatttccaagattcaaaattgactcgggtggcataatgaggctttactgtggtgccgaaaatggatggaaatctggcaatggtactcatcaatgcttggaccacagcatggtacaagtataccatctaattgtgaccgctatgcgcaaaaatggaggcattaaaattcaaaaagttaaaagttaagaaaataattcagggttccgatcattgccggaggcagtaactgttcgggtacgggacgtaaatgacaatccgccagaattgaaattgttctccgatgaaattgttgttgtgaatggacagttgagaggtgatgccccgtttatgatcggcatcagtgacaaagacaggcaagaaatggtcaaaaatcgaatttttaaagccctgatcagctgggcaagcccttcttcgatcagttatcccaaatcaaaaatcatgatatggtttaaagtgtcaggtcaatattttggtatagaaaaagcggattttgttttttaggttaggtcaaacacttaatttctaaaacggtctaaaatttttgtttgccttataatgaatcacatttggatgatcagaagatgatccacatattgatcactgatctgtcaacatttataaacagtttaaataaaatcacatacgatgatcaaatgttctacgtgttgatcactgatctgaaaaaaactaattgatttattattgtaaataaatttaacaaaatttaatttcagtgcacctgaaaaccgtttcaatgccctttcattggctggaaatttgtcaattttctttaaattggaacaatttgatgaaataaatggacttttcggcgtcatattaaaagacggggtcaaattaacggaagagggcacccatgaactgttgttggttgttgtggacggaagtggtcaaagtgacacgaaaattgtaccagtacgggttacggtacacattattctgtctgtaaacggtaacatttgtgcattaattattttcagaataatttgaagctataccatttcaagaaccaattatataacaaatcgatgccagcctaccgtatccataccggtaatttctttggttttacagtaatttaattttttggtttatttgaaggggtgccaattgtgcagttgcagttaaagcacccaccgccgagtactgttacagtaaactatttgatcagtgatggaaaccctggctggttgtcggtggagccattcattggcaatgtttttggtgccaatgttccaaagtcattaaaatcttgagttcggcatttttgatcctttttttatttagggaaggtgtcccaccaggcaattacagtattcaagtggttgctgtagaccaggaaaaacgacaggtaatgcatgaattttttttataggattatttcataattagcacttaattaagacgttttgaatataatgtgatcttaaaggttttggcggaatgtcaactgttgttggagctgacgggtgaaccagtcattgatgaacagctccaattcccatcgccatacgtctcgttaagcattgcccgattggacaacgatgatgaaaatgatgtcaattccaaaaaataataatttaaaatataaaaatgtgatttaagaaaatcgttgatttggtgccattcccagagggcgaatatctacggcacgctgagttcaattatggcgatttaagagcctgggatgaggctgaaaagccggcacaactgtcgaaggtgtccattcaaattggaaaattgattatttttttaatttaaaattttcagggagccttaactgtttttatgcccggaaatgggaccatccgtttggacatggcaaagttgcgcaatgtccgttcgcttcatctcaatttcacgataaaacccaatccaaattttattgccacaaatggaagcgaaagtatggaaagttttttagttttttttgaaaaaaaaatttatttagaaatcaacaatgtaactcttgtggccatcacacttcaatcggatgaaacaaaaacattggcattacaacgacagcgcgagaagccatgttttgccgctccatggacaaatgaatcggtgccaattcggcttcgaattaccgaagaattgccggtgaaccatcattaattactgtattttcacgggctacagtatttcttagatggggcaaataaaaaaacgaaattattatgaaaaataaaaaaataaacttaagattgaccatcccatcatcaaattgcctgcttacaacccaatgaacagcactgatcggctcaaaattttcatggatggtccttattcaaaattgttcaccattaatgatggtaaaatttaatgggaaaacaggcatggttaaggcaatgtttttctaaattaaattaatggcatttttaaatatttgaatttcattattaaaatagatttttattagaattattggatttccatatcatcccaagccttgaaaaatcaaattttcagatggtgtcattgctgtgaaagctcgacttgactttgaacaacttttactggatgatcatctaattgaaatcctattgcttgctacgtcaatgaaatcgccaccgcaaagcacgacagctcttgtacagattgaactgctcgatgttgatgacatggcaccggtcattcaactggtcaatggcatgctaaaagagccaaacaggtggtgaattggagcaaaatattttctggaaaaattgaacatcaattttactgggataattggattcttacagagaaaaatcgtcctgatttttttggagtagttttatgactcagaaattccgtaaaaaaaaaattaaaacggaaatatttgagaataaaagcattaaaaaaatactttaatgaataaaacacaaatttataatagaaatttgatcaattgagcttgaacattcaactgtaattaaataaatcgattaaatacaaaatttaattatttaaaaaattagagtgctagaggatgaccaaaatgctttgatcattgtggacatagaggaaaacagtggccatggcaagcttgaacttatgctgttgaatgtttctgatgttgattcgaaaaagcatcaatgtgaactgatcggaggcgaagggaaatttgcaatcgagaaaaaagtcaaattaataattaattaattgtaattaattaacaattaattttgttttataaataattagaatgcggcggagaatcagtggagtgtgaatgcaaaattgagtgaattggatcgcgagttacaagaccattatgcactggtgttcaggtgcaatgatgaaggtggtaacaacggcgaaattccggtagaattttaaaattaatttttaatcataatatttatttcacccaatttcgaatataattattattatcatgcttttgccatatttaataatttgtcctaatcatacatatttttggaaaatattttcagatccaattgaatgtgttggacaaaaatgacaatcgaccagtgatcacgtgggatcggcaggacacgcaaatccgcctgctggataatatgccggctggcagtgcggtgggacgctttttcgcccgggacaaagacgcgggggacaatggtcgcgttgaatttagtcttggacagcgacagcagccggctgccacgaaat

SEQ ID NO: 67613 - DNA, 1180 bp, Heterodera glycines
  misc_feature (45)..(45): n is a, c, g, or t
  Genomic contig location: Contig_ID=SeqID_8296; Location=74..1253; Strand=+
  SCN-specific regions: Sequence locations=1-104,144-236,258-260,294 -577,628-741,785-1070,1092-1180
gctcaacaaacacattcagtcgcactatcgtccgctgaatttgcnctggacactttgcatgcgttcaattttccaatggaacaatgaaacagtgaatgtaaaaaacattgaacaaattaattaccattttaaaaatttaaactaaacgagtttttttttaatagttttgattaaataaaaaaaccgaatttcaaattagaaaaatattggtctgaaaattttcatcggaacacaaaaattaactacattttcattataataaaatctaattatttttcattttaagcatttttgggtgtaaaagcttaatttttcgcttcattttggttctgtggtgccatactgtcgacgtaggaaaaaatttaatttctatgattattgttatttgatcaaaaaataataataaaaaagcataggtttggagccacctgctcggcttcgtctggttcgtctacctccaatggtgggccctcaatgaatcgcttccgtcggtgaacgcgccgattgcggactattgggtgatgggcacggcaatgctgtgcagtcaggtgaataattaccatgttaattgctttccaattaatagaattaatatttgaataaaattaatattttttcatttaaatacaaaaatgttatgcctaaattgcatctgttcaaaatctattgcagctctgtatgcttctctcctctgcttaccatattttcgggtgccattcgcctcagcgccgcaaacaatggtaaaataaatttttaaaatatttttgtaaaattcaaatattttctatggaaaggcttcgggccgaccttttcggcgtgtcggctggactcagtggactgtacatgaccggactgtacacttcattttaccattttccggttagttcaaaaaaaaaattatcagcgatttatttgctatttttggaccaaaaattaaacctaaaaatttccaaaatttaggagcttcaaaaattttacggcactctgatcggtgccatggtggttttaatcgccatttacgtgccattccgtcgcttctccatccagtccaaatgtcgctttggtgtgccggatgtattgtatttgtcaatggcactgatcgcactatacccgacttggcattggacccaggcaaatgctaattattaaggctggcattttgacttgatgctaatatgca

SEQ ID NO: 67614 - DNA, 734 bp, Heterodera glycines
  Genomic contig location: Contig_ID=SeqID_8297; Location=39..772; Strand=+
  SCN-specific regions: Sequence locations=1-734
atggccaggtttgaaccggcatatctggcttaaggacagtgcttttacggctgaactacagaccgtgccctgtacgacgccccacgcgatcatataagatttacagcgcctcttgtgatcctttacactccctctcgggaaacctacgactttatgccaccatggcatgctctggtatcagggaatgcttgtcttgtctgaatcgatccaaattgggcaaaattcatattcgaagagtcggtcgagaaagttactctgacattgagacaaatgtcgatcatttcaaaaaaaaaataattgcgtcgaccaccaatcctttaggcaaattcgatgtgatcggctgctcccaccagtggtggcatttgctaatcctcgccgcgttgacctattcccactggacgggcatccaactgctgatcacttaccatcgcacggcactgatcagacagcagcctctccatacggaccaaatgcttcttcaatctgccgcttcgccttttgtgccagcgctttcgtcgtcgggccgactgggaacgaatctcttaaatcacaccgcgacatcaaccaacggcggatgaccacacaaatcataacggagggcaaaatggaaaaacaatttcgcatttaattgtatttaacatgcacaatttcagatgaaaaatatttttgaaccaaaaaaagggctcccggaaataatgccaagggaaattgcgtcagtatactgtgtttctaaa

SEQ ID NO: 67615 - DNA, 563 bp, Heterodera glycines
  Genomic contig location: Contig_ID=SeqID_8297; Location=1904..2466; Strand=+
  SCN-specific regions: Sequence locations=1-563
atgcacacaaaagtggcaaaacactcaccaactttaaaattcgaattcaatccgaatgaaaagccgacggttggccaagcgattaatgcccttttgccgaccaattttggcatgccattggcacaagcgatggcacagtttgacttcaaagtggaaatccgtgaacgtgccattgagtgtgcgctggtgtttgtcgactttgaccaatgggagaattcatttttagaacatcacggagtgtacaaagtgttgctttacccaaaatcagggtaagacggaaaggatacggtactcaaattaaaatcattgtctgattttacaagttcagaaataatgtacgcacaaatgatcaatcgatgacacaaccgtgggcaacaaacactgatcagaaaaaaggtaaattattaatacaaggaaaaataagaaattttttttagctgattgtgaatttcccataatttatcgtcaatttcaagaaattagaataattagggcaaaaagtgccaataattaagaaaatatccccgcgttattcttgagtttattccataatttagatcata

SEQ ID NO: 67616 - DNA, 563 bp, Heterodera glycines
  Genomic contig location: Contig_ID=SeqID_38922; Location=212..774; Strand=+
  SCN-specific regions: Sequence locations=1-268,306-563
atgcctctggattatattttttttaccagaaaatatattagacctggatttcctggaccaaaattcatgaaaagttaggtccagaaaaaatccaggctttccatgtcctggacccggattttttttttcatttttggcctagattcttgtccaaattcgggattttgtcaaaatggatgtcagatttgtaattagcgaccacaaaaacacccgtttaccaactttttatgacaaaaaaattttcaaaaccaaaaaaggacccctagtgtttttaataatttatctaaaaatctaatttttttttacaattttcaggtgctaatgccacaaggcatcggcctattcttgtcccaagtcttctccaacatttggccaaccaatttggcatcacggatttgcatctgtccattgcgcaaggcttttggcggccaagaatttggggcgcacaaatgccgtgcacagaagtgcccagtggcaacgaattaattgccaaatttgacacatgccaagtggctaattgcaggcaatatctataaatgccagaaaaaatttttattataaaa

SEQ ID NO: 67617 - DNA, 55 bp, Heterodera glycines
  Genomic contig location: Contig_ID=SeqID_38922; Location=789..843; Strand=-
  SCN-specific regions: Sequence locations=1-55
aaattagtcaaaatacatgtcagattcgtgattagcgacctttaaaaccccggat

SEQ ID NO: 67618 - DNA, 555 bp, Heterodera glycines
  misc_feature (63)..(63): n is a, c, g, or t
  Genomic contig location: Contig_ID=SeqID_38924; Location=688..1242; Strand=-
  SCN-specific regions: Sequence locations=1-129,160-215,237-414
atggcaattcaatttgataaatgcaggttaacatcggaaccaaaggtagatgcccaaatcaanttattaattattcttgaaacattgtgtaattaacctaaatttacatcaattatgtatagatgagagaattattgtttaaaaaaaataaataaaattgttaaacggaatttttaactcaattgcactgaatcaaaaaagttaacgctaaattcatttattaaaattaatttttagctaaatttgggttttagaagagggtttgttgaaccaaaaatggatttgaaaaaggtcgccctttttttttgctccgggttcggaattgtccaaattaaaccaaatattcatgataatgtattatggtactccggggaacgtgtttttgtgacatattatgtttaattgtcatattactttatttaatattaaagataaaattaaaatcaaatatttaatagtcataatatttatttaaaattaattatagattagagtttttttaatttaaaaagaaaaatatttttataaaatattaaattccattataaaaataaa

SEQ ID NO: 67619 - DNA, 271 bp, Heterodera glycines
  Genomic contig location: Contig_ID=SeqID_38925; Location=127..397; Strand=-
  SCN-specific regions: Sequence locations=1-88,117-141,163-249
ataaactgatcagaagcggaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaat

SEQ ID NO: 67620 - DNA, 436 bp, Heterodera glycines
  Genomic contig location: Contig_ID=SeqID_38925; Location=720..1155; Strand=+
  SCN-specific regions: Sequence locations=1-56,83-163,210-210,236 -391,418-436
ggttcgatgaaactttttaaaatatgagcctaaactttttggcctgtttaaaaaggaattaaaaatttttaaaaattttattcatctccctttttgatagaaaaagcatcagagtgcctaaactagcatgtaaataaaatttggtgcgtttcacagcacgttctaaaaaatatttatgaattaattatgcaaaataataaataattaatgaaaaagtcagaatttcgaaaaattttaaaaacaacaagcgttggcattttttcaggttaagttagtcctttacaatggagaaggcctgcaaaatttggagagattatatcgattttagcgcgctaggttcgatgaaactttttaaaatatgagcctaaactttttggcctgtttaaaaaggaattaaaaatttttaaaaattttattcatctccctttttgataga

SEQ ID NO: 67621 - DNA, 723 bp, Heterodera glycines
  Genomic contig location: Contig_ID=SeqID_38927; Location=31..753; Strand=-
  SCN-specific regions: Sequence locations=1-393,418-723
atgtcttcagctcgatgccggatggctttggggcccgcgctgttccgacttcggcaacatgtcactacggccgaaaatttgctggacgagcccgtgatcaatgccgagacgaccgaaaaccttgaacaggaacgggggcacatcacccgtatcctgtcaaggatggaggtcgagctggacgcgtggggtgccatcatgaacggactgcaaggcccagcgagagaggcggaggaagcgcttttcactgcctttattcgagatgaccggcacttgacggagtggttggaagatgcgcgagaaatgttggctcacatagcagcagaactcgcagatgaacccaaccagccgatcgcggcgggaggacagcaaccagctgttgttgtgaatccacccgtgccagccgtgccattcgtcaacaatgccgcatttctcggcggtgccaatgttcaacagccagctgctgttgccaaccatgccaatcagccaccattggtgccaaataatgcccaaatcgtgccaaacttgccggctgttgctgcgcctgcgcctttagccactgctcggctgccgcagctcagtcttcctgttttttcgggcgaaccaatggaatggcccgcgttttggcagagtttcgagagtgccgtcgaccgtgccgcccttgagcccgtcgacaagctcactatctccacggttgcttacgcggaaaggctgctcgtgccgtaa

SEQ ID NO: 67622 - DNA, 666 bp, Heterodera glycines
  misc_feature (30)..(30): n is a, c, g, or t
  Genomic contig location: Contig_ID=SeqID_38928; Location=308..973; Strand=-
  SCN-specific regions: Sequence locations=1-622,645-666
atgccaggagacattcaaattggcgcactnttcccaatgcatcgccaaattgccggctccgaggggtgcggtgccatttgggaacagtacggtaggtgtattagcggtatttgtaaattcaaaattcgaatttccatcgcagtgctgttaatattgggcggctcttttaggaattcaacgagccgaaattgccatgctaacggtgcagcagctgaacaaagtgttgccgtttcggcttgggattagcatccgcgactcgtgctggacagaacgaatcgccatggagcaggtcaccgctgttttcgctgccaagagcagaatcatttttaaaatgccaaaattaaaatggaaaaacattttttaaatttaaaatgtttccctgcagaccatcgcctttctgcgcgagggggtcacccaatgttcgtgctgccaaatggccggctgtcagaagaagtcgagccccgtagtggccatcgtcgggccggcgaagtcgtccacaacaattgcggtgcagaatctgctccaggtgttccgcattccgcagattggctactcggcaacgaccacggatttgagcgacaaggagcagttcggatactatctgaggtgcaaaatgctcgaattttcatgacaaatcccaaaaagatgggttttggaaagcattag

SEQ ID NO: 67623 - DNA, 1219 bp, Heterodera glycines
  Genomic contig location: Contig_ID=SeqID_38931; Location=42..1260; Strand=+
  SCN-specific regions: Sequence locations=1-87,110-134,173-228,255-1219
cgttggcacagacaatcaaaaagggccacggattatttatctgcaagagccgactgttcaccaaatttctcctagtcaattccgcaattttgttatagaaaataccacagatcccgaatggaaaggtgaaaatgtttttttaatttatattttattttaatttgaaattttagcaacaaaaaatgcaaatgaagcatcatcatcttccataaacatcccaattaacattgatagtgacagcgatgatgatgattatgatggtttggacagaagagatgcattaaggacaggaggcccattgcttttggactttttcaccggaaaggcatatcagcaaaacttaagcaggcaaaatcttggagaatattcaaaaagcaatttacttgatatgtcaaatcaaccaaataattcgaatcaaatgattttaccggttgtgagaaatcagccaagcaattctgatcagaccaagcaacggagtgtaaacgatgattccaatatgcttatgcgagtaaatccagctaataatttgccagaagtgatagcttcagtaaccaattctcagcagcttactgaccagaataatcagccgttgacggaaaatccaactgatcagtctgtaagatcaaatcaaaacaatcagcatgaaattcaagaaatattacatttaccaatgaaaaatcaacaaaacaataaaagagcagcagcaccaaattcacgacaagaatttggatttgatctggagaaagtgccaaaagcaaaaaagggtaaaggtttggcagaatggttgggtcatagcatagatcaaaagcagaaaattgctgtcgaaaacacgtctgaacagccaactattactgatcatattaatttatcgtcacagacaacccaattaaacaatttgaataatccaacaaccaatcaaaatgtggttgatttatctgacaaaactttaagtacgaagcaaaccaatgaagtcggtccgttaaactcaatggacaattctgatcatcaaatgatgggaaacgctgttgttcagcaagtcgcatcagatcagtcatgccagtcgacccagactgacaaattgtctgatcaaataacctttacaaaccaatttgacccgaacaatttggaaaataaattcaatcagtccaatttcatcaatttttcattatcagggcaaaatcagacaaataatgataatcactctgaacaatctgaacca

SEQ ID NO: 67624 - DNA, 1112 bp, Heterodera glycines
  Genomic contig location: Contig_ID=SeqID_38932; Location=46..1157; Strand=-
  SCN-specific regions: Sequence locations=1-131,160-465,487-630,653 -927,957-1112
atggcaaccgatttgattcattggcacaatgcaggcagaaatgtgccaactttgagtcggcggcacaaggcagttcaacaggcgatgaaggacaacatcattcaatggttttgccagtccgtgagttgcacaaaaaaatattttattttattttaaaaacgcccttttatagcaaagtgttctggtggtgttcgcgcagcggtgaacgctgatgcacgagtgattgaatgtgccggcactgacaaatgcccggacggctacacatgtgttggcaataaaaactgttgtccagcgtcgaaaggtgccaaacaaataattttggaaatggcgcatcatgcaaaattgttttcaaaattcatgaaactatattttgaccattacttaatatcagatccaaattcgaagaaagtcgaaaattcatatcgaaattcgcttttttggctcaagtccggattaaatacaaagaaacaaactaaaaagccaacaaaaagatcatttaaataattctaaactaaaaagaaatttcgactttttgttcggtcccggtccagggttcagaatttgcacaagtgaatgcttgattcatgatcaaatgaccaagaaaacactcggaaaacataatttcaactgaattttttaattattattttttcttttgaaaatggggagagaccaaacgatgcgcgctttaagcaaaaattaattgtaatatatcttacaaaattaacaccctaaaagaaattgtctgcggtattgaatatgatacgggacgatacgccttccaggggtcgcatacgccggtaaattttggacagaaattgaaaacactgcactgaaaatttacagcgttacttctacaagaaagacattgacaattgccttctgttcacttattacggtgcactcggaaatggcaacaatttcgagtaataataattaattattattttaaatttgattctccaaaacacaaatatttaggacatacaatgaatgcatcaaatactgcaagaagacttaataatttatgtagttataaatatttcatgatgtgaagtcaattggcgttgagaaaaaaattatgtcatttcataaaaatgatcctaaataaa

SEQ ID NO: 67625 - DNA, 56 bp, Heterodera glycines; identical to SEQ ID NO: 52733
  Genomic contig location: Contig_ID=SeqID_38937; Location=145..200; Strand=+
  SCN-specific regions: Sequence locations=1-56

SEQ ID NO: 67626 - DNA, 192 bp, Heterodera glycines
  Genomic contig location: Contig_ID=SeqID_38939; Location=467..658; Strand=-
  SCN-specific regions: Sequence locations=1-25,47-192
atccgcgtttcattacgccgctttgttcttcctcttctgagcccgtaaagcgccgttctctgctggtggagccaatggcaccgctcgaagatcaccacgagttgccggtggtcgttttgcaagaggagcgactgaactcgcaaccgccggtcagcaaggagtacctgcaagaactgttcgttcaattggatg

SEQ ID NO: 67627 - DNA, 601 bp, Heterodera glycines
  Genomic contig location: Contig_ID=SeqID_38941; Location=1..601; Strand=+
  SCN-specific regions: Sequence locations=1-121,143-473,499-601
  Gene Ontology: Mol. function=structural constituent of cuticle; Cellular component=extracellular; Biological process=cuticle biosynthesis (sensu Nematoda)
gaatgtccccaagcacagccaggcccccagggtgcgcctttgccccagggagtgcctgggtcgcctggagtgccaggcatagatgccgatggaggagtccgtgggcagcccggcttgccggggcctccgggagcaccgggcgagccagggcagccgggccaacccggcgaaccgggcccagctgggataatgcagtgagaattataactaataatataagcataaaaacaatgaatattgccatgaaatttagcgaagttgacggaaagccaggaccgccagggccagcgggaccgcctggtctgccgggcacagagggcgcgccagggcagccaggcgccccgggtcaacccggcgggcagggggcagctggcgaaccgggagagccgggcccaccgggcaaaacaggcgccgccggacaacagggaccacagggcaaccagggcacagggtaagcgtggaggaaaacggggtaaaaatttatttttatttaaaaatcattgagagtcgaaatttcggcatttataaagtaatgaaaatttgtcccttctgaagaggcacttgcgaccattgcccgccgccgagaacagcgccgggctat

SEQ ID NO: 67628 - DNA, 1470 bp, Heterodera glycines
  Genomic contig location: Contig_ID=SeqID_8301; Location=876..2345; Strand=+
  SCN-specific regions: Sequence locations=1-95,118-606,628-867,889 -1264,1286-1354,1383-1470
atgcagaagggatacggtagggacaataaacggtgttggcttgaagatgaacttttccgaagaagaatgcgagtcaacatatttctggcaatcggcatacaaatattgttatgcttcgcattgtttaagaggtatgactttggttaaataagaccaattaaacgaattgaaaagggtaattataatgatgaatgttaattaattttaaagtttgacggttccctggagcacgactcaatttaaaacccaaatatgggtcaaggagtttaattactacttaaatactgagttcacaactctgttcttatttatatcccacaaatatggatttaaagttcaacctaatgcttcaagtcttatctaattagagttcctccccgatcttaggtggaagaaatgtatgggctcataaacgaaaatacttgaccaaactttttaagaatgactcgaaaattaagaaatgtcatgtatgaaaccatcataatcctcttaaagaaaaaaaaggcttttttggaaccgtactattatgcttggacaatcaaaacagaggtatggaacatgtgacttaattactattaaatacagagcctacaactctgttcatcattatactataccgaaaaatttatacgaatttgacattcgaacccgtatcagttaatatgtatataaaattaggattattctctccggtcttaggaacaaaacaaatctcttagactaaatttttttaggacgattcgacaattttgtggatggcatttttagctcgtcataattcactttatcaaatattttaaggaaatgaatggcttacgcattatgggtgtgccaaaagcccggagaaaggtgcatgtagcgacaatgttgagaaggagatgaaagatttgtatggccttgctgtgagctgttcattttgtacaattggacgcaaaatggacgacatgagcaacaagaatttcccgctgtacaatacaaccaatgttgtaatgccgccatcaggacgaggtgaaacatttaattaattaatatagttagtagagcctggaaatttctaatttgcggatcgagttgcgggatttgaactaaaaatcttttgtctagaggggatcccgcgggattaattccgcatttcgcaaatccactatgctctacacggtaaaggttgttttaatgtgattgtacagtcaccgttcggaatgtcgtttgtaagctatcgtggcgcattacccatctctgtaaaggattttttgggtgctagtcgctttgtaaaactgccaaacttacagatttttcgttactttttaacacaaccaaattaaaaatctacatattacgatagctctgggcttgctctattagcataaaatttcagaaaatttcattgagttttcagaaagtcataaccaaaaagcaatctatgcgctagcgtgtgataccaagattaaaaaaggcaggaagaaattgtaa

SEQ ID NO: 67629 - DNA, 757 bp, Heterodera glycines
  Genomic contig location: Contig_ID=SeqID_8301; Location=2410..3166; Strand=-
  SCN-specific regions: Sequence locations=1-426,462-637,660-757
atgaaccaggggaaagaagaaggaaagtcaaggagactagccattaggccatttgcacacttgggcaggggtccgtatcgttttggcgccgacgttttggcgccgacgttttggcgccagggtcgttttggcgccgacgttttggcgccgacgttttggcgccaagctataataaaaaaaagaaaacacccaaatttaaaaattttgtaaaacaacaaaaaaacgtatttttcgcgaaggtaatactgccgatggttggttgcccccttttttgaagaaaatttttttgttttcaaaagtcatgaaaacatgcttccaatggttttcagggtcgctgctcacgaaccaggcatccatttcgaccaattcggaacccggagccgaaattcgaacaaaaaatcgaaaataaaaaatttcaaaattctctttttgtttctaaaatagattaaaacaaccaaaacgttttggcgccaccgatttggcgccatgtagggaggaggtagaaatgatgaaatcgttataatttttctgacgaagtctatcaaagagccggatttaattcttcatttactctttttcgctttggcttatgttctcttaattttgtatttaggtaatgaatcgtcaaattgatacgaaaaaacaaaagcctaaaataacgcatgaaggccagcttcggccggtgggctgatcgaatgaaagaatgtttcggagacggcacattctcattggcacctccaatgttctaccaaataaa

SEQ ID NO: 67630 - DNA, 862 bp, Heterodera glycines
  Genomic contig location: Contig_ID=SeqID_8302; Location=4..865; Strand=+
  SCN-specific regions: Sequence locations=1-695,730-761,783-862
ggtcgacagtgttcgagtgcacatggaagaaatcaacctgagcttctcccaccgttttgcggtgatgcccgacaattgtctctccatgtaagtttggcattttgtttttttttgacaaatcaaaattgcctttcatttctcggatgggaaattggggaaattgacccaactcgaaataactactttttcttccatttttatagcctcggcacggagctgctgggagctgttggctttatcctaagcttacccgatggtttgggcattcgtgcggacatctgtgcagcgaagtggttttaaaccgccctaaattttggagactatcttttttttttgttagcgaaactcctcaaactccgtccatttcgttttcgcaaaaaatgtaagttgtatggcgttttgtttgtttttattgcttttttatgcattttcattttaaaggctcaaagctgttttgggtgaaggtgctggtgactcggggaagaagaacgaaatggtgtacgttgaatttaatccggataaaattggtcacagttccattcgaatgctattcggtcatccttcaaaaaccaaattagccaaagactcattcctccaacaaattttaaattcgaaaaaagtacccaatttattgaatttctatccctgaaaaagtgggacagtaacatgcgttaatattcgatactttgtttatgttttttattacaattaattaatttttcccaatttccataaagccttttggcattttgatgactgagttttaaatatctttttcatttgaaggatcgagggaaaagtcaaatgggcgaaatttttgacggaggatgagattcaacgggagatggccgacacaatgtag

SEQ ID NO: 67631 - DNA, 224 bp, Heterodera glycines
  Genomic contig location: Contig_ID=SeqID_8302; Location=1277..1500; Strand=+
  SCN-specific regions: Sequence locations=1-46,90-224
atgggggtctgggtgagaaaagagaagggaattggtgagggatcacaaatttttgataaaaataaattaaatatttattttcatttatagcatttgtccatatcataagtggtcaagtggataaacgtttttactttcattatttgtctcttcggttcaattccctgatggaacagaaaattttttaatattttctttaccattattttaattgaatttaatta

SEQ ID NO: 67632 - DNA, 54 bp, Heterodera glycines
  Genomic contig location: Contig_ID=SeqID_38948; Location=805..858; Strand=-
  SCN-specific regions: Sequence locations=1-54
cgtcgccaatacgaggagacggagttggagaagcggcgcgaattggaactcgag

SEQ ID NO: 67633 - DNA, 141 bp, Heterodera glycines
  Genomic contig location: Contig_ID=SeqID_38951; Location=95..235; Strand=-
  SCN-specific regions: Sequence locations=1-141
atgaccctcaagtgccttccgcccgaacttttgttcgaacttatgccttttgtccctgctgaaaatgccgttccggatgcgatttcgtcatgtcgactgttccactgccttttgtttaaacgtgtcctcaattggaaaaag

SEQ ID NO: 67634 - DNA, 1074 bp, Heterodera glycines
  Genomic contig location: Contig_ID=SeqID_8303; Location=214..1287; Strand=-
  SCN-specific regions: Sequence locations=1-1074
atggaacggaacaacgaaccgctcgatgaggaagcggcaaacgggaacggaaatcagggggatctcccctccgaccgacaggacggggaacgagcgaatgcggcgcagcagaccaaaacaaagaaagggatggacgcgcaaggcctggggacaagccaaacgggtgttacacccgcggcatcgaagaatttgcgcagcggagcaattacggtgaggtcggcccgagatcggattgagagagcggctgacacactctcgtcgcgaatcgcagaagcgcgggagctgatggactcggatttcacgaggggcgaagcgcccgagcacgccgcgcggctgatggcaatggaacggggacttggacaggtcacccggatttttgaagggcatttcgataagggaatagcagaagcgggtgcggcacccgaggagcggcaggatttcttgtatgatttcgtggccgcccccttgccagcctcgacgaagtatctgcaactgcgggagcatccaactcctgccgaactgctccaaattgcggctgagcatctcggtgatctgcaggcgatgaggcaaacatttgaggacgaagaaagggagcagagcatctcccgatcgagcagatcagtcgacaccgaggacagtcacccatcgaaggagctcccacgcaccatggcaagacgaagcatgccagagtgggagacatcgttcagggatgtcttggcgcggttccaggctggacaagttggccaagcgccacaaagattcgaacaagccaaccgggtggccccacccgtcatgccaaacatggctgcgctcatccaacgccgctcaaatgccccatcagtggccagtgttcgggtgaacaacccggtcagggaatggatggcaaggaaccgagggggagagaacgaacccccggcgcaacagcggccacaagctcagcaaccgctgcaagccgaacagcaacgatttgagcgacttacgctcaatgaccagggacaagcattccctcgggcatcccatcatgcccgtattcgaagggaggagcatcccagtcgggaacgcctccgaacttag

SEQ ID NO: 67635 - DNA, 648 bp, Heterodera glycines
  Genomic contig location: Contig_ID=SeqID_8303; Location=569..1216; Strand=+
  SCN-specific regions: Sequence locations=1-648
gccaagacatccctgaacgatgtctcccactctggcatgcttcgtcttgccatggtgcgtgggagctccttcgatgggtgactgtcctcggtgtcgactgatctgctcgatcgggagatgctctgctccctttcttcgtcctcaaatgtttgcctcatcgcctgcagatcaccgagatgctcagccgcaatttggagcagttcggcaggagttggatgctcccgcagttgcagatacttcgtcgaggctggcaagggggcggccacgaaatcatacaagaaatcctgccgctcctcgggtgccgcacccgcttctgctattcccttatcgaaatgcccttcaaaaatccgggtgacctgtccaagtccccgttccattgccatcagccgcgcggcgtgctcgggcgcttcgcccctcgtgaaatccgagtccatcagctcccgcgcttctgcgattcgcgacgagagtgtgtcagccgctctctcaatccgatctcgggccgacctcaccgtaattgctccgctgcgcaaattcttcgatgccgcgggtgtaacacccgtttggcttgtccccaggccttgcgcgtccatccctttctttgttttggtctgctgcgccgcattcgctcgttccccgtcctgtcggtcg

SEQ ID NO: 67636 - DNA, 617 bp, Heterodera glycines
  Genomic contig location: Contig_ID=SeqID_38952; Location=126..742; Strand=-
  SCN-specific regions: Sequence locations=1-391,415-617
caggatcaacgcccacctgtgtccgttcggcttcaatctgttgcctgagggctctgatcgatgcttcgtgccaagccggcgtattgtatgcccagcggcataaaatgtgcgctaccgtaatcatcagcgaattggcaggaggcgccaaaaaggttgttgaaagcttgatcaaaaggtaaagctaagtttggaggagtgctgcgattgttgtttgttggcctatgaattgtcgcaaaggggcgaaagatgcgcagcgcccaaagggttttgagttgttggcaaaggcacagcacaaaacgcactgtgtttaggttcagcccggactgtttgaactctttcaacaaatgctgtgggaattcgtcggcggaagggccgcaattaaacggtgaatttggggagacaaatggggaggggttgccgaaacggacggacgaaattcagcgccaatccttttggcacaaccgtaccaaagtgttgcggttgccattgggcccgaaaatggaggtaaagtgaagggacagagcaacaacagtcgagcggaacaattggacgtgaatttagcagatgccaactgtgaaagtgccaaatgccaacatttgtgctcagttaaagacgac

SEQ ID NO: 67637 - DNA, 49 bp, Heterodera glycines; identical to SEQ ID NO: 51181
  Genomic contig location: Contig_ID=SeqID_38956; Location=562..610; Strand=-
  SCN-specific regions: Sequence locations=1-49

SEQ ID NO: 67638 - DNA, 847 bp, Heterodera glycines
  Genomic contig location: Contig_ID=SeqID_38957; Location=142..988; Strand=+
  SCN-specific regions: Sequence locations=1-423,445-733,755-847
  Gene Ontology: Biological process=tRNA modification
acaagacccgctctcgcattcgttgacgaacgattctcaaactgctgcggcaattcagatagtaactgcgtttaaagacacaattttgtcgccaaatgtttcattagttgtgatttgtttgtactcttatcaaaaagaatcacttcaaactgaattcgaaaagcagagaattgaggtacttgtagtgacagttgatggatatcaagcgcaagaaagtgatttagtaattttggtcacaacaagaacgagtcttcgagatggggcattaagtgagaattcagaatttttgaaggattcgagaagagctacagtagctctaagcagggcaaaaagcggtttatttttgattggggacttcaaaactttaagtgagggtgaggtatggaataagtttttggaaacagcaagtgaggactctcaaattgttggtgaggaatatcttcagatcctacgaaatggtcgatacatgcgtgatcgatattggcaattaattgatggcattggcagagtagtccaggatctacagtggttacaaaagaatgatgaaaattggcgaacgatgcaacagcagagcacttcaagcagcatgtccacatttgagtcgagaaaaagaagagctgacgaacccgaccaagggccgagtgcacgccgaaatgagacatggaggccgcagcagcgtcttggacaattcagcggtgccgtttttgtcagaagtcgcgaaccaacgggtcctcgtggtgcttgctttgtgtgcaaacgtgtcgggcatttggcaaagaactgttggtatgcggatggacaatcagcaggacgtggtcaaccaaggggcaaagggcaatggaaataa

SEQ ID NO: 67639 - DNA, 439 bp, Heterodera glycines
  Genomic contig location: Contig_ID=SeqID_38959; Location=605..1043; Strand=+
  SCN-specific regions: Sequence locations=1-439
aaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcttccaattccttctacaatcgcctttatacatcccattatgagcgctaaaattatcagagggccgaaaatcgc

SEQ ID NO: 67640 - DNA, 638 bp, Heterodera glycines
  Genomic contig location: Contig_ID=SeqID_8306; Location=1743..2380; Strand=+
  SCN-specific regions: Sequence locations=1-248,274-355,378-638
atggcatttgttgggcatcccattttggcagtaagtgttgtcaaataaatttactaagttcctttcccattcatttcgctttaggacattcgcaagggtttccgtcttcggcccactcaaaccgtggacaaatccaagccgatcattcaggcggaaggggagcagctgaccgaactgcttcaaaaccgttcgccttcccccgcggagctgccccaagcgaaagccaacggagtgccaaaggcgacaaaggcaccgccgccggcaccgccgatgactcagcaaaagaatgaggcaaaaagacagcagcagacgatgacggcaaaggtgttgtatagaaaggactaatgaaaaatacttttaaaatttgtgacagccatcgccgaaaaacattggcaacggtcagtcggtgagtgccgaccaacggcaaaaaatgttggcacaaatccgttccggcggtgttcgtctgcggcacgtgcaaacagcagataaaagcgggctgattttggacgagcaacagaaatgcacaatcggcacgcgtaacggcgccgcgtcacctcagtcgttggactcgcaggggtgagggagcaaaacggggccaaccaaatgccaagcgcaaaacgcaccggtgaagcgtgcca

SEQ ID NO: 67641 - DNA, 587 bp, Heterodera glycines
  misc_feature (264)..(264): n is a, c, g, or t
  misc_feature (293)..(293): n is a, c, g, or t
  Genomic contig location: Contig_ID=SeqID_38962; Location=70..656; Strand=-
  SCN-specific regions: Sequence locations=1-69,92-226,256-273,325 -334,362-534,575-587
atggcaatcaaatggtaattactttaatggatattaaattatcaatctcagagcaccgggactttgggaaaataaatatgcaaattaaaagtgctacaaattagccgctttttcttttccattggcttttatttatcatttttagttccgttttgccgcattgtatggcattggaaaccttatggacgaagccaatttacaaggcttaccataaatgcacaacggaagacgagcgagagaagcaaatgcttttccccgtgttcngcagccaagaaaaatattttgtaaaattntaaatcttttaatttaactaatttttattttggatattttaatttatctatttattttttatttattttactaaatgtttcgaaacggatttagaaaccggccgagaagcaaactgaaattttttatatcgggaacggtttgccgggatgttatgcatatgaagacccacaaaggtgggttattggttttttttgaattcccgcccccattccttcttactgtaacttttgtaaaggttgcaaaaatttgaattataaaaatttattttttttaatttttagaatatgaataaa

SEQ ID NO: 67642 - DNA, 157 bp, Heterodera glycines
  Genomic contig location: Contig_ID=SeqID_38964; Location=153..309; Strand=-
  SCN-specific regions: Sequence locations=1-42,64-97,119-157
atgcgaatttacacgaatttggaaaaaattgaaataatagagaaattctatagaattaaagaggaaaatccgagaataactggaaatcaaatgagcgatattttgggcatttcaaaatatacattagggcgatggaaaaagcaattcagtgaaaaag

SEQ ID NO: 67643 - DNA, 277 bp, Heterodera glycines
  Genomic contig location: Contig_ID=SeqID_38964; Location=446..722; Strand=-
  SCN-specific regions: Sequence locations=1-159,181-182,204-256
atgcgaatatcccaaaatttgtcagttaaatgttataatgacgccgagaaaaaagaattgctgaaattgtatgaaaaaattaaaaagaaacaccccgaattggacaaagaaaaaattgggaaaattctaaatgtgacgggacgaaccctaacaaattggaaaaaccaattttatgggaatgattccaagaacaaatgtgaaaatgtacagaagaaaagtaagttttttttattcaaaattaaataagtttttgaaatttaaggcaaataaaaataaa

SEQ ID NO: 67644 - DNA, 660 bp, Heterodera glycines
  Genomic contig location: Contig_ID=SeqID_38965; Location=145..804; Strand=+
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactccagaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaac

SEQ ID NO: 67645 - DNA, 457 bp, Heterodera glycines
  Genomic contig location: Contig_ID=SeqID_38968; Location=230..686; Strand=-
  SCN-specific regions: Sequence locations=1-133,155-245,310-457
gccttttggagaatttggcgttgaagccatcatttctctcgagttcgaacgacaacatttcggagataaaaatcatattgttgaaagcatacaaacattttaacattatacctgaagaggaaaaccttagtgaatttgaaaaaattacgcaaaattttgctaataaagaaaattatgaaaaagtgcagaaactggtcaaggcatttaaaatgagcagagcattggagcgtaatttgattctaaagattttttaaaattaaaaaatatatttgtccattaaatattcaattaatgaataatttattttttctatggattattaagaatgacaagaagtagtgtctaaaattgacataagaaagataaaatttaacaaaaattccttcaaaacccattaaaaatttaatttacaaatttaagcaccatacgccaaactaaacggataaaaattaataaa

SEQ ID NO: 67646 - DNA, 129 bp, Heterodera glycines
  Genomic contig location: Contig_ID=SeqID_38968; Location=1..129; Strand=-
  SCN-specific regions: Sequence locations=1-129
actcaaaagtaccgtaaggcgttggaaaaaatcaaagctgagatggtaaaggatgcggattactgtaaggattgtgcaattcctaccgttaacgaagtcttggcaacaccaattccgcttaggaacaaa

SEQ ID NO: 67647 - DNA, 373 bp, Heterodera glycines
  Genomic contig location: Contig_ID=SeqID_38969; Location=890..1262; Strand=-
  SCN-specific regions: Sequence locations=1-142,201-373
atgggaaaagatggcatttctgctggtggaagacattggcgtggcatcaaagtgcaaacgaagccgaaaagtggcccaaacggagaacaaatgagaaactttgagcttgaaacatcatttacctctcaaatgtttattcatgaaaataataagaaattaatattatcattcattataaaattagtaagtaataaaaaaaactaccaaataaatgttaagaattacttaattagtattaattagctgatttaacattactaattaagcatcaatgtcgggttgaatcgacgtcaattttcgatcagatttgatggtaatgaccaaagcgattccttcacaatgttttcgccgtcaaataatggtaaaaaataaa

SEQ ID NO: 67648 - DNA, 657 bp, Heterodera glycines
  Genomic contig location: Contig_ID=SeqID_38971; Location=106..762; Strand=+
  SCN-specific regions: Sequence locations=1-657
caaaaaaatcgattttttcaagtgtccgtttggggtactcaaacaattatggggagcaaaaatccaacgcagaattaaagtacaggctatagggaagctattcccgaaggattcggtctccccataaatctgggcgcatcggtttggggggactgccccgaaaacaaaaaaatcgattttttcaagtgtccgtttggggtactcaaacaattatggggagcaaaaatccaacgcagaattaaagtacaggctatagggaagctattaccgaaggattcggtctccccataaatctggacgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccatatatctgggcgcatcggttcggtgggactgccccgaaaac

SEQ ID NO: 67649 - DNA, 508 bp, Heterodera glycines
  Genomic contig location: Contig_ID=SeqID_8309; Location=539..1046; Strand=-
  SCN-specific regions: Sequence locations=1-183,218-476,498-508
atgagaatggctttcatgttcgggtggatgaccgatgtgcgtgccaccaaaatcaaattggcaatggacaacggaatgccaacaaaatttatcaacagttcaacggcaccgccgaggaacaaaagaaactgctcagtgtcagttggtgtcgttgtgttcatgtttttgtgttagcatacgttgattaatttcaaaatttaaaaataaattaaaattacgtttttaatcaactgatatatagaaattataataagtcaaaccaaattatgggggaacagaaaaatcattcaaaatttacacaaatttccccattattaaatacaaatttacaggcatgcttatgtaaaaaatcacacgctttttttgtcagtgaaaatatgacagggacaaagtgtcaacaaattacgaccaattaattgccaaacatctaaattttaatgagtttttcacttcttttcatgaaattaaagagccgtcaaaaaaggttgtgcatgactaacgaaataaa

SEQ ID NO: 67650 - DNA, 1209 bp, Heterodera glycines
  Genomic contig location: Contig_ID=SeqID_8309; Location=1423..2631; Strand=+
  SCN-specific regions: Sequence locations=1-190,213-346,368-415,449 -652,683-896,918-927,949-1209
atgcctaaaaaacttaaaattattagttttttcataagccaaaaggtattttgataatgttgttaagcataatgttaagatgcatttaccgatgaattttatatgccaaatctgtttttttctgtcctatgtcactctaattcgagagatgattaattcttattcgataagatataagcgatcaatttttatttacagttgatcatcccaatttatattgccaccacaacgccttcaccacatgatcataagcaaccaataacgaatctgatcacaactgccgtccaattgctgctggtcggaagcattgagttaggcattttttacaaattaagccgatacaattccaaaatttatcaaaaaatgttccaaaatattggctcgaataatctgtcaattcgttatcaggtaatacatataaattaattatataatcattatttattttgaaagctctctgaaaacattcgcattggcaaacagctaattccaccgctgtttctgaatttgggcaacattttcgcggggacaatgattttattatgggactttcttgatttgccattttatatttatatattcaatttggctgcgattatcaactcaattttcggccttcttatcgaatttttcattataacgtaaacaaatgtaaaatttaaaatattaatttaatttaaaagttttaagatgccacccatttttgaaaagggatttatgccattttttgaaccgtattggcaaaatgtttggatttaatcttttggcctataatcatcgaattgctgatgcaactgtaaaagttggcacaaataatactgctccatctttgtctgctgtcaatggcattgctcaacggaatttgatcagcggaaaagcattgattgataaccaaacaaaaccagaagatcattttgccatgctgaaagaagcatgggagaaggggccgatgaaatgacaaaattaactgaaaaactttttgactcattctaattttggttgagaattaatgctttataaggaaaaaaccgaatcatttgggatttacatgaaatgccataatttgtgttataaattatatgattttgcatattttttctacgcatatgctatgaagaaaggggctcaaaaataccattactgcgttaaaattttggatttggtgaaggtttttagtgcatataaaagcatattttggggttttcgaga

SEQ ID NO: 67651 - DNA, 1105 bp, Heterodera glycines
  Genomic contig location: Contig_ID=SeqID_8310; Location=136..1240; Strand=-
  SCN-specific regions: Sequence locations=1-352,375-391,413-460,483 -613,635-682,716-826,848-925,950-1008,1031-1105
atgaaagccattctcatcttccagagtctctttattatcttggtaaattaaattcaattaaatcaaagtatttaaataaaaacaagaaatgattattattctaaatttaagcgtggttcctgtcgttttgtcatctgtctgttcaaattcttcctttgggacccaattggtgccgaatctatgcaatttttcccggcacttttgaaaatatatttcatcggcatttatgctcgtaattttgtgccccatgttctgatcgttgaacgcattttgtccactttatttgtccgaacatatgaaaagaaacgtggccatctgttcactattctgtggacgccttttgcggtgagagtaatgacaattttattagccaattaaattatatttccagaaatgcctaaaaaacttaattcgagagatgattaattcttattcgataagatataagcgatcaatttttatttacagttgatcatcccaatttatattgccaccacaacgccttcaccacatgatcataagcaaccaataatgaatctgatcacaactgccgtccaattgctggtcggaagcattgagttaggcattttttaccaattaagccgatacaattccaaaatttatcaaaaaatgttccaaaatattggctcgaataatctgtcaattcgttatcaggtaatccatataaattaattatataatcattatttattttgaaagctctctgaaaacattcgcattggcaaacagctaataccgccactgtttctaaatttgggcaacattttcgcggggacaatgattttattatgtggctttcttgatttgccattttatatacatatattcaatttggctgcgattatcaactcaattttcggccttcttatcgaatttttcattataacgtaaacaaatgtaaaacttaaaatattaatttaatttaaaagttttaagatgccatccatttttgaatagggatttgtgccaatttttgaaccgtattggtaaaatgtttggatttaatcatttggcctataatcatcgaattggtgatgcaactgtaacatttggcacaaataatactgctccccttcttgctgct

SEQ ID NO: 67652 - DNA, 605 bp, Heterodera glycines
  Genomic contig location: Contig_ID=SeqID_38972; Location=494..1098; Strand=-
  SCN-specific regions: Sequence locations=1-345,367-503,525-605
taacttaattgtttgccacagttatttctgcgcaacgaaacaatcgccgaacaattcaattcggttaaacgattgaccgatcaaagtcacgtcaaatggttcggaaatgtgcgaataatgacggagagattgtcggaattccaaggcaaaacgaagtcaaaaaatggacaaaaaacagatggaaaaaataaagtaaaaaaagggagggaaaggacaaaaagtgagggaattatttggcagaattcaccggcaaatttcaaaatgtatccgtcgcgggacattggaattctgacggaacaatcgcaaagggacaaaatggcgatggccgaagttggaaattggaattaataataattaacaattaattggaaaatgattagaaacgggcttatgtggacacgcaaatggagagaattgggaaggcattggacgaaataatgccaaaaaacggacaaaacgaatcttttgggggcgacagaataacgcaaacggaatgccataacgaagtggggggaaagagaaggaaatgaacaatttgaacattgttaattgttaaggtgatgcacactttcaacaaaatttgttttaatttctcaaaggtaaaa

SEQ ID NO: 67653 - DNA, 512 bp, Heterodera glycines
  misc_feature (389)..(389): n is a, c, g, or t
  misc_feature (447)..(447): n is a, c, g, or t
  misc_feature (456)..(456): n is a, c, g, or t
  misc_feature (460)..(460): n is a, c, g, or t
  Genomic contig location: Contig_ID=SeqID_38973; Location=459..970; Strand=+
  SCN-specific regions: Sequence locations=1-32,55-152,289-512
atgctttcccctcgtgccatcgcacaaaatcaaacagtagcagcagcagcggcatcaggcgccaatgtcggcacaaatgcggcgccggtgcgacgcttttggccctcgtacattgaccaacatgtggcccagctggactttgacgcctccgtgatgatgatgacgagtgccggcgacgagtgccaaaatgacgatgacgaagaagacgacgatgaggaagacgaggatggtggagacgaagatgatgttgtgcaacaggggggaggacgaccacaacaacggctacaaattgggagcggaatggcacgagggggaggaggggcggaagaaacggcacgggacggcaacattttcgagtaatttcggttttatggcactaccaaatttanaatgaactcattttcaattatccggcggtcgtttcggtcattacagtttctgggattntgatcatgnaaanccgtgtttcatggtccaattccaacccccacgatttgggtagtcttgtgata

SEQ ID NO: 67654 - DNA, 201 bp, Heterodera glycines
  Genomic contig location: Contig_ID=SeqID_38976; Location=819..1019; Strand=+
  SCN-specific regions: Sequence locations=1-52,101-135,163-201
atggccactttcaatgtggcccatctcatcactttaattggcgttgtggtacaaaaatataaattaaaatttattcatattttttctaatatttatttttgttttagtcaattgcttcatccgttgttgctgatgagcaacaaaaccaaaacaaaactcaaaatggaggaggaggtttaaagcatttgttgggatcggatg

SEQ ID NO: 67655 - DNA, 623 bp, Heterodera glycines
  Genomic contig location: Contig_ID=SeqID_38977; Location=330..952; Strand=+
  SCN-specific regions: Sequence locations=1-393,416-433,457-458,480 -507,529-559,581-586,608-623
atgatccgtaattgggcaaatttaacaatttcatgggaagacaaattggacagtttgctgaaaggccaaatatttgaagaaaaggtaattaatattactactcagtgttgtcatggtaaattttcattttttcccccaaaaaactgaaaaaattacagtattccacgctagtactatttcaattacggtatttatttcactaatgatttgctaattatatacattcctccctttacagtatgcccattacattcgcatcatctgtaaatctgcttcactggcagatttttatgatttttgtgggtatgccgagacgcgaattcgtctccaattattgattgacattgaacgctttgatcacatccgattagcccatgggaaacaaattattgcaaatgaacaatccactgaagaaattgagaacgaaaacggcacaaaaaatgagcagaaaaggcaagtgacaattaagaaaatattcgttatatttgcgatggttagttaattggcaattttattttaatttgattatttcttgtcaaaatttatttgactttaattaacaaatattcaattttaagtttattacatttacaatagcagggatctcatatgagagactttag

SEQ ID NO: 67656 - DNA, 557 bp, Heterodera glycines
  Genomic contig location: Contig_ID=SeqID_38978; Location=541..1097; Strand=-
  SCN-specific regions: Sequence locations=1-284,309-383,406-557
gcatatcttccgtcgttgccaaacgccttggaaatccgttgcgctatggaaatccgtcccgccgttgttttttgtcccttaaaactgttgcacttgccaaactgacgcaggtgcgaatattgtgctcttttctaattttaagaatacttcagaccattcacaaagtcaatgttaaagaaattcggaagctttcggtgaaggaagtcgaatcattaagttttataccaccgaaaatgctttgtcatatccgcgaggaatttttatgtaagaaaatgaacataaagataattttattttttttaattttagcaattccgcaaaaccaaaaaggaagggttttctacgaactttcagcagagaaaaggagtcgcattttggccgaattgctttgtcttttgctgcttttcgacggttacttcaaatattttactgccacaaatcatcccctccccattatcgttagatcccgaattcactttgccaatttctccgattgtacaggatttttatatgtcggaaaatgtgttgaaaaatctgctcgttgcgatgggatgcgt

SEQ ID NO: 67657 - DNA, 1993 bp, Heterodera glycines
  Genomic contig location: Contig_ID=SeqID_8311; Location=1282..3274; Strand=+
  SCN-specific regions: Sequence locations=1-164,186-1219,1241 -1358,1380-1488,1521-1993
atggctgtacgaaaatgcccaacttttgcacaccgaagggcccgagagcagcaagtgcgaggaatggcatcgccgtttcaaagagttcagcagcacggccaaccaactgacggagctgtacaaaaatgtcattcgcttgccgaacaaagtgtggtttctgccttcccctcccccttctctcttctgtcctttcatttctgttcttcacttttagagtcttttgcaagaaatttttccatatttatgggaggcgcaaggacttttgtctgttctttgcgcgttgctcaaatggatgcgcaagggaaaccttctcattgcaccgacaggtcactcaatcaatcgtgggtttaatttgcattttcatatttcagaatcggccacttggggactcgaagacgtcgactacgactcggagccgtgggccctcggcggtggtcttttgcccgacatgcaaaggctcgtgatctcttcggccaaagttggcgaaattttcacggttaaatacgcgattccgctgtccctcacttgctacactatccaacccgtggatttgctcagtttggacaaggtttcctcatccccccctctttgaattttccctccgttcagtcgctgctcttcgatctgttcgccctgtccgatgagcaacttcttgccaactccgccatttctctgcccggcaattcgtcgcttcgtcccgaagagtttttcttcgacctcaacttcgccccgttccttaaatacggtgccccgtcccatcacttcgctgccgaatgtgcggacggaggagaggccgacgacggagaggcgaattcaaaaggcctttgctcattggcacttggcattctgaacgcgtcaggcctcgtggaaagcttcaattccgaatgtattgtcaaattccggcaaaagtattacccgtctctctcaagtgaacaacaaatggaggacgactcttcccagtcgcccggagatgtaccaatggaattaatgccattctattttaatctttccattcactcagagcacgtcgcttgactcggagattgcccataggttatccgttccgttgcgtctgaccagcgactttctcgcctccttccccagcctcgtcgagattcgctggctgatgggctctaatgaggcggtctccgtccgtcgtctcctccactgcgtttccgcctctttggctttgaacggtcagacaatgcccatttaaatattcgtttgtttgtttcctttccactttaaaggttccaacgggtttttcactatcgtcagctccgattgtgaggagcgtgtcgaattgctcacccgactcggcctccaaccactagtccaccgcgacatcgacgggttaatggatggatttgtggtgatgggccatgctctttgattcgccatgaaggaaaagaagcagcccacgttctttctctcccccccccccgtttttttgacactgtttcacaaatctttaatgttaaattgtacctttcctaattatgtttccatataatcagtcaaaactaggctttctctgtttgttattgtccaaaattccgcatggccatcggtctcccccaagatcattgttttgaaaacttgaaatggaatgccaaaaacacacatggggttggactttcaaacaaagagcgtagccaggcccttgagcgactaccatgtttttacttttgtgtcaaattttaaggaaatttgggcccgaaggtgctgataggcgtcgcttgggaaatttgagatttttgatgaaatttcttaaaagtggtacttttttcgagtttccaaattttcgttaaaacacccttttttcgaactccccatgatattaaaaatgttcactgtaccgaaatgaatgcctcgatttccattcgcttctctcatttccaattccctcgtccctcccattcgctttgcccttgtctcacctatcacttaatcatcaaattaatacctaattaccaatggtcgttgtcaacga

SEQ ID NO: 67658 - DNA, 1612 bp, Heterodera glycines
  Genomic contig location: Contig_ID=SeqID_8311; Location=4176..5787; Strand=-
  SCN-specific regions: Sequence locations=222-244,266-278,340-418,441 -465,487-692,724-966,988-1137,1160-1452,1474-1612
  Gene Ontology: Mol. function=actin binding; Cellular component=actin cytoskeleton; Biological process=hearing
gacggtgtccttcggctcggccatagaagaccaacaattggccgtggtttggcttaggaattggatcgtcagtgtctcattgagcggcttcatcaattacatttgccccgagacactgaaagtctgccgagtgctcagaggacataacaaatccatcaccgcgttgacgctgtccgaagatcgacgaatggcattcactgctgactttgagggacatataagtgaggaaacttcttaatttaggaatttaatatttattttctaacctgaaaactcagcccgttggaatgtctcggatggctcttctgaacgagtgactccccaagtgcacaagtcgcaagtgtccgggctgagtttgaccagcggcggtttgctcatttccatcggatgggacgattcggtcgctttcattgaaaatgccctttccccttccattggtcggttttggtttttatagcttttctttacatatattcttttagaaaatgttcagtcgctttcccaccgtttgtcctcccaaccacgcggtgtggcgagcattgggcaaaacggggaaagagttgcggtcgcatgccatcgctccattttcattttcaccgacaaaaaacaatcaagcgttatcgatataaagtacgaaggtacttctgttgccattcaccccaatggaattcttttggcagttggaggaaatgtaaaaatttcaaaaaaaattatttttattttgtcctttaggacagtcgcgtgcatttgtacgatttgcctaccaacggcggcgcatttgttgagaaaaaagtattacaacatgcaggtgccataacctcggtgaacttcagcccaaatgggaagtatttggtggccacggacattgccagaaaagtggacactttggcactttcgggtcattatctgccttttgccttcaggtggtgccttacagtgtggacgacggtttcaaagtggcatctgaaaaagaatggtcttttcatacagcccggatcaactgctgcgcctggtccagcaacaggttgattatatgttaatggcgtggtactgacttatgaaaaaactttactaaatttttggacaaatctattaacaaatttcatcaaaaattactaaaatttttcataccggcgttcccggaaaatttttaaaaaagagcgccgcaacaaaacgggttttaagcaaaaaaaaaatcgtccgtttacatggctgagttttcgcaaaattgaccgctgtcctccctttgcaaaaattacgaagatctttggggtcgctgattatgaataagaacataaattccaactaattacaaatcccgaatccgttttaaggaatttaaaaatcagttaaataataatttttcatgggcaggggtaaacaatgcattcaaataaagtggccactctttgtcttcagtcggtacatcgccacgggttctctcgacaccaatgtgatggtttgggacttgcaacaaagcggtgaacatccgctagtcatccgcggtgcccattcgatgagtgccatcaacggagttgcttggctttccgacaatcgactgcttactgttggccaagactcgaatgtgaagcagtggacactgaaactgtga

SEQ ID NO: 67659 - DNA, 659 bp, Heterodera glycines
  Genomic contig location: Contig_ID=SeqID_38982; Location=814..1472; Strand=+
  SCN-specific regions: Sequence locations=1-153,340-540,567-588,610 -610,637-659
  Gene Ontology: Mol. function=transcription factor activity; Cellular component=nucleus; Biological process=transcription from Pol II promoter
atgttggacatttctcgagcccggcaaatgtaattaattactattttttataagttccataagatagaatttatatttagaacaattgtgttgaacaatacgcgccaaggtttcaagattgttgacactgggaacgcagcaacaccgccaccacaacaacaacaacaacatcatcaacaacgacaaacacaaacaccacaacaacaacatcatcaacaacgacaaacacaaacaccaccacaacaacaacatcaacaacgacaaacacaaacaccaccaccacaacaacaacgacaacaccatcaacaaacacaacaacaacaacaacagcaacaacaagaacgacaacaaacacaatctccacaagctcaacaacaacaacagattttgcgtccagtgccattgaatatgtttcaatttcaacctgtaaacgacgatctgttgcccggtacaagtggtacaacaacacacattggtatatatgtggggggagggacctaggggaattcaatttctcgtttcattttaagttcccatggcatttaaaaataattttaaatatttttctaggaaaaatggtctgtttttgatgttcaaattttgcttaaaatcctcaaaaaattttttgggggaacatttaaaatacaccagacccccca

SEQ ID NO: 67660 - DNA, 677 bp, Heterodera glycines
  Genomic contig location: Contig_ID=SeqID_38984; Location=269..945; Strand=+
  SCN-specific regions: Sequence locations=1-264,353-510,547-568,591-677
atgcttaaggatattatggaaccgctagtcaaatttcataaaggtaattactatttgaaaatgctgatcaattaaatttcttaattaatttgcaaaattaacggaattatttttagttgggattcatttggatttcaaattaaagaatttaattgttgttgaaaaaatgatgaaatcaaaacacaagaaaaagaccttatttggaacaaaggaatgtttggaaaaagtcaaggtcaaaacttttaagttgatcgattttgatggtaattttttttaattctatcattttaaataacagtttttagtatttaaaattcataaatataaattaaattatgaaatatatttttatctactcaaattttaagggtccgttttatatttgaacagagaaaaaaagggaaaaattgcttgggatttaatgggctacacagaagccttcagtgcacccgaactgcttcaggttggaagaatttaaaaaatatttacaatttcgataggttttccgtgaaatttttgaaaagttgtaaatgaaaatacctaattcggtaatattagtattttttgcatttcattattaaatacagattgaatttctgctaattatatcgttaataaaataatatttcagaatttatctctattcactgagggcgatattgaggttatttgaaata

SEQ ID NO: 67661 - DNA, 643 bp, Heterodera glycines
  Genomic contig location: Contig_ID=SeqID_38988; Location=1..643; Strand=-
  SCN-specific regions: Sequence locations=1-79,101-481,503-617,639-643
aaaaattttattcatctccctttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatg

SEQ ID NO: 67662 - DNA, 192 bp, Heterodera glycines
  Genomic contig location: Contig_ID=SeqID_38988; Location=1095..1286; Strand=-
  SCN-specific regions: Sequence locations=1-108,130-154,183-192
ttaaaaattttttgatttttattcatctccctttttgatagtgaaagcatctgagtgcctaaaataacttgcaaataaaatttggtgcgtttcagagcagtttctgaaaaaatatttatgaattaattttgctaaaaaaataaaatagtgaagctttaaaaattaataaaaaattttaaattcagaattact

SEQ ID NO: 67663 - DNA, 361 bp, Heterodera glycines
  Genomic contig location: Contig_ID=SeqID_8313; Location=25..385; Strand=-
  SCN-specific regions: Sequence locations=1-339
atgaataatgacaaatatggaatttttttggtaaattttcaatttaatattcgtcagccatctgattgtacattattggtctcggccaagctcggcttatacttcaaaaattgaaaatttatgtccttctcatttgggatcagactcaaaaatacagtaccctttgaccttctttgtaaaaaccttacaattttttatttcgcttttcagctttacatgcgttacatggatgaacatccttgttggacgttcattgcttttgcgctggcattttgtataattgggacgattggaatagcatccaatggggcagtgatttatgtgacaattaaaactaagtaaaaattataaaaaaaataaa

SEQ ID NO: 67664 - DNA, 759 bp, Heterodera glycines
  Genomic contig location: Contig_ID=SeqID_8313; Location=2671..3429; Strand=+
  SCN-specific regions: Sequence locations=1-23,45-91,130-462,484-759
atgccaataaatccgacaaatgtaatccatttaatggaagagtattatcatggtaatgctccaaatccatcgccaatcactgtcgaggagaagcaattggcagaagattttttgaaaactttgattttttgtgcgaataaaagcggcgaaattgagattagcgaagagctggtgttggatgattttgccaattttcatcaaaaggaagatcaggcagtcctatagaatcttcatcatcaagctatgccccctctcctaaaaaaattttcaatactgatttcgcctaattttgtggtttgagaaaattttacgatttacacccccttaaatttgaaacgaaacttaattactttttacagtcgaaaagtcccctcctaaatttataatatttctatcgaaaagtcctttgctgtcgaaaagtccggcgcccaaatgaattgctgcataacattttttagcatcaaaatgaaaaaacaatggttcttttcacaatataaagtaatgcatggaaaatgaattcggaaaaacagtaaattctaccgtatcttcacaaatgagtcctttcaacaaaagtacagtttggtgaacggattgtcattgtccagcggagtgttgcagaagggacaaattttgtgaaagccttgtccgccatttgggattagtgtctttgaccaatgtctgtatgtaaagatattgattgttacagtagtaatcgatgtttatatagaataagtccacaaatatgatcatataacatga

SEQ ID NO: 67665 - DNA, 1701 bp, Heterodera glycines
  Genomic contig location: Contig_ID=SeqID_8314; Location=210..1910; Strand=-
  SCN-specific regions: Sequence locations=1-311,349-461,494-772,794 -958,998-1023,1064-1320,1350-1374,1399-1481,1510-1546,1571-1701
atgaactttgatcagcgtgccgagccaaatggcatccaacaaaacccatctgcaatgatcggaagaactgcacgggccaataaccaatggccaaattatccgatgccatggccaattagtgccaatgatgaagaggacaccaccacacactcaataacattctcattcagcgacatacaacaagtgattgctcaatacagtcaggacccaaaccgggatatgtttcaggtcgaagagatttcatcaaaaaataattagggacagagagcagctctaattagttttggcaagagatttacaatccgaaattctatttaaaaatttcaaaaattattaatgaatttattagcttagcaaaccataaaatttttaatagctgcaaaataccttttttggcctccagaaatcgcaaaatattttccaaatccgtgttctctggccttatatctgttaaatagctgttataatttgttttaaaatttaattaaataaagcttgggagagaaaatagcgaaaaaattgattttatctgaaaataattcagaaacagagatcacccaaatcacggtgagaatggatttgtatcccacaatccatttgaaaaattagccatcattcgaaaactgttgatgatcttttatgagcttataaaagcaaaattaataaaaagccacaaaactctcaactaaaacaattattttgcccccaaaaccaccaaaatgttttccaaatccgtgatctctgaccttgtatctgttaaaagatgttataattttcttaaaacttaattaaataaagattgggagagaaaatagcgaaaagattgacttcgtcattgatcaccttacgacaatttctcggtttgcttgtcgcattgtggccgagcgtaatgcccccaacaatgtgtacatttacgcggctggctttgacgattcaaatgatgtacataaatggcttcattatttaaattttaaaaaatttaaataaaattattattcctctccattcgttcagacagaagtcttaattaaaaaaaaagaaaattaatttttaatttttaaaagacatttgtcctgcacaaataacttttctgatgtggacgtggatttttctagtttttttttatgaaaaatttttggaagtgaagaaataaaatttgaaaattattttgtcctgaaaactattctgattgtgacacaaattttttagagatattttttatgcgtaaataataggcaaaattgacaatacacactaaaatgctgtaaatttgatgaaatggacaacctataaaatttatttagagtttcaaaacaaaacaattaaaacataatttatttatttttattcattcagttatttttgggcccagacgcaaataaaatagaaaagtcaaatggtcaatttgatggtttggttactaatggtgtgctaattctttcacccaatgataatgacgatgaggtaaaagagaaacagagaaaatttatttaaaattttttttattttcagggtgcctccgtttatttatcagcttcctcttcaaacaatgatgatgatgaaaatgaatcagacagcgaaatttctccaaattgttggaaagaaggtaattgtcatcattttgaaaaaaataattcaaaaatttgagaaatttctcatttttttcagaattgcttaaataatgccaaatttaaaattaaa

SEQ ID NO: 67666 - DNA, 1352 bp, Heterodera glycines
  Genomic contig location: Contig_ID=SeqID_8315; Location=116..1467; Strand=-
  SCN-specific regions: Sequence locations=1-279,319-841,874-1093,1115 -1172,1194-1352
atgtaatactaaaattcatatgtaagaaccttgttcagaattttttcaaagaagtattaacattgctgtgtacaaaattggtgtaaagaatatttatttttttagcttggatggccctgtgttttggagtcgtcgcgttctctatgttttttgctgctcatgccattttgatcgacatgaggtagggcgcggagttaccaattatggaattattgccccccccctcaaaaaatattccaacgctttttttcttataaaatttgtgtttttagctgaaacttttttattattttttatatatacaaattgttttaaaaacaataactttgcagaaattttttgtggagataatttgacagaaaaatgtcaggattaacaaataaatgaaaacagccatattctgtataacatttatttgttagcgcgacttgcttcgactgatggagcagtggaagcatcgaattgagagagtctgtctggtggaccgtccattggactacccatttttgcccgattcgctgtttggctttttggctaaccatttaccccagttagaggtgaacatttttttttataatgaatgctaccgcagttggagtgaaatttatttttattttttggttacaaatcaaaattaaatctactcaattttttgcaactttttggcattttttggttttagcctattttagaatcaaaaataagatgttgaagaatattaacgcttcaagtatttttgtcgaaatttatgaaaaaaaaactaaattttaaaagaggatataaaaatagttgttttttcaatttatgtagaatttattgagctatttctaatcctcttaattgacattttaaatttttaaaagtttgtttatttgcgcgagctggaccttgaaaagatcaaccgagtcactgtggaacgattgtcgcagcacaagcgtttaaagaaaatgattgtgcacggctgtcgcaattatgaggtgctgatgatgtttttttttatcaaaatgaaatttaatcgaagattttgctgtaggcactaataggttcagtgtttcgaaattaatgaaacgaattctttaatttactgaagttttcaaaaattttccacaaaaaatgggcataaagccattcgtttaaatagacaaagttaaggggatagagaggcaaggggcggggacaacaagagcagagaaaaaattggttaaggaattgatcaaattatgctttaccactaattagtcatgtcattattatactttcattatttaccacaggtgttgcaagacttccgaaatttgccccaacttcttgtcgtcaagggggacattcagggcctgaaggtatggcgaact

SEQ ID NO: 67667 - DNA, 322 bp, Heterodera glycines
  Genomic contig location: Contig_ID=SeqID_38996; Location=246..567; Strand=+
  SCN-specific regions: Sequence locations=1-79,113-246,279-322
atttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaataatgctggtgtggtaagtgtgaagaactgtgttcctccaggcaaaaa

SEQ ID NO: 67668 - DNA, 1326 bp, Heterodera glycines
  misc_feature (1220)..(1220): n is a, c, g, or t
  misc_feature (1252)..(1252): n is a, c, g, or t
  misc_feature (1271)..(1271): n is a, c, g, or t
  misc_feature (1285)..(1285): n is a, c, g, or t
  misc_feature (1315)..(1315): n is a, c, g, or t
  misc_feature (1326)..(1326): n is a, c, g, or t
  Genomic contig location: Contig_ID=SeqID_38997; Location=8..1333; Strand=-
  SCN-specific regions: Sequence locations=1-135,157-232,254-827,849 -1042,1064-1326
atgcctgatttagtgcacagtggtgccgaagtaatatcaattcagtcaacttccgaagactgtgaaagacaatcaaatggttctgtatgtagagtcagtggaacaaccgaattaacaatttcattagcattaaaagatgataaaggaaaaataatgggttcattagaattaattttacaatttttacgattacactgtaaccaacaaactttaaaatggttacggtcatataaaataaatgttatttcaaaaagacgctgtccaacaatgggctcatgcacaaaaagtaaatgtaaaaacattaaaatggatgaaaaaattccagaaatggaagattatgaaaattttccaggaaacaatttctgtaaaaaaggagacgcaatttggggtcataaatgcgcactcccatcatcggaatgtttcttttatagaacttacgcagaaccaacatcaaacacaatttgggaattaattagatgtaccggatgggattatgaattaaaaatgagtttaacattaacaatcggaaacgaaacaaaatctaaagatttgaccatgtttcctggccttacagttaaatggagtaaattttcatttacaccggaaggattaacacctccaatttcaccaattttaaatgattatttcatagtgtcaaaaaatgatataatttatggtggaaaagaatttctgacagatttgacatgtgatgacccaaatgaggcaaaaaatttttcatgcaaattaaataaagaagtgtgcagagaatgttggattaatagggaaaaaggagaagttgaatgcgcatgcagtgaaaaaacaatagaaaaaatgacaccaaaattacctttcacaacagcaaaattaaatattcgcaaagaaggtaaaaaaatattaagcgagactgaatattctccagttaaattagcaataagagttaatggtataaaaattgtaacagtcacagatggaacaaaatgcaacataaaaccaactaattttagcggctgttacaattgcggcacgggtggaaccctaaattatgtgtgccaaacagaatttggtcaagcagaagcagaaataaaatgccaaaatgggccaatatttttagcaaaatgttcagaaaatggacatgaacaaaaggatattttaccctttgaaatggccgacataaacatgaattgcattgtcgaatgcccagggggccaaacaaactttanacttaaaggcacacttcgttacgtaccagtanatgaaaagaaatttcgaanaataaacacagaanaaataatgaagacgaatcccgatggaattntgaaacattan

SEQ ID NO: 67669 - DNA, 422 bp, Heterodera glycines
  Genomic contig location: Contig_ID=SeqID_38999; Location=606..1027; Strand=+
  SCN-specific regions: Sequence locations=1-55,79-195,217-237,271 -351,373-377,401-422
atgaaaaaattagaaaaatcgtatatttatagtctgatgggggtgataaagtaattttcaatttttctgttttttgggtaatttggtaaacataaattaagggagaaaataatcaattgaactacataccataaacttaatctaataataatatgtaatttgaccagtacaaaaaaataatttaattgttttaaaatgcaaatttactattagcaaatttggcataaaaacggtttgaaaaaatattttatttgtttaaaaatataaattcaatttcagtttttataggaatttacatatttaccattggatttaattttaattgccttcggttgactcattaaacaaatgaaaaaattaaaatttaatttacctatgaaatttgttctttgataatcgtcattagttgaatcattaagcaa

SEQ ID NO: 67670 - DNA, 132 bp, Heterodera glycines
  misc_feature (96)..(96): n is a, c, g, or t
  Genomic contig location: Contig_ID=SeqID_8316; Location=3088..3219; Strand=+
  SCN-specific regions: Sequence locations=1-132
atgattctgtgggtggcactgcgcaagaacagttacgaaattatgttgaatgacacggcgttggacaacagacaattttggccaaatgattggtgngaggggtcgggacgagagaatgtcacacatatcgtg

SEQ ID NO: 67671 - DNA, 2409 bp, Heterodera glycines
  Genomic contig location: Contig_ID=SeqID_8317; Location=215..2623; Strand=+
  SCN-specific regions: Sequence locations=1-63,85-239,268-276,299 -308,330-480,503-1375,1404-1425,1449-1669,1691-1783,1806-1846,1868 -2235,2257-2409
atgctattacttgaggagccaataacaaaccaaattgaggttaaaagctataattagtggcaagaaaaggaaaacgataattcagataaaagaacctgtaaagcttacttacaccaaattctatcggaaaatatgcaacggcgtacagtttacattccgcctccaactgcagaatgaaaccgaccagttcaaaatcagtttgttacacgacagaccggaacaccacgacagaagtgatcaaaatttaaattaattaattattataatccattaagcaaataaataataatgtaataattcagttggctcaacagtttttgaaattgaagtcgcactaccaagcaacttcactttcgtcgttcattatgtgaggaaatgggttttttacttaaattcttaccaatataaaattgattttcaatataagagaattggaaaaatgttatgaggctttggcctgaagcttttccttacaatttcaaaaaatataaaacaatttttagtacggtattagaacatctaacaatggaagcctaaccttaaatgtcgacgatcagagagaatatgagtttaaactcattatcagtgacacatataaattcattgtgaatagaactttgttttacgaacagaacacaagcattacgccggcttgggcaataaattttgtccgggtaattaacgtactaattgggcaattaacacttttattgaaaaggtggaaggcaatgtgaatctactcgaagagccatcagtgaacatttcaaaggtaagttttaattttatgaaaaagtgtcaatttcttaaatgattatcgactagccgttttgacaactttttctttgagtttagtgcagaaaatcggaaaaaaatgccagaacaatggaactctcttcagtgctaaactacggagatgttgtgacaatccaaggaaagtttaataaactcaagccagaactgaacatttatttgcttcacgaggcagcggaagcggacacaaaaagtgagtgacgagaatttcgtaataaaatttatcagtgaaatggtcgcaagtgtcagaaccgaaaagcctggaaattattctgagtaaatttaaattttgctgaaaaactcacataaccagcattcgtcagtggaagggggcaaattggcggcatgtccgtgccgagaaaattaagacgatagaattttatttgagttgataaaagctaaaaatttaaccaattcgagaaatatggttttattattacataagtacaaatcttttaagcggctacggatgcaaccgttggtgacgtgctgttgcatttgcattttgattttaatactacaaaaatcaaatgcgcccataaaatatattcggtgaattttttcctaataaaataaaattaaattaaattttacattcaaggaaaaaaaatatgttgatggaaagaacacattcttaactgacatattattgtacgaatctcaaccattcatattgcaaattctgatggctgatgatggcttctacggaagcatttcgagatcggattataccaaattttgtgattattacgtcgcccaaatcaatcatgagaaagcaataatgccctttccgccttttgccattgaccatattcaagtaatattaaaggcgaaattttaaaaattaggctggaggcttttttgtattttctgagactttttattaagttggaaaaatattcaaaattgcataaaaataccaaaaaatacaacaaaaaaaaaatcccggggcttattgataatgttagattaaaaacttttttatattattcaaaatttgaaaatcaattccacgtccaggtccgagcttttttcaaaatgtcaaactcaaataaatacccatcaatcccttcccctcccactttcagatcgatggcgatttgaaaccggtaaaaggaatcaaactgattcaagttattctgcctaataactcaacacattttttggatgacaaaaataaaacgattaattgtacgcccctcccatacaaacaaatcaatcggaccgatgggcttttgaaagtgaatgaaagcataattgtgatgatggagttgaggggatttaaccccggggaaaagcaagaagtgggcgtgttcttctacaaccaggcaattggctaccacgacctcagtgagtggtgacaatttcattaataaatgccattaaaaaggggcggggtggggcttaaagcaagcaacagattaaatttgaaaatattttttaattcagtgcgaatccgaagatggcatttcaatggaactgtattctttgcttaattatggagaattagtgaaaattgaaggacgagtggatcgtaatgccacagtaatcaaaatttatttgtttcatgaagtggcgcaattcaccgaaatgagttaa

SEQ ID NO: 67672 - DNA, 337 bp, Heterodera glycines
  Genomic contig location: Contig_ID=SeqID_39002; Location=1..337; Strand=-
  SCN-specific regions: Sequence locations=1-193,215-294,316-337
ggcggtggcgtctattcggcgcgagctgttgccgctggtgtcgatcattacgccgaacctgccggaagcggcggcgctgctggcgtgcgcgccggcggaagatgaagcgcagatgcgcgagcaggggcgggcgctgttggcgatgggctgccgggcagtgctgatgaagggcggccatctgagcgaaagtgagagcccggactggctgtttaccgcagaaggcgagcagcgctttaccgcgccgcgcgtcgccacccgccacacccacggcaccggttgcacgctctcggccgcgctggcggcgctgcgcccgcgccatgccgactgggcggctacg

SEQ ID NO: 67673 - DNA, 1325 bp, Heterodera glycines
  misc_feature (25)..(25): n is a, c, g, or t
  misc_feature (1275)..(1275): n is a, c, g, or t
  Genomic contig location: Contig_ID=SeqID_39005; Location=1..1325; Strand=-
  SCN-specific regions: Sequence locations=1-122,153-165,187-236,272 -275,301-336,358-368,415-428,462-720,753-758,842-842,872-923,1046 -1048,1076-1083,1159-1230,1298-1325
aatctccccagagcggagcgcattntgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggngctgcacgcgcgctacactggcaaaatcagcgtgcttgtcttccccgaaa

SEQ ID NO: 67674 - DNA, 1189 bp, Heterodera glycines
  misc_feature (51)..(51): n is a, c, g, or t
  Genomic contig location: Contig_ID=SeqID_39005; Location=1..1189; Strand=+
  SCN-specific regions: Sequence locations=1-28,96-167,243-250,278 -280,403-454,484-484,568-573,606-864,898-911,958-968,990-1025,1051 -1054,1090-1139,1161-1189
tttcggggaagacaagcacgctgattttgccagtgtagcgcgcgtgcagcnccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagt

SEQ ID NO: 67675 - DNA, 217 bp, Heterodera glycines
  Genomic contig location: Contig_ID=SeqID_39008; Location=734..950; Strand=+
  SCN-specific regions: Sequence locations=1-217
atggcctatcacaacaacagccagcagcatttgaacccgcctcgcctctgcttccaaaaccgttccctaagtgcccgtgaaagcggtgccgcggaagatgaaggccaccgattcgatgctaccggagtcgacgcattttggcaaagaaccgcaacgccaacaacggcgacgcgtggacggcgccaactgtccgccagcactgatcagttgcttaccg

SEQ ID NO: 67676 - DNA, 219 bp, Heterodera glycines
  Genomic contig location: Contig_ID=SeqID_39011; Location=219..437; Strand=-
  SCN-specific regions: Sequence locations=1-151,173-219
ataaattgtgaaaaacgaaatgttgcgttacaaagtgatccgatcgctttatccggttctgtgtttgatcgcttccctttattatgcattgatcaatcgcgtgttcacgctgatcagtcacttttggccaaagagcaaagtgacgtggacagagggcgaggcggaggagccgcttctgttcatgtcggccaaaaaaatggcggagaaaattcggcgtaa

SEQ ID NO: 67677 - DNA, 1268 bp, Heterodera glycines
  Genomic contig location: Contig_ID=SeqID_8319; Location=1714..2981; Strand=+
  SCN-specific regions: Sequence locations=1-135,165-286,310-948,970 -1268
  Gene Ontology: Mol. function=glutamine-tRNA ligase activity; Cellular component=cytoplasm; Biological process=protein complex assembly
atggctaaacagacgcgcgacgagggaaagttcgttgagttggatggtgccgagatgggaaaggtggtggtgcgttttccacccgaagcaagcgggtgagtgaatgttgttgtgatcactgatcataaacaaaacaaggggagagaaatgaaagaaattttaacacttccaaccaaaattcattgttttttacgcggcgacaagcacgtaatcgagcggaaagaggggagggggacttcgtaatcaaaggcggcagaaattaatgagaaaaaaaatcgccagcgatggagggggaggggaagaggagaactattgagataaagaaccctagggtttgacatttttcggaaacggacagaactgacggacgagttactaatttatttcagttatttgcacattggacatgccaaggccgcactgctcaatcagttctaccggcaccaattcgaaggtcggctgattctgcgcttcgatgacacaaacccggccaaagaggacgcacacttcgagaaggttttgtttcacatttctcagattttggggggtaccatttcaaaagcattaaaaatctttcgctttttcatcacaatgcttaaacccaatgcttactaattcaggtgatcgaagaagacctgcgcctgttgcaagtcgagtgggacaaaatgagtcggacttcggaccattttgacgcccttttggacttttgtcagcaattgctggtcgctgggaaggcctacgtcgacgacaccgaagctgagcaaatgcggaaggaacgcgaggagcgggtggagtcgcggaacagaggaaatggtaactttttgggtttggcaccgtacgaaattttcaagaaaaaaatcttagaaaattctatggaaacaaaattttttgaaatttttgtttcttcgaattttttcagaaaagtttttctaacatttttttcttgaaaaatttctgtttgaaaatttttagaccttattttgtgccgaaaaattttcggtttttcctttatgatggtatcccttccaagactcttttacccaaatttttccaaaaaccaaaacaaacttcctggaacagtccctgattcagcggtcgagcagaacttggcattgtggaaggaaatgcaggagggcagcgagcgtggacagcagtgttgcgtgaggatcaaaatggacatgaagcacaacaacggggcgttgcgcgacccgacaatttaccggtgcaaaggcgaaagtcacgtgcggcacggggacaaatacaagtga

SEQ ID NO: 67678 - DNA, 155 bp, Heterodera glycines
  Genomic contig location: Contig_ID=SeqID_8319; Location=363..517; Strand=+
  SCN-specific regions: Sequence locations=1-155
atgattgcacgtaattgccgaaaaaattcgagaccaatttccgaatgttgaccgactaattgcagaacgaaagccgtctttgtcaaagcgccttaccgagtcaaaaaatttggaaatgtatctcatatgcaatttcaaccaataaatttgaagaa

SEQ ID NO: 67679 - DNA, 1894 bp, Heterodera glycines
  Genomic contig location: Contig_ID=SeqID_8320; Location=496..2389; Strand=+
  SCN-specific regions: Sequence locations=1-123,145-191,228-1248,1273 -1480,1504-1894
  Gene Ontology: Mol. function=glutamine-tRNA ligase activity; Cellular component=mitochondrion; Biological process=protein complex assembly
atggacatgaagcacaacaacggggcgttgcgcgacccgacaatttaccggtgcaaaagcgaaagtcacgtgcggcacggggacaagtacaagtgagtgggaatgggaaaaattaatttttagtttctaaaaaacccccaaaatagttgctaaaaagttccgaatttaggggtgtaaaatcgaaaattttcttcaaaagggtaacaaaattattccaaatcagtaaaaaacatgtttttcgtgcatttcattcaggctacggggagctcaggaaaaaaatagtgaaaaaacctataaatcgtatccctttcattaccttttgacagagtgtacccaacctacgacttcgcctgtcccatcgtcgacagtttggaaggagtgacccacgcgctgaggaccaccgagtacatggacagggacgagcagtacaacaccatttgcgactcactcggactgcgaaagccgtgcatttgggcattcgcgcggctgaacatgacacacactgtgatgagcaaacggaaggtgggcaaaagtatggcaccgagcattagcaatgtctgtttcgttcagttgacctggctggtcgagcagggcttcgtctccggctgggacgacccgcgaatgcccaccgtccgtggcataattcgccgggggctgaccgtcgaggggctcaagcagttcatcctggcacaaggaggaagtcgctctgtcgtcacgatggaatgggacaaagtctgggccttcaacagaaaagtcatcgacccggtggcgccccgctacaccgctttggaaaacgcttctgccacgctcgtgccggtgacggttcgccaatttgtggcggaggagtgcgggcaggtgccactccacccaaaggtactcacttggccagtctcgcccatgctgaccggacaattgcacgtgtagaagcccaacggagagtccaaggaaatttggttcggcgccgatttgctggtggagagagcggacgccgaatgcttcaaagtcggcgacattgtcacctttgtgaactggggcaacatgaaagtggcccaagtgcggagggaagagggcgcggaggggggacgaataacggcggtggaggtcgacttggacttggacaacaaagtgagagacggaccaaaatgccactcatgtcagaccacagggcgggaccataagctaaaatcagtcacggcattggtcggacacatttaacttagtcaatgggggagggagggcacgaatttcaagttcattcccctaatattgagtcattgtcttccaggactacaagaagacgttgaaagtcacttggctggcgaaacgtgccgaaaacttcgcggtgaaaacggtccgttttgatcatttgatcagcactccgatcattggcaaggaggaggactggaaggagttcgtcaatcgcgacagtgaggtgagttggattgtgcccattttgttttgttttacaatttttttaaatttcttttagcattttggcactttgttggccgagccggcacttcaaaaagtgaactgtggagacattttgcaaattcagcgcaaaagcttttacatttgcgacgcgaagacagccaactcaatgacactcatcgaaattccggacggcaaagagacaaataatgcagatgtggacgacggcgaaatgccaacattttgtgccaggcttttaccctcctgtgacgacagtgaaatggcaacattttgtgccaggcttttgccctccggtgacgacagtgaaatggcaacattttgtgccaggcttttgccctccggtgacgacagtgaaatggcaacattttgtgccaggcttttgccctccggtgacgacagtgaaatggcaacattttgtgccaggcttttgccctcctggtga

SEQ ID NO: 67680 - DNA, 159 bp, Heterodera glycines
  Genomic contig location: Contig_ID=SeqID_8321; Location=1076..1234; Strand=+
  SCN-specific regions: Sequence locations=1-4,26-45,114-159
atggcaaaggaacagcggaagagagagaaggcaaatattggagacagaagggaaacgagaggaaggacaacagaaggagaagaagcggataaggacggaaaaggaggaggagacaatgagggcggggaaagcatcggcaaaagatggcggaaatggcaa

SEQ ID NO: 67681 - DNA, 155 bp, Heterodera glycines
  misc_feature (90)..(90): n is a, c, g, or t
  misc_feature (118)..(118): n is a, c, g, or t
  Genomic contig location: Contig_ID=SeqID_8321; Location=1..155; Strand=-
  SCN-specific regions: Sequence locations=1-155
tacagtttctttctttttaatcaacaccagaaatcaccaaataaaaacaacaaaacaattgcgaatacttccacatgaatacactgtctncattaacaatctttgccttcttcgtctnctttccttcctttttcgtctctttttccctctggccc

SEQ ID NO: 67682 - DNA, 101 bp, Heterodera glycines; identical to SEQ ID NO: 56211
  Genomic contig location: Contig_ID=SeqID_39012; Location=253..353; Strand=-
  SCN-specific regions: Sequence locations=1-101

SEQ ID NO: 67683 - DNA, 941 bp, Heterodera glycines
  Genomic contig location: Contig_ID=SeqID_39014; Location=253..1193; Strand=+
  SCN-specific regions: Sequence locations=1-250,290-327,349-426,448 -627,649-941
atggcattcatgggctctgatatgacaaaaattagtccatttttaccatttcgaacttcggaagaaatgattggtgatatttctgaaattatggcgattcaaatgcgtccttttcagtctcatcactcggccggtccaacagcaggaagcagtacacctcgcagcataacaaccactgcagcagcggcggtggttcggtcggtcgtcacgcgttgcctccgaacaattcgctgccaaaacgacagcaaccgcaccaccacagccaccaccacatgaacaacagcagcagggggacaccgtgcaacagcggcacgggcagtgggaaaagcgcgcgcgtgcgccacgacgcggccgccgcgacagcgacgggacggacggcgaagcgaacggtggcgacgacgaacggaacgcaaccacaacggaatgacaacgcaaacagcacacacaccaacgccacctccaccaccgcatcagcaacaacagcaggcaataacatcgcaaaccacgcgatggacacaatggccggtggggaaagtggcggggagggggggggacaacggtggggaactcgaaaagccaaatttttggctcttcaatccaccaattcttccagtattattttacaaaattacacaccgctggaaaaaactgtatttttggctcacaaaaaagatatttttcaaaataatttgaggattcttttgaaacttgagaatttctcaaaatttggcgccctaagttggcgatggaatgaatgtgcgcttatttcagcaatgtccagcagtaccatcgacatggacttgctgcccgccgaagtgtcgtccggatacgactcggacctcgtgtcgcgcatccaagacgacataatgcagcagacgccgcctgtccagtggaatgacatctccgggctggaggaggccaagcgattgctcacggaggcg

SEQ ID NO: 67684 - DNA, 489 bp, Heterodera glycines
  Genomic contig location: Contig_ID=SeqID_39016; Location=153..641; Strand=-
  SCN-specific regions: Sequence locations=1-296,318-374,396-489
atgcatgcgccattatacggctataatcaaagcagcgttgtcgccgaaccaacaattgccacaactgattcaattcccattcgcacgagtttcgtcacacctgaaggaatatatcggcaaatgactgtcaacgaatttttcagagcgaatcgcatacaaaatcaggtaaaaaacaataaattttgataagacaatttgtccactcgcaaaccctaagatttgtgagatgctatttttacatcatttatttacataccttttgaggtcgccggttccgtatgcaacacacccgtccgtttttccttcctaagaattccagtaacgaggctaagctttgctgaagaagctttgccttccacttcggatgtacaccatcacgagcttttaagggaaaattacaaatggcattctaatgaaatgaatggatacatcgacagaatttgccataacattggacgagaaatctatgtgtttgattacacgaggtga

SEQ ID NO: 67685 - DNA, 400 bp, Heterodera glycines
  Genomic contig location: Contig_ID=SeqID_39019; Location=557..956; Strand=+
  SCN-specific regions: Sequence locations=1-99,174-400
atgtgttctgttttcgctaaacatccgattttgctgttcaataattcgtccgacattttttactacgaaatttcaatcggaaataagaaaaagtaagagattttttattttttgaataaatttattaggaatataaaaatttaattatttttattattattaataataaatttccagttttatgttattcggattcgccgtcaaacagcagacaacactgtatggatatgaaaagggcacttatgcatatgacaattatggcaatattttcattaacggagaacaaaaggaatcaaatgtcaaatatttctacggtgttggcgataccgtaggaattggcgtcaattcggccactcggcagatcattttcacaaagaatggacaacgtttgggttggtaa

SEQ ID NO: 67686 - DNA, 585 bp, Heterodera glycines
  Genomic contig location: Contig_ID=SeqID_39020; Location=692..1276; Strand=+
  SCN-specific regions: Sequence locations=1-216,252-377,417-585
atgttgtgcaaatgcggcgaatgcttcgaatgcgaagatgaaaagcgccgcctcaagcgcaatcgggagctcaatacccgcaaagagcaaattaagaactgcacaggcaatcatctagcaccggctatgatggaactcaaacgccggaatatgaaactgtttaaaaaggcttataggccggtgaagggcgtcatcaataaaataaccgggggtgagtttaaaaaagaaattgaaaaaaaaaaaattttttaggcccttggaatgtagaatgtgaggtctgccatgagaccttcacatacttcatggtggagtgggaaaactcccggaccgacttctcgtggggtcccgggaggaccatggtcgaagcggataacatagtaaaaatttttgaaattttttccagttaaaaattaattttagaatcagaaagaaattttggctcactatgtaggccaaaatgatctactccagaatgaagtggactattatcagaaccttggtaataatcctccgttgaatgtgcccccaatgggggaggatgctataattttgaccagggacgatggtatgccgattggtgcagag

SEQ ID NO: 67687 - DNA, 1782 bp, Heterodera glycines
  Genomic contig location: Contig_ID=SeqID_1091; Location=673..2454; Strand=-
  SCN-specific regions: Sequence locations=1-241,266-1472,1494 -1691,1713-1782
atggaccccgcatttttggccgaattcgccccgcccgaaggagccgaattgcatcgtcataaaataaaaaaaatcgatcctgatcttcttcccacttctgccgaagccgacacttcgtttgacgagcgcactgtgccgctactggacaaggaatccataagcacacttctcgtcctgttcctgttggatcaggagaagttcgacactgtgcgtcttcaggtagaagactactcagcattcattgcttacaattagtattccctttggtttcagaaattgttgaaactgatctgcatagatccgggcacttgcgatttcaccatttgggcactgctgtcaatgttcgatgggctggacaagttcaaatcagtggacggttacgaggcacctgcggatggcggcaaattccaatttggatggatcaatgagcttcgtttacagaatgttttgaatcggcccgaaagggtccttctggtcacttcaaactcaggtaaacccatcctgttttatttcagtagctattggtttttctacatttagttttcatcaacaatcaaattcgaacaatggcagctcaacgcgtaatcgacaatttggcacatttggctcagagctttgcgcggaattttatgcccacacaaattcgtgcgccaactgtgatgacggactctcctccagcaacggcctcccttttttggaatacaattcgcaggtgtaatccattctattttcttatttgaatttgatgtttagtataaatgggcgaccaattgatgactctcgcaaagaagacgccaaaatgatgcaagaaatgatcgctgactccatcgagaaatcgccgttggcacaacttttcagtctgttggattccaatttatcaaaggagagtcgtgcgatttcggatcggattgttcgcattatttcatcggtaatttttgttttgttttttatggtttattttctatttttattatagcttgcgcaagcagttccatcagactttcatgaaaagctgtccgatgaatcgaagctttggcttgggatgcgcttgaagagcttcacaaatgtgtgtttatcgtttatacacgatattgtttaaaaaatagctttaggctttaatgagcagctgcgccggagaagccttgcgtgatggtcgttcaatgttggctgagatgtttcgggcaattccaacagaaagctctgctattctgcgagcaatttacgaatcggtcacaaaccatgggaatcaattgaatgcccaattagttttgatacgccgtgctgctgaatctggagacggtgtgtttggtgccttgtgcatttttatatggttcgttaaggacaacaaagcttgttgcacgtgttgaaagaggtttctggtcgagaaagtgttcccggcaaatttctgaagtcgctggaaacggtgagtttttctttgttacgattgcatcacttatcacaacttatttatatatctttggtgtttttcagtttcaatatttgtgcaaccagttgaaaaaggtggaggaacagcggaagaaagcgcaactcacaaaaaagaaggacgacactgagaaggagggagccgaggaacagcagcaggcaacgacatcgaaacctcaagccgacacacacgcgaaggaggaaagtgacgaggcaacactggtccggaacatggtcgatgagctggcgccactttgggaggagctgagcaattgcctgtcacttctcgagaaggccgaagattccaacatggcggtttttgtgtcttcaaaatggtaa

SEQ ID NO: 67688 - DNA, 70 bp, Heterodera glycines
  Genomic contig location: Contig_ID=SeqID_1091; Location=7233..7302; Strand=+
  SCN-specific regions: Sequence locations=1-70
tttttgtattcaccgatcttcagagtaagtggctaatgcccttctgtagatattttattgactgaataaa

SEQ ID NO: 67689 - DNA, 2403 bp, Heterodera glycines
  Genomic contig location: Contig_ID=SeqID_1091; Location=3618..6020; Strand=-
  SCN-specific regions: Sequence locations=1-1294,1316-2151,2175-2403
atgaccaagcgtttgttgcctgaccagcaacagcagggcttccatccgcttcactcatcagtgccaatctacgcaaaagcaaatctgcgcggagacttcaatatggagaagcttgtcaagctggaaagtgaacttaggaagggcactgaacgacaccgactgcttgtcaaaggcatcctgaaactggtaaagtcgagcagcactcaaccgttggacaacgaattggcacacaacgcgctgacattgttgcttcgcctcgtttcattggatgggatgtcgcatgagtttctgaatgtaagtctatctaatgtattttcattttaaacattccctttttaagggggatggagtgaagacactgttggagatgaagcgcaatccaatttcggcacaaatggtgacaaatggcacgacaacgcctccaacactgaacacattggcaacgctcattcttcgccagtgcatcgactcggacgtcgcacttcttcagtcagccttcgaacaaatgatcaccgcaacttgcaatggccagccaatttcgatgcaggaaatcacttcgcgccgacatgcaatgagaacgaagcgttatcagaaggatgttaaggtttgttaattttcattcaaagtctgtaatgtaattcactcgctttcagagagttgtgcgcatgttggtccctttggcggtgcggtcgccctcactttacatggacgcggcgaagaaatgcatggtcatcaaacaaaacgaaattctggtcaaagaacagcgcgctgacgtcaaaggcaatggaaatgcagcggcggcttcagaccaatttcttcaagcggttgttttcattcctaatcaatatgtaatcgtcatctttacaccattttagcttctgagtcaaatcgtgacggagttgacgcaatttgacacatttgcggacgcagacaaaaacactcgtcttatgcagcctccaaacctgctcaaattaattgccgaagtgcttcgcagttatccaaaggtggctgttccaattttcatcgagcaatccctgggcgaaaaatcggttcttcgctggatcatcgaacgtttcctcctctccgctcccgtcaacgatttgtccgacaccgcccacttggccaaaaccgtggtcagcgagctcgtctcaaattcgtcaagtcagcgcatcaccgatcatgtcgtgggcaacatcaaatcacttctcatcgaatgtggcgactttgactgtacggttgtaacttccgatgagagcaacaacggtgcatatgtgaaatttgcggacaaagtgaccattttggcaaagctgacaatgcatttgagggagtgtttgcaggtgcgcgtaattaaatggtaaagaaaagagatggaatatttttgaacaggtgaacaatcaacacaatgcaaagcagggcatgtttattgttaaaagcattcacaagaagaacttggcaaatgtttttgtcagaggcatttggaaaattccggtgagttttctttaaatcaatgttttgttgatctgaatgttaaaaatcgcttttagttacacgagaagccgggtatcgacactgtgaacacattgctgaagctgctcgaaggaatgatgaccaaaaacggcgcagaattcggagcaatgggcgcacgttcttatttgttgccatccttctcttatgacccgcgctcatttcaatattacgacgacgatgatttgactctaagccgtgctacctttgaggagatgggtcgaccggcagccaacattgacccacccattgcttcgactccccgagaagaccaaaacgcgcaccaagaaaatcatgtggcaattcctaacgaacatggagacgtggaacaattggacgaatcgatgggcgaacccgggcacttgcgaggagatattatcgacagtatgttggacaccactcaagaagagaacgaggagggaggggagagtgaagatgagtcgcctcatgactcggaagaggaagacatggacaccggtgaagaattgacgcagcaaagaccagcggtgcacgagggcgcaatggaggacgaccacatttccgaggcagccgacgccaatgagcaggttctgcaatcgcacttggtcgctgatgatgacttcgaggagatggatgacgacgacgatggcgaggaggacgaagaagacgagaccgaagttgagggaggcggggagttggccgattttgacgtatgtcatgtctgttgtgttcacttaaatgcaataatttgtttaggacactctgcttgactacgtgacggactttaatgccctcgcccaacagatgcacgacattcgacggcggatcaatctgaatattgatacgaacgctttaaccatacgaccacaacaggtgcagaaaaggaacgatgaatattaa

SEQ ID NO: 67690 - DNA, 1227 bp, Heterodera glycines
  Genomic contig location: Contig_ID=SeqID_1091; Location=7728..8954; Strand=+
  SCN-specific regions: Sequence locations=1-357,490-575,607-726,750 -776,805-841,873-878,900-1227
  Gene Ontology: Biological process=N-linked glycosylation
atgcaaaacgaagtgatggacagtgatgaggacgaacaattgacagggaatggcgccgctgaggaagcgatgttggatcaaggcgagtggggtcatcaatcaactgaggaaaagtgcatttactacagcactattaatattcttcgtagttggacctcttttttgtatcaaaaatgaccttaaatttgtcttttttttcatttttaaatacaaattatttagaagggacgacattttccgaaaaaagaatcggaaagaaaaaattggcgaagcttcaggcaaaggcagaagcgaaggcactgcgagaacaggtaaaagcactggtaagtcattttaaaggcaatgaatggttttcaggaacaaacggaaagagaagagaggaaacaaagagaggaagaaattagaaaagaggaggagaaaaagcgacaattggaggaggaggaaaagaggaaacgggcagaaaagaggagactcgagaaggaggaaaaggaccgccgggagatggaggagtatttgaaagtgagggacggggcaaaaagggaaaagtgccaggctcttgcagagtttacccaatcttaaataatttaaatattcaaaaaaatttaacacgacaatagaagtccatttcacaccttgcatttttgaaaatttctaaaaaaaactcaaaaaatagtcagaacaaaaaagtgtaaacaattccaaaatatgtagaaaaagccgaattataaaaaatgcaaataaaattcccaactatcaaagcacatagaacccaaaaccggtttttaataaagaaaaataacaaacagtataattctatgttttctttcaaatgcttttgttgtttattacaaaatttttaaatatattattttgcagataaaaggtgcctttgaagtgcacgaacagggctttgactatgatgaaaatgaggacaatgccgacaaccttctcgagtcgtttgtcaattttgtgcgcaagaaaaaggtcattcgttgccttattggccttttttattgtcattctccgcaggttgtccacgtcgacgaattggcgtcaaactttaaaagtaaaccaactgacattgttgacagactgaagacactgctgcagcaaaagcgactcactgggctttttgacgacagaggtgtcctcggattccgtttatcccatcagctgtcccttcccttaaggactttttgtttctataacagaggaggaattgcttga

SEQ ID NO: 67691 - DNA, 137 bp, Heterodera glycines
  Genomic contig location: Contig_ID=SeqID_1092; Location=267..403; Strand=-
  SCN-specific regions: Sequence locations=1-137
atgggagaacaagtaaaaagacatggacgtaccgtcaagcaattcctcctctgttatagaaacaaaaagtccttaagggaagggacagctgatgggataaacggaatccgaggacacctctgtcgtcaaaaagccca

SEQ ID NO: 67692 - DNA, 401 bp, Heterodera glycines
  Genomic contig location: Contig_ID=SeqID_1092; Location=999..1399; Strand=+
  SCN-specific regions: Sequence locations=1-164,186-401
atggatattcattcggtgcaacaagccaaaaaagtggccgaacagctcgagcgggaaaagcgcattcgccgtcttccaatgtcggaaacaattaacgacttaattcggtgggactgagatcgaaaatgttattaaattcgctagttatgttactcatttgactactgaaattattttgttttttacaacattttgtgccctaataatgactttcgattgtttaatgtgcgttaatatttaggtacacccaggagatgcagaaagacgactgtaagtgttttgaagggattctaattacagacttggatggattaaactttgatttattcatccctccgaatcatgcaaaaagtttgcggtttaacttctgtaaacaatcaaaaaaatttttaattctgtaa

SEQ ID NO: 67693 - DNA, 482 bp, Heterodera glycines
  misc_feature (127)..(127): n is a, c, g, or t
  misc_feature (254)..(254): n is a, c, g, or t
  misc_feature (383)..(383): n is a, c, g, or t
  misc_feature (434)..(434): n is a, c, g, or t
  misc_feature (466)..(466): n is a, c, g, or t
  Genomic contig location: Contig_ID=SeqID_1093; Location=49..530; Strand=-
  SCN-specific regions: Sequence locations=1-482
atgggaaagtacaaagcaatggcaaaaacgctcaaaacattcaaagtgaaggcatcgcggaagcaattggaaaaagcgaaaagggcgagacggaggaaaacgaacggcgaattggggacagaggaangtggcacaaataatggagacggatgggaaggcggaaaagggggcaacgatcaggaaaaacgacggacgattgaggaaaagcgaaatgccatttgttgggacagaaaaaggacgaaaaaacggtgganaggtgagcaaacattaattaaagcaaaatcgttgaaactttcagcttagcaaaagactcgaaaacaaaggcacccggcgaagcgcagcagggagtgacgacaaacagacaaataacgaagaaaaaggcngaggaaagtgatgagaaatcggaaaagggaggaacggaagagggaaaaggncggcgaatgcaatggaaaaagacgaaaaatancagattatcattatga

SEQ ID NO: 67694 - DNA, 893 bp, Heterodera glycines
  Genomic contig location: Contig_ID=SeqID_1093; Location=780..1672; Strand=-
  SCN-specific regions: Sequence locations=1-443,479-582,622-893
  Gene Ontology: Mol. function=translation factor activity, nucleic acid binding; Biological process=protein biosynthesis
atgcatcgacagctgcgcatcggctggttcgaccagcactccaacgaggcactgaaccaagaacagtccgccatggactatctgatggtcaaataccaaatcgaccagcaggtgctgctgattattcgttgcattgcttttggcaatttttaagagcgcgaggaaaaatttgggaatggtcggcctcgcctctcacgcgcacactgtgcacatcaaaaatttgtccggcggtcaaaaatcgcgggtggcattggccgagctgtccctaaagcagccggacattctgatactggtaaagtttctcgggatttatttacataataacgtgagaatcggtgaaccccaaaaaaagtcgcagagacaaaaaaaattctaaaaaatcttaagaaaaattataatgaaaaccaaggtgttacattgaataaaatttacaaaatttcaggaattttttttagtttatataatttttgaaaattaacaaaggcatacatttaaaaagtgggggggggtctacctcctttcttttcatgaacaatggtaaaaagtcttcgggttcccactccatttttttggttgcgggcctttgcaatcacacaaaataaaattattttgtgcatattcgttgtttttcgtagtaccaatcgaataaatcgaaatttcttccataatatgcaaacaaatctaacaataatctgttggttaaggacgaaccaaccaacaacttggacatcgaatccatccaagctttggctgaaggcattgaagacttcagtggcggtgttgtgatggtaactcacgacgaacggcttatcagagccacagactgtcgtttgtgggttgtggaggatcaggtggacggggaggaggaaacaccttcgcattgtgaaatttag

SEQ ID NO: 67695 - DNA, 1229 bp, Heterodera glycines
  Genomic contig location: Contig_ID=SeqID_1094; Location=802..2030; Strand=-
  SCN-specific regions: Sequence locations=1-317,339-897,919-967,989 -1070,1092-1127,1150-1229
atgagtggacggaagtctctggaaagaaaccatcatgaacggagttctaaaacttcccaccatcgttcggcggtaataaaatttagtggcgaagaatgtgatagcaaagatcggtgagtctttttttgttttatttcgattgaattggccattctttaaggaagtcttctcatataagaagaactgactctgataaaattatgcgatctgttaatagcgtcaaaaaccgcttaaaagcgtcattaaatgctgcaattgaagcggaatcgacgaaacaaaacacaggcaaaagagaaatgtcaagttcaaatggtcagtgagacatttgtggtttaaaatgcattcaacgtttgtccatttctcaaacaaaaattaaaaatttgtgcaaaagtaaaaaaaccggatttagctaaaaagcatagaaatacgaattgatgttttacagatgtagctgattcatttgcaaggcaagctgagataaaccgaattgaagagccgggcttccgaccttcgtcattcaaatcggacgctgacacatcccgaaaagttattaacagcgttttatttttaattgtttttttcaagaacaattccttggaaaaaatgaatgacaaaggcaaaacgaacgcgacaaaacacgaccgggcgatgtttggaccaatttgggcgggaaaagaactcgaaaaaggacgaaagacagcacaaagcgaagcaaaaagggacacgcggcaacatcacagagaaacaaacgaaaagtttgagggagaggctcaatgtcagcccggcactcgtttcacattggcccatgaattggtaagacaaacgaagacacttttttattttagtgggcctcatcaaatcacaggaggacccttactactttcattttttggctgcaatatataatatattttttttgaaacttatttacggacttttcggattgcttataaattacagatccaatcaaattctaaaattatttttcgacatttacaaatgtggaaaaagtcatttgtttaaatttagttgtcacaaaacgcagaaataagaaacggacgatggaaagagctgttcaaagaaagaaggcaaaacgctctggatggcattttgtgaattcgtcatactttatataaatttaaattaattcgtaaatattatgcatggtttaacctctattcgaatattttcacaattccttatcatttttttaaaaagaagaaattaaa

SEQ ID NO: 67696 - DNA, 502 bp, Heterodera glycines
  Genomic contig location: Contig_ID=SeqID_1094; Location=3007..3508; Strand=-
  SCN-specific regions: Sequence locations=1-60,82-450,490-502
atgaaaatacgccctaaaatcagaacatttcttagaaataagaacataaagaaaccctgcattaatcagataaaaataaattcaaatgaaaacgtcaaccggtatcgaactcctaacaagaaatacggttagtgttgaagcactaaccactaaaccacaaatatattggaagttaacagcaaaatttactttatttcataaaaaatttgtcaaagatggttaaaaattcattgcgggggtcagagtcgcgggggcgggggtgacgggggcggggtccgaactctacttctaattgaaataaaatgcgaaaaaaatgacctcaaaaaattaactgttgcagttgcaaattgagtatatttcaagccttttgagataaagctcatacgattttcggcaaggaaatttttgtaaaagggtcggtgttaggtcgagcctaaaaaagtatcaatgataataataattaaattaattaatattttaattttatttgctgaataataaa

SEQ ID NO: 67697 - DNA, 1303 bp, Heterodera glycines
  Genomic contig location: Contig_ID=SeqID_8323; Location=742..2044; Strand=-
  SCN-specific regions: Sequence locations=1-222,244-447,469-572,594 -874,899-1068,1091-1227,1249-1303
acaatgacaaaaattaaggaagacattggtgaagcatttgtctggatttcagtggacgagactacggataaaatggggcgaatgatcgccaatttgttgttaggcaaattggatggcaaaaaatggcaccccccgcatttaatttctgtgaaagcgcttgaaaaggtggacagtggagcaatggcgcgttttgttaatgaaggccttggtagtcgtttagcttttattcctagatattttttaattttagacagtttttctgctaatattaagaaagagcgagtgctgtttttggttacggggcgaatgatcgccaatttgttgttaggcaaattggatggcaaaaaatggcaccccccgcatttaatttctgtgaaagcgcttgaaaaggtggacagtggagcaatggcgcgttttgttaatgaaggccttggtagtcgtttagcttttattcctagatattttttaattttagacagtttttctgctaatattaagaaagagcgagtgctgtttttggttacggacggggctgcgtacatgaaaaaggccggaagacaattaaaagttagaaaaaagaaaattcaaataaattttttctctttttcaggttttttacaccaatttgttgcatgtgacatgtttgtgtcacgcattgcaccgcgtggccgaaaaagttcgtgacgagtttgcgcaagtggacaaattgataagcaaaacaaagcaaatatttctgaaagcaccgcatcgcctttctgtatatcgtgagatgtgccctgaattgtccatcccccctcggccagttttgactcgttggactacctggataacggcagtgtccttttattgggagcattttgaggcattaaaagcgttaatttatataattttattttttgtagtaaaggtttgtattttttaggtagtgaattcattcaatgcaaatgatgctgtgtgtgttaaggaatgtcaattgtctttcaacaattcagtttggcaggacctggcttacatccattcaaattttggacaattatctgctgcaattacaaaattggaaacacagggaatgaccatttttgatgccatggatgtattcgctggcgttcacaatcaaatggacagtgtttatggcgaaaaggcaaccgaaattcgcaaaaaattctcggacattgtggccaagaacaatggaattgaaaaaatatcccaattttgccagattctgtctgggaaaaacactgaatctgatgtacccccaaacctcatccctttttacaaatttgctccattgacatcttgcgac

SEQ ID NO: 67698 - DNA, 218 bp, Heterodera glycines
  Genomic contig location: Contig_ID=SeqID_39023; Location=176..393; Strand=+
  SCN-specific regions: Sequence locations=1-218
gagttggtcacactgtggatgctgaacgaaatttgatcaatttgtatccacaatgccatctgatcactgctgatccgtcagcagaaattaatgacgcattgacacatcaaattggtggcaaatttgttcatgcagcaattggtggcaaaacagcaatgggacagccggtgaatgttcgacgagaaggcatatttagcaaaaactaaaaaataatttaa

SEQ ID NO: 67699 - DNA, 302 bp, Heterodera glycines
  Genomic contig location: Contig_ID=SeqID_39026; Location=355..656; Strand=+
  SCN-specific regions: Sequence locations=1-219,241-302
atggatgaagaaataaagggagggaaaatttcgaaagaattggaaaattaccatgaacttttgttgcgtttatttaagatcaaattcaaacaattgataaatcaaaatgacaaatttgtggaggaaatgttgactaaagagtgggtcattgaattggtgggaaaatatttgcccaaattgacaatgtgaccatttgggtgagaatttcggactgctttttgttttgaatacataataccatttctcatttgcagctttgtcgtcaattcaaaaagagaagcattaagaaaaatgactgttag

SEQ ID NO: 67700 - DNA, 1038 bp, Heterodera glycines
  Genomic contig location: Contig_ID=SeqID_39030; Location=78..1115; Strand=+
  SCN-specific regions: Sequence locations=1-312,338-1038
atggatgattcatcaacaccaatcgatcgcgacgaagtaatggttaacttcaagagaaacctcgcattcatcaacaaccggtaccaaattgcactgccatggaacgacagagtcggaactttgccgacaaactaccatcaagccaaagctcgactgatcagcctgatcaacaagctccgcgcactcaacttggtcaacgaataccaagcaattttggatgagcaactgcagaagtccgtcatcgaattggtcgactctcccgagcaatcaattggaccagttcactatctgccgcaccgtgccgtcgttcgtaccgacaaaacaacaacaaaaatccgcattgtgatggacgcctcggcaaaacccaaacacagcccatcagcgccgtcactcaacgaatgtctgcacaccggacctcttttgctaaaggacttaactggaattttgttacgcttccgccgtatggaacatgtcctattggcagacatcgagaaagccttcctacaacttggcgtacgtgaacaagacagagacgcaactcgtttcctatggctaaggaatccaacaaacaacgacttgaactcgctgaaacgagaagacattttggtcttccgtttttgtcgtgtcagttttggcctgacagtctcaccatttctgctcaatgctacagttcgtgaacacctggcattattcgacagcaccttagcaaaaaggattgatgagaacctttatgtcgacaacattttgatcgaaatgtggccaaacgagcaacttcaacccgtcgtggaagaagtcaagtccattttcaaagccgctggaatgaacatccgcgaattctacggcagcaacatcgatggtataaagcaattgccatctgaagaccaggccaaagaactcgaaaacacgaaagttcttggcatcacttggaagccaaaattcaaccgaatcgtcttcaaaatgccaacattcgacggaaaaatcacaaaacgaacaattctgtcacacatcgcgcaagtctacgaccccgctcggttttaa

SEQ ID NO: 67701 - DNA, 228 bp, Heterodera glycines; identical to SEQ ID NO: 65316
  Genomic contig location: Contig_ID=SeqID_39032; Location=559..786; Strand=+
  SCN-specific regions: Sequence locations=1-228

SEQ ID NO: 67702 - DNA, 214 bp, Heterodera glycines
  Genomic contig location: Contig_ID=SeqID_39033; Location=1287..1500; Strand=+
  SCN-specific regions: Sequence locations=1-156,196-214
atggcacatttttttgaaattatgggttgggagaagtctaagacatcggtatttcgtgtacaggcagttaagatgctagagtaagtaagacgcaaatttccaaggacgcccttgacatggatcaaggatgcagaattaagtgcatatttggcgacgattaaaaaaaaattaagaaaaaataaacaaaaaaattttcagtgttaaaattttttga

SEQ ID NO: 67703 - DNA, 509 bp, Heterodera glycines
  Genomic contig location: Contig_ID=SeqID_39034; Location=158..666; Strand=-
  SCN-specific regions: Sequence locations=1-55,109-202,244-374,415 -420,442-509
atggattcacttcgatcgctctgttttgacttctttttggcagcaaatgtattcgtatatattatttaatttttttttatgttttaattaattaatttattttatattgctaggaaaccaattcaaatactttgcactttatggtcatttacatgattttgcatcaacaaattcagacaaaattacacaacgaattaaaggcataaaaatttgaaaaaaaaattattttaatttttaaatttaggaatatgcaattgaaaaaggacttttaccaaaaaatgaacaaaatgctgaggattattccgattggctttgttcggccatcggcttggagcatcgaccattcctaccgtatacaaatgccgtagtaaatgtaataaaaaaaattatttgagtatttaaattaaaatatttcaacgcttattggttttcaaaattttgaatatgcctagttttaggcttaaattttaaaagttttatcgaacttaactcttgctataattaataaa

SEQ ID NO: 67704 - DNA, 263 bp, Heterodera glycines
  Genomic contig location: Contig_ID=SeqID_39034; Location=1008..1270; Strand=-
  SCN-specific regions: Sequence locations=1-263
atgaaaattggtgtccttttaacgcgtagtgaatggtatcgccacaatggtctcggcgatggggatcgagcatctctgcatggacaatttcgtggatgccgtccagcgaatggaggagcgccatatgcatgtcgaaatgccattcaatcaggacaaatatcatcagtaaaacttaataatcattatactgatactagaaaatggaaggaggaactcggggcaaaacattaaattgtcaaaagatcaatctaatacaaattaaa

SEQ ID NO: 67705 - DNA, 1368 bp, Heterodera glycines; identical to SEQ ID NO: 39035
  misc_feature (1012)..(1012): n is a, c, g, or t
  misc_feature (1025)..(1025): n is a, c, g, or t
  Genomic contig location: Contig_ID=SeqID_39035; Location=1..1368; Strand=+
  SCN-specific regions: Sequence locations=1-58,80-191,216-415,454 -658,689-936,959-1341,1363-1368

SEQ ID NO: 67706 - DNA, 811 bp, Heterodera glycines
  Genomic contig location: Contig_ID=SeqID_39039; Location=9..819; Strand=-
  SCN-specific regions: Sequence locations=1-304,359-406,428-705,728-811
acgaaggcttcgacaatttgtacgacttggaattccttcggatgctcagcctgagggactgtcgatggatcgacgattgggtgctgagccgaattggcggaatgttcgccaacactttggaaatgttggacctgagcaactgtcacagaatatcggccaaaggtcagttcgagaatagtgatccgggaacccggtccgaatgcagcagcaacagttgctgtctgggattgttcaaaacccgggccctcgtgtgtgggtacacccccaaaacgtcgccggcttcgcggggacgtaacgtcgccgcaaaaaaaattaaataaaacttttttcaaaattgccataaaaatttaaaaaaaaacctaggtgttactgaaaaataaaatttgctgcatttcctgagaaaacaaaattttaagtatctaaaaaattcaaggccatctccccctgacaaccgttgatttccccctccgtccccaaaggactgctcggcctccgttcgctctccaaactgcgctttttgcgcttggacggactcggcaaaacggagggaatcgcaaagagtgcgcttttgctggaggaaacgctgcccaatttggtggtgattggcatcgactatgagcacgcgatggccgagatggaggcggagaagaagctgctcagcaacgaccgggtgctcatcgacgcgaaaggcaccaaattttcaaatgggacaaaaattggggaaaaaagcgtaaaactcggaagaattttggaaattgaatgtattaacgcagaagaagatgggtatcaaagttagcttttaatcccagcc

SEQ ID NO: 67707 - DNA, 1420 bp, Heterodera glycines
  Genomic contig location: Contig_ID=SeqID_8328; Location=1502..2921; Strand=-
  SCN-specific regions: Sequence locations=1-362,462-593,615-753,775 -930,988-1163,1188-1323,1380-1420
atgggttgccaagtaacaacagtggccaaatttgcaacaattagtcagttgtttaaagaatcagtgagcttataggaaatacgtaagctaaaaaacatatttaactgctaattgtaattttgaattgtcaaaaactctgtcgaatctttaaaattaaaataaaggttctattcatggttacataaaacccatttagtttcaataacctaacgagcaaaattttaaaattcaatttaaattgacaaaaaggtgacattaaaccgagttttaataaaggctatctcatccaatgaatctcctcaaacaaaaaaaaaaatttaaacgctttttaagcgaataggaaaattttttgaaaaaaagtctcgagtctcgggttttttgggtctcggtctcggggtttcggtctcggtatcggggtcgagtctcggtctcggggtcgagtctcggtctcgagtctcgggaaatttttggtctcgagcatcactactaaattcacagtacttttcaaggacataaaacatgcattaatgtactctgggcactgattaaccctatttaagtgtaataatgcatttgaaaaagtggatttcagcaattatttaattcagattaatagtcctaaagcctgctgggtcgtttcgtaaaaacttaccgattttcaagaaaaatccatcataacttttctaaaccctatcaaattaaataagcttggtatcatcatacggtagctcccggcttgctctatctattaccataaaaattgcagaaaatttcattgagttttcaaaaagtttgaccaaacatgtttaaaaaattgccataactttctgaaaacttaatgaaatattctgaactcgaaaaatctgtaaaattggcatttttacgaaatggcctagcaccgtcctaagtgccctacagtaatttttgtacaatataaaaaaaaaatcaaatcaattaaaattaataaatatttaaaataaaaattttcttttcagggttcaattcaacctcaaacaaagtcgatgataaaaattatgatggatttcttgctcgtttcccgcgcagcaattcgaatgtgttcattcacccaaaatatttgacaaatgaatttcttggcgaaagttattatgatttggcactgatcaaagtggcatttttggcccaattaaaaaaattaaattttatttcccgaaaatttgttcagattcccgatgaacatgttgaattcacgtcaaaactccctcccgtctgcttacattgtggttcaattgaacgattcaaaaatgggacaagctttgttgccggatggggaaaaactgatggttaaaataatgaaaaaataatatttaaaattaattaatattaaaatgtaatttatagggatgggatttttttgtatgaaaaatcgctagtaaataaa

SEQ ID NO: 67708 - DNA, 1396 bp, Heterodera glycines
  Genomic contig location: Contig_ID=SeqID_8329; Location=400..1795; Strand=+
  SCN-specific regions: Sequence locations=1-38,87-156,190-214,254 -948,1012-1045,1075-1228,1303-1396
atgaatgcaacgcctaacgatcaaatattcaaggtaagataaatatttataatataaaaaatacaaaaactaatttaatttaaaaagctctgttcgggcaaggatcaatgctggacagtgattatttatgcttttattgtgacctttttgactattggtggtgttttgtttaatttttctgttattttcattacaattcgaacaaagtaagattttttactcataaaaatatatttgtaattaaatttctggtgttattttctcttttcaggtcatttcgtggcaccgttaacattttgttcgcattttattcattgtgtgaaattgtccatttgggtggcaattttctgtcaattttctcagcattttctggccaatattttatgccgtataaaactctcattacttttgcttttgcccctataatttgcggcacttgcgctgtgattttgttgcttttcattggcattgaacgcctttccgctgtgcttttcccgtttaagtacataatgtttttcgctaattaataatttaattgttttttgattttaaggaaaattaatcaaaatagttttcttgccattgttttggtgttcaatatcattcaaatcattatgctaacaatcatttattcgcattgtgaagacacgcaacttgactcagttgaagtttttgccaattattatgaagttgccgttctattttatactgtccgttttttaaatattttcccaatattttttaaaataattacactgattaagagccaatgctctacttctggtctgtttgaagcaacaatggtaattgtgtgttcagtggttatttatgcattaattgcggtaacactttactgtcgcaaaggtcggtatttctaagaaaagaagaaaaaaattacactaattaaatgaaaaaaactgtttgaagatgaaaaaaaaagttaagtagtttttaaaattattttaatttaatgttaatagacaaaataaattttatttttaatattttaaagatacaaaacaacggaaaaatccattaagccagcattttttttaaatttaagtaaaattttttgttatcaaattttggtggggcatttacgaaaaatgaaaggttttgtgatactctggcatacaatacttaattaaatctagtaaagaaagaggccaaaaactgacgaaatattagtaaaaattaatcattaaagttgcggactaatactattgtgaaaataattaaacaatattttttttaattgttccttttttgtaaaaatactaaaaatgaaaaaaaatttaatttgtctttttttttgcattttcagaccaaagcaattacaactcggcccaattcaacaatagaatattccgttcacttttcacaattgtcgcagtga

SEQ ID NO: 67709 - DNA, 232 bp, Heterodera glycines
  Genomic contig location: Contig_ID=SeqID_39044; Location=370..601; Strand=+
  SCN-specific regions: Sequence locations=1-232
atgggtggacagcgacgcgctattcggtggacatcggatgggaccagcaaaattcatggtgaccaaaagcattcggtgccaatgtatatgttttcatttagcatgattcgactgataatcgacgaaccaaccgaactctgtgcgactcttttccaacaacatgctcgtaccatgttggaccaagttgacattatgctgctgctccatagacaggacggcgaggctacgcctg

SEQ ID NO: 67710 - DNA, 509 bp, Heterodera glycines
  Genomic contig location: Contig_ID=SeqID_39048; Location=89..597; Strand=-
  SCN-specific regions: Sequence locations=1-6,28-106,129-229,257 -354,380-509
atgccccgcgggggcgaaaaggggccgaaaaccatcgaagaagtacacgaagaagcggagaaggaacagcaagtgaacgaaatggaacgtattgaggtgagggaaaacaatgaattaaattgaacatttaattactaaataaagagaaacgaatttaaataaatgatggaattttacactcatttttaaatggtaaaaatgcattttgaaaataattgtttctttcagcatgaaaggaagaaagaaaatgagaaaatgcaacaacagacgacacggaaaggcagccgaccgaattacggcggacggagttcggccgaccgtcgctcggcagcggcggcgaacggtcgaaaatgaacaaaataaaatattaaaaaagcaattttcaattcattgcttcagtcagctcactgctccccagcagtcgggcggaaagtcgaattgccgggctgtcgaagctgcgcgaagtggacagtttcgtcctcggaggtggcgaaatcccaacggaatga

SEQ ID NO: 67711 - DNA, 852 bp, Heterodera glycines
  Genomic contig location: Contig_ID=SeqID_39049; Location=18..869; Strand=+
  SCN-specific regions: Sequence locations=1-784,815-852
gtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtctccttcgctgcccatgcgcacgcttgcgctaaaccggaagtttgtttctgctgaaactatccgtctttacaagacggctgtattaagcggcgcttggcaacgctcgctagcagtaacctggttgatcctgcctgaactgattgtgtcatttcaaagattaagccatgcatgtgtaagttttaacctgccagacagggaaactgcgtacggctcatt

SEQ ID NO: 67712 - DNA, 696 bp, Heterodera glycines
  Genomic contig location: Contig_ID=SeqID_39050; Location=259..954; Strand=-
  SCN-specific regions: Sequence locations=1-343,365-696
atggcgcaacttccgctggaggacatcgcaacactgcccacgcagaagggcgtcttcaacgcaccgttcgacaacaaggccacctactacgtgcgggtacgtttggacgcgttccacatggcatgcggaataaagtttttaaattaaggtgatcaacctgggacgaagcgcatcggctacgccttcaagaccaccaaaccgaagcgcaagaagcaactcgtcatcgagtacaacatctgatggaagaacgcttcgtcagctcaacatggacatgataggatcccatcccaccgtcccaaaattgtcattttgtcccccataatataaattgttgtatctaaatgctctgtgcttcaattgaaatggttgtgtaggggggggggggatttgggtctgtttgaccggacagttagctctcgtagattcggtctgcttaatccttgtatatttgtgtaatgactagggctgtgatttttaggcaaaagcctaaaatttttgcgcacttcacacttcatacgcacagataagcacgaaaaacatattgcccttgtacaacattctaagaactgtcttttgtacgagttgccattgacccttgtatattcaggccaaaaattattgagataagattggcacaaaaatgactacaaaatgctgctgaaatttactcaaagaatttaaaggcgccaaaataaa

SEQ ID NO: 67713 - DNA, 870 bp, Heterodera glycines
  misc_feature (25)..(25): n is a, c, g, or t
  misc_feature (29)..(29): n is a, c, g, or t
  misc_feature (72)..(72): n is a, c, g, or t
  misc_feature (74)..(74): n is a, c, g, or t
  misc_feature (95)..(95): n is a, c, g, or t
  misc_feature (97)..(98): n is a, c, g, or t
  misc_feature (113)..(113): n is a, c, g, or t
  misc_feature (120)..(121): n is a, c, g, or t
  misc_feature (125)..(125): n is a, c, g, or t
  misc_feature (129)..(129): n is a, c, g, or t
  misc_feature (132)..(132): n is a, c, g, or t
  misc_feature (142)..(142): n is a, c, g, or t
  misc_feature (148)..(148): n is a, c, g, or t
  misc_feature (156)..(156): n is a, c, g, or t
  misc_feature (159)..(159): n is a, c, g, or t
  misc_feature (161)..(161): n is a, c, g, or t
  misc_feature (167)..(167): n is a, c, g, or t
  misc_feature (169)..(169): n is a, c, g, or t
  misc_feature (174)..(174): n is a, c, g, or t
  misc_feature (180)..(182): n is a, c, g, or t
  misc_feature (185)..(185): n is a, c, g, or t
  misc_feature (190)..(190): n is a, c, g, or t
  misc_feature (192)..(192): n is a, c, g, or t
  misc_feature (195)..(195): n is a, c, g, or t
  misc_feature (199)..(199): n is a, c, g, or t
  misc_feature (203)..(203): n is a, c, g, or t
  misc_feature (216)..(216): n is a, c, g, or t
  misc_feature (220)..(220): n is a, c, g, or t
  misc_feature (227)..(227): n is a, c, g, or t
  misc_feature (243)..(243): n is a, c, g, or t
  misc_feature (248)..(248): n is a, c, g, or t
  misc_feature (253)..(254): n is a, c, g, or t
  misc_feature (301)..(302): n is a, c, g, or t
  Genomic contig location: Contig_ID=SeqID_8330; Location=343..1212; Strand=+
  SCN-specific regions: Sequence locations=1-274,296-328,350-458,497 -599,637-689,711-717,739-870
atgggtaatattgtgttttgtgttnaaanaaaagaatgtgttttgtttgttagtatttatggtagattatgngnggattatagggtattttattngnngagggataaagtgangataagnnaatnagtnggngaagaatggnattggnattgggantangnatttantntgttngtgttnnnaanaaaananagntganaaangagatgggagggngggnggagaanagaaaaaagaatggtnggagnaaatnntaatggaattttgggtaagggatgttagtttaaaaatgttaatttgnnaataatttgttcttcctctttttttctaaataaatgaaacataatgtactgagtaaaagtgtccatttggttggttttctaaaaaatgttctcgacctatatgttcgaggtttcttgagtttcgtcatatccattgtccttcattttttaatttcgtttttaatatataatatttctttaatttattttttttagaagactcgagaaagagtatttgttcaattcaatcattttatttaaaattctcacatttttcatacaaacaaacgcatccaatctcaaaaattcttttttgaagtgtgtgtgtgtgtttgtgtgtgtgtgtgtgtgtgtgcccgctcactcaaggactatccaattgccaattccccatgaatgatttctttttgggcaatttgaccctggcactaaaaaatgccaatttttattccactaaagcttgttttgtgctctttccatcacattgttaagaaaaacctcctctttccggtggcaaaatgggccgaggggagggcatcgaatgagtctcacccccccctttcccctaaagtcggtgccttttaatgca

SEQ ID NO: 67714 - DNA, 1102 bp, Heterodera glycines
  Genomic contig location: Contig_ID=SeqID_8331; Location=207..1308; Strand=+
  SCN-specific regions: Sequence locations=1-330,364-453,475-537,559 -563,585-700,775-954,981-1102
atgcaacgaaatgcaaagcgaccgcccatgaacggcacgggcggaccgtcgcgtgtgctgatcggcatttacattgaatcaatgggcaatttccaagcagcggacatggtactgatcagattgaaagaagcaaataatctattcggaaataatatgacaaaaaatcaacaaaaagccttttttcaaaagtcattatgcgagcagagagggcaattttggaagagtcgtgggtttgagtcacaccagtcgggtttctcggggttttcaacaatcttagccctaactaagtctcgaaaatctgtttgtctcatctgttaatacaatagcaagtttattatataaaaattttcaaaataaaatattcaacaaaaaaagttctaaccgtttttttgttttgtttaatgagatgaagaattttttataaaattgaacaaatttatcgagaatatcgaaattaacaaaataaaaagaaatccgattcaaataataaatttttaaatcttctaagatttaattataatgaatgcctctgcctcattaaactattactattacatttggagtaaaattttaaaaataataaacagagtttcgatgtggatttgtatctgtactcacattggcgggacccttcactgaaacacaacaacgacgattatgtgctgatgaccgacccgaaagttcgggaaagaatttggtgaataatttaattatttcttaaaaatttttaaaattaaatattttaaaaaaattattatttatttttttaataaaggcttcccgacctgtactttgcaaatgcgcggaccagcaaattccacgatgtgaccattcccaactttagtctgttcattgaccgggacgggaacattgcttattcaacgaggcataaaactgataaattgataaatgaccggaatatttagggcaatttaatcaaaaaaaaaaatggtcaaattttttatttaaaaattttaaatgagttttcaaatttcagagtaacactgaacgttgcatgcaacttggagctagtgaggagcaaaaaataataaataaatggccaataaaatccaatatctcaggcgaattatccgatggatag

SEQ ID NO: 67715 - DNA, 2018 bp, Heterodera glycines
  Genomic contig location: Contig_ID=SeqID_8332; Location=109..2126; Strand=+
  SCN-specific regions: Sequence locations=1-58,80-164,192-371,401 -434,457-661,683-705,741-1004,1051-1053,1087-1132,1179-1330,1371 -1412,1470-1504,1527-1533,1556-1722,1745-2018
  Gene Ontology: Mol. function=glycine-inhibited chloride channel activity; Cellular component=integral to plasma membrane; Biological process=synaptic transmission
atgcttatgtggccagccaagtgaatgtgagttggttcaaaatcggcgccacccgctacaacccggagattgggctgcccgagttcaaaattgtccagctgacgcccgagtcgtgtgacggctcctatatgtacgccatcatgtcgggcacgttcaaatatggtaacaaataaaattttgaaaattctttttcataattttgaatttcagataagttcagctgccttgaggcagtgattcatctgaacagacaaattggctaccacgtggtccaatcattcatccccaccgggcttattgtgatgatctcttgggtttgtgttagtcaattttattaatattgtaatttcgtatggctaattatattcaagtaaataattcataaaaaataattataaaagaataatgttacatcaggtagtttgtgagataaaatgcggaaattggataaaaaataaaaggcgaattcgagaaactttaaattaagcatttattccttaaataaattttgtctgggacaatttaaagaaaagcccaaaaaatatgagaaagcgataagcgagaggaggaacatcccctaatataaatgtctaaagtgattaagataaacaaatttcactctggcaaaataaaaaacttaatcaagttttaaattaaaacttttgaataaaaatatttcaggtgtctttttggattgatcgaaggtaattaattaattttttaatcattaaatttattttctttttagagcagttcctgcgcgggtgacactttcattcacaactcttctttcactttccacactcgtgggttttacaatattttcaataccgtaaatttaaatgtttacggtatatttaaaaagatattctacagtatattaaaaaaacacctttttagggaaatggcttacgcttcaacttgccacaggttgcctacgcaaaggctatcgacttttggtttggatgtgagtagcaatttcgaaatttgaactcaaaaattggaatataatttttaattttttttccttaaatttaaaattttttaattgggttaaattttaagtttttaaagcctctttaatttatggtgtatttttttaatggttttatcagaaagcatttaattttggaatttttttaaatattaaattttttaaatttaaaaacttatattaactttcgcgctaataatgaaatctcaacctctgtttttgatcagcttgcatgttcttcgtgtttctgtctctcgttgagtttgctgcagtgaattcgtacatgcgtgaggcggagaaatatgagcggttggccagttatagtgccaaaaaaggttttatttatttatttatttttaatttaaataaaaattaagagatgacaaatgaggaaggaaacccgtgggtttattccgagtaatatttttaatttatatttttaaatataaattaaaaaataaattttcaaatatttctaattcataaaatcttagatttttctgataccccatataattattaaatttattttcgcttactgaataaaatatatttgaaaaagcattttttacatcaatttttgccatttccacaaacattcagtgatgatgacttctcctcgaccagtcgatcgcccgttcttccttttccctcgtcacaccaaaaaaattcgaagaaaaagtcgggcaacaagtcgccaatattgagtgccaacaacaaaaacgattacaacaacaataataaaaaagatgagcaagaaaatgagacgaaggcaattggtgccaaattgcacaattggacgagcaatgccattgccattccgtcacgtttcggccgatgcgccgacggcggcgccgcaggggacaccaaacgcagcataacaacacacaatcagcagcaacagaacggaacaatgcgaatgatcaggcggggcatttcgccaagattattcagcaaattccccgcaaatagtccaagttttgcaaatgagaagcgagaaaataaccaccgatttttcgaataa

SEQ ID NO: 67716 - DNA, 175 bp, Heterodera glycines
  Genomic contig location: Contig_ID=SeqID_39052; Location=1266..1440; Strand=+
  SCN-specific regions: Sequence locations=1-53,81-92,119-175
atgcattctttcaagctttttgcatcgctctttcttgtactttgtgtggtaggttttaaattttttaaaaataattttttcccattttattgaattatcttttgttttttagatttcacttgtcatctgccaggacaagccagcagcagtaaaacgggggcatcttcttaattag

SEQ ID NO: 67717 - DNA, 195 bp, Heterodera glycines
  Genomic contig location: Contig_ID=SeqID_39052; Location=1220..1414; Strand=-
  SCN-specific regions: Sequence locations=1-31,58-69,97-195
ctgctgctggcttgtcctggcagatgacaagtgaaatctaaaaaacaaaagataattcaataaaatgggaaaaaattatttttaaaaaatttaaaacctaccacacaaagtacaagaaagagcgatgcaaaaagcttgaaagaatgcatttttttcgtaggtttgttaatgagaattgggtaattttgtggggag

SEQ ID NO: 67718 - DNA, 75 bp, Heterodera glycines; identical to SEQ ID NO: 54636
  Genomic contig location: Contig_ID=SeqID_39053; Location=1465..1539; Strand=+
  SCN-specific regions: Sequence locations=1-75

SEQ ID NO: 67719 - DNA, 189 bp, Heterodera glycines
  Genomic contig location: Contig_ID=SeqID_39054; Location=771..959; Strand=-
  SCN-specific regions: Sequence locations=1-1,23-189
atggaagaaatggtggtgaaatgggcatccgtcgtctttccagaattcggaattcgctataatggtgccgacataatggtggccaattttctgtcggttgtccgacggattacagtaaccccgccgataaagctgacacggttcttcctgaacactttcatgtacagcatgcggcaatcgtcgcgaatg

SEQ ID NO: 67720 - DNA, 632 bp, Heterodera glycines
  Genomic contig location: Contig_ID=SeqID_39064; Location=77..708; Strand=-
  SCN-specific regions: Sequence locations=1-61,95-348,374-453,496-632
atttgaatgagaatagaaagagccaggttcgatgaagttttggtaagccaaaaaaatatccaaatatttaaaaatctataaaaaatttaaaaatgacaattcatgcgagattttctggaaataagcttaattgggcctagttaagctgtaagacacccaccacttttgcacttaaaaaaatttcaaaaaatttgatcgtccataaataatttgtaattgatcagcggctcaccaaattttgcagagatacgtatcggagcactacaaatgcttactaatttttctagattttttaaacccgctgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaataaataatgaaccctcctccttaataattttcctgcgcccaaggtactcactcggccgcttcgcggcctcgtggctgtaaaaaaaatttggggcgatttgaaagagaatagaaagaacccaggtcgatgaagttttggtaagcca

SEQ ID NO: 67721 - DNA, 493 bp, Heterodera glycines
  Genomic contig location: Contig_ID=SeqID_39065; Location=70..562; Strand=+
  SCN-specific regions: Sequence locations=1-359,381-493
atgtcgttgaattcgcgtctcagcaaccacactggcgacgaagttgttgacaatgagagtcattcgccggcggtggcgacgccgccggtgccgaaaagcaaaaagcgaaccgccgcctcgctcaagcagaacgacagcggcaacaacaagtcacttagcacattgattgaggcggccaaaatgatggagggcggctcttcatcggaagagcatcaccaggacggagtcagcatgcccaactcgccggcggggagcagtggttgaagttttcaatacctcggataaaactgacaattttgacgatgactgaaccggattatgcaggattttttctcaaattcgcttgcttcaagcgaggattctctcccttattttatttgtttccgttatccaaattttccattttatgctgcatcataaccttgaccaagtacagactataacttaaaaattgctttctttgatatgaacattgtttagccaaaccattgaa

SEQ ID NO: 67722 - DNA, 210 bp, Heterodera glycines
  Genomic contig location: Contig_ID=SeqID_39065; Location=826..1035; Strand=-
  SCN-specific regions: Sequence locations=1-139,161-210
gggatttcggtgctttactcaatggtcgacaaaacgacgcgctgcggagctccgatgaaagtttggcagcctacgcgaaggaagcgattgagggcattttggatgagacggatcggaatgtggcgaccgttcgacagaatttgccctccccttcccttgaggggggcgcttttcatttcgtcgatgccggtgtgcccgacaattcatcga

SEQ ID NO: 67723 - DNA, 1010 bp, Heterodera glycines
  Genomic contig location: Contig_ID=SeqID_39067; Location=1..1010; Strand=-
  SCN-specific regions: Sequence locations=1-155,177-253,277-863,886 -921,943-1010
tttcgaaaaacaaaattgcaaaagaacaaaaacattctgtacgcataaaaccaaccaaaatcaatttatatttgtgaggcactgtaaacctcgttaccatgacttgacttgttcttgtgattggtgctccattcagtcgtattatgcgccgcgttgggggacgagtgtgtggggagagccgacattggtcaaaggctgtctgagcggaacaatgcttcgtcgtggggtgaagtcgcactgcgaaacggcggacggagagggaaaggtgagagagaaggaaaagtgcagagagtgacgagagaattggtggaacggaaccaaaaaaagaactgcttgaactgtcaggagcctttcacgtgtttctgtgacggaaaggattactgtaataagcgtccgtcgcgaaagacggaaatggagccgattcagttgtatgtggcactgatcaatcagctgctgatccgtctgtgtccctttagattcacttgcatttgtgaagggacccattgccgggagaagaagacgtgcacggggtaagcgaccaattggcggagaataaacagagaatggcactctttcccaagcgaactttgcaccttcgtgaccaatcaccgcagcaaagagagggaacgcggctgcgtcaattcgtccgtgcctttggtggagcgacggtcggctggcgcgtgtatgatgccaccgatcaccggcgcaatgcatcacacagtggcgaagcgggcggaggatctgctgaggacggagtcgtgcgtgtgtcagggcgacttttgcaacgcggtgagagagagataaagagaacagagagagaaaaaacattgttcaggaaaggcccaaacccgtgcctgaaaacagccgatgcactgcctttgcccaattcgaagtcggcgtttatcccccatgagttctgacgtttcttctcaattctttcagttgctaggccagaaaatgaagtccaagaaaacatcttgcacccggtgaattctgcttccgagcggaca

SEQ ID NO: 67724 - DNA, 109 bp, Heterodera glycines
  Genomic contig location: Contig_ID=SeqID_39068; Location=54..162; Strand=-
  SCN-specific regions: Sequence locations=1-109
atggcacatgccaacgttttagctttcgttgttttgccgtcggtcgtcgctttgccacgcgttggacagaaacgactcggacaaattgtttttgctcgtcgaaagaatt

SEQ ID NO: 67725 - DNA, 389 bp, Heterodera glycines
  Genomic contig location: Contig_ID=SeqID_8335; Location=849..1237; Strand=-
  SCN-specific regions: Sequence locations=1-389
atgattcgtaagaggaagataaatcgaagcaacaaaaatgggctgaaaattcggcgtcgcgcggatgactcagagggggcggaggaggcgaaagaggacgccacggggccgcaacattcgccgtcctcttcggcggatgaggcggacgatggccagcaaatattggcaaatagtgcagaaggcgaacagcaaaaagagcagaaagacgaggaggacgaagaacggacagagccgcactccgtggcactgagttttgacgaaaaagggggtgagaagcaaaggacgacgaaccaaatggaagggcaattgaattttatttttcagaagtagccgcaacaattgtcacaggtcgtattcaagaggtcgtccatgtgttggccaatttcaaa

SEQ ID NO: 67726 - DNA, 268 bp, Heterodera glycines
  Genomic contig location: Contig_ID=SeqID_8336; Location=29..296; Strand=-
  SCN-specific regions: Sequence locations=1-191,213-268
atgattcgtaagagaaagataaatcgaagcaacaaaaatgggctgaaaattcggcgtcgcgcggatgactcagagggggcggaggaggcgaaagaggacgccacggggccgcaacattcgccgtcctcttcggcggatgaggcggacgatggccagcaaatattggcaaatagtgcagaaggcgaacagcaaaacgagcagaaagacgaggaggacgaagaacggacggaaccgcactccgtggcactgagttttgacgaaaaagggg

SEQ ID NO: 67727 - DNA, 1963 bp, Heterodera glycines
  Genomic contig location: Contig_ID=SeqID_8337; Location=196..2158; Strand=+
  SCN-specific regions: Sequence locations=1-274,298-430,452-488,520 -699,728-839,862-1034,1056-1243,1265-1543,1566-1708,1732-1885,1908 -1942
atgcttctcacttttcctttctgtcttctgttgatttttgctaaatcatccaattgccaaatgcaaaatttcaattgttttgcccaaaatgggcccaatcgccgcctctctcccgcccaattagcagacacagccttttggcatgagcaattccaaaagattgaactcatcaatagctcggacttcaaattgaaagagtttatttgcgagttgagccaaaagcagcgaatatttgaggcagtttttggaacattgccaagagtaagttaaccgcttaattaattaattaactaatgagtccaccaccactaattaggcccttgtccctccttccatggatggtgaatttgaattcatcaaaagtagaagagaaatgcttgtccacaatgatcccgctttgagtgaagtgctcaatggtttatttgtcactgcaatgaatgccaaacagaaattgcaattatttccgggtgaataaataacacttttaattaattaccattattaattattaatttgtttcctttttcgatgttgacgcttttctgcttgtcaaaacgatgcgaaagcatctgagttttgtgcttctgttcttggccaaacgttaccgaattcggctgagtgattcgaaagagcgaattgttttgacggaacaaagtctaaaggactttttagaagagtcattccaattaatgagccaagtaattaatatattttttcaaatatataaccaattcttccgaatcattagcccaaaaaatgtattagctgtgaaaattgtgcgaacgatcagacaaaaagcggaggaaagaattactcgagaagaaagcgattgctccaatttatttcaaaagcaattcaaattgattgggacggaaatgggctcttaaatcggtcgaaaagtaaatggcactaattaatttgggctttaaaaacccaaaacaaattaagactcaaatcgccgccgcaagcgaaagaaattaatgaaaattttcgagccgatcactctcgccattcttctgctttttctagtgattttcatcatcattttatttattctttgccacgctccgattatttcctttcgcaacggcacagcgtttggcggcggaacaaacgcagcgatcactgagcaatcagagcaaagggacataaaatgtaattaggaaaaacaatgattaaacacagtgccaaggcatttaaaaaccctaaaaaaaaagtcaaagaaaaaagcgaacggacggagagaaagggaaagcaattattaaatgctttcaaaaaaatatttttttaaggtttgaacgcattcaaagggatttcgcccgttgttgtggacaggcaaaaaggcgatgaacacgacgagggggaggagaacgagcagttggactgcgcaatttgcctcggccccattgattacggcaccgaagttaggccattgcccgtctgtaaggtgtgccatcttactgtaatacagtaacaaacaactaaatgccatttcaatcactaattttagcacaaattccacgacgaatgcattgaattatggtaataataataataattattatgttattggtcccccttttttaatagtgtgacataatttaggatccgaggcggacacaacgcgtgcccattttgtcgtcaagaaatattcaatttacaaatgatgtcaccgacattatttccacgtacaaaatttttggtttttcttgattaattaattaagcaaattgggtttaatggggaaaaatattcgctttttaacttttagaacaccggcagaacaatgatgggacaaatgaggcgacattaatagaaataacaaatggaaggacagaagaaaatgaagaaggccggagggaggaagaagaaggacgacgaacaacagcagaagagggaggagcagaaattgaccaagtgtaaaagtggaaatgttaattaaccgaaaataataataataata

SEQ ID NO: 67728 - DNA, 981 bp, Heterodera glycines
  misc_feature (936)..(936): n is a, c, g, or t
  Genomic contig location: Contig_ID=SeqID_8338; Location=43..1023; Strand=-
  SCN-specific regions: Sequence locations=1-100,122-203,225-258,282 -352,404-424,447-489,542-783,821-859,881-981
atggcaaatataactgctggagacacaattttcttgcatttcaattggaatgagaataaaaatgggtggtggtggggggaactttggaagtttttggcaaagaaatcatttaaattttcaaatgagaaaaaatggccgaattttaaggtaaaaatgacaaatcgacaacacgcttataacatgcgccaattgccatctcttgaaatttgattatttttaattatgccaaaattttcaatcgtctttctgatggttccgattttaaatttaaattattgggcggagattgcgtttaaataagcaaatggtttcaattttatgaccattgtcttcgaagcggtgccgacgaaagaaaatttaatgattttatattattatcaaaattaatatgatttttaaaattgtgatatgtttatttgcccttctctactggtaattagcttatttgttatttacttccttttcgtcttctttttttactcacaattcaaatttaataaaattaatttttattatttctttcaattaatttgttttatttcctttggcccaattattttcgcttcccatattattgtaacagtaaaggtcatttttataattgtgcaaaagcaattggtttccaagaaatgttgcaaattgttagtgaaaagtaaagaatgaaactcaaattaattttaatttgctgtataaaaaaggcagaattctaattattattcataaaagcaaaaacattttttatattttttcctaaaagaacaaaatttgcgattttttcctttctttaaatatttatttattttcttttttatcttattaagcacaaaaaagcattgaaaatgttgagattttttgccattcttttcattctttcggcaagtgccgcgccaagggcactgaacttcggcacaaatttggagaaaacgtcgccaattntcgccgtctcatcgattaagctgaaccaaaaagagccaccagttg

SEQ ID NO: 67729 - DNA, 60 bp, Heterodera glycines
  Genomic contig location: Contig_ID=SeqID_39072; Location=811..870; Strand=+
  SCN-specific regions: Sequence locations=1-60
agagcccatgaacagctgcatcggatgcaagtaccgccgttgctgtacgcctaacagttg

SEQ ID NO: 67730 - DNA, 500 bp, Heterodera glycines
  Genomic contig location: Contig_ID=SeqID_39073; Location=157..656; Strand=+
  SCN-specific regions: Sequence locations=1-160,381-500
  Gene Ontology: Mol. function=protein binding; Cellular component =axoneme; Biological process=eye photoreceptor cell development
atgccgcaagttgtacctgctgcggttgctcgtcgaaagcgaagcattttcggtaatttctttgcggggcttttccatcgcaacaatgagacttcgacggaaggtcgtcgcccgtcgaacggcacagagtcagcggaagaagcggaaaaggtaaaggaaaaggaggaggagaaggaggaggaggaaaaggaggaggagaagaaggagaaggaggaggaagaaaaggaggagaagaaggaggaggaggaaaaggaggaggaggaaaaggaggagaagaagaaggagaaggaggaggaagaaaaggaggagaagaaggaggaggaagaaaaggaggaggagaaggaggaggatgaggaaaaggaggaggaaaaggagaaggacaatgcgactgatcagtccgccgttgggcgcgagaagcgcagcccatttggcattttcatgaaatacaaaaagaacggaaagcaattgagcattggtcaacacgcaacaaattaaaagga

SEQ ID NO: 67731 - DNA, 711 bp, Heterodera glycines
  Genomic contig location: Contig_ID=SeqID_39075; Location=543..1253; Strand=+
  SCN-specific regions: Sequence locations=1-293,315-711
atggaaattgggcaaaatgcgaattgccacacaattgaagagaatggcaccaagcaaatgcaaattgtcaattccgatggaaatccattaccaattccgcaaaatccgctgccgaacaaagtcaccggattccgaggcattcagatcaagtaaaatttcgattagattggaatttttcgtcatttctgattttcaggtacatcgatcaaaatgtcgtcacatttctccgccgttttcatcgtttttttgccgtttgttcaacggatttgtaccttaccacgggcaatggtcacattttggactttgttttgctcaacatttggccaatgtttcgccattcaatgcatgtgatgtttttgagttccatcgcttttcgtcgtctgcgccaattggccccgtcacttctcaacgattgtccatcacttcacactattttgtttgatggcgacattctccctgaatttccgcccgatgaaagtgccaatgcgtcggatggccaagcgcaaatggttgtttacgcctcgtccgaatggtatgcccaagtggctcagatgctttgtgaattctccggttggtcaatggtcgtcaacgatggaacagattaaagcggtgattatccctatttaatttgtttttctctaattttttttaatcccatttttaggcattccaatgcttcttctcctgttactttttacattgactttctga

SEQ ID NO: 67732 - DNA, 367 bp, Heterodera glycines
  Genomic contig location: Contig_ID=SeqID_39080; Location=207..573; Strand=+
  SCN-specific regions: Sequence locations=1-367
tgcaaaaccaaaaaagcaacaacagcacaacgactaccaagaactgattgattctttgactgtagcgtcaacattgctcccttcccaacccgaacagcatcctcccattattgcacaaacaatggatactcaacccatggactttgttgacacaatgtctgcaatgacgacatttcttccctcccagtctacaaccaactcggccccagttccaaaatctcagcagtcagaaactttggttgatgttttgtcggcagctgtcagctttctaccatcggaaggtgagaaaacaaaggagcaacagcatcaaacagatgatgatgtgtccaccgtaaaagcaaaccttgacgtaaaggaggaagattaa

SEQ ID NO: 67733 - DNA, 912 bp, Heterodera glycines
  Genomic contig location: Contig_ID=SeqID_39081; Location=31..942; Strand=-
  SCN-specific regions: Sequence locations=1-912
atggaaaaccgttcacctaaacgtccttccaactaccgtattgatcatattccctccaaaaagccccgccaaggcttagtcatcaatcaaattttgggtgtcgtccaacaaggaggaggagagacatcatcttcaaaagaagctccaaaggattacgtgcagaaattgggtagttctgttgaacatgtcgccaaattccactacaccaaaatgaaatctcgcttcagtatttcggatgttccttctaaccccgagaggcttttggctggaatatttcaacattgtattgatagtgctacaaaagacagccgtgaacatgaaatcgagccaactcaccttggatgtttgataagcagtcctcttttgtcggaaggagctataacaattcctactcgaaaaatctccgacaacactatcgacaccatcctcaatttgtttctgaaggtggctcaaagtaaacaacagaaaaacgtttcactgtggggtgatccgttcacggtgacaataacaacagtcgatcgctccggacttcaatttaaacgacgtgtcaaaggaggaacacgccgaaaaatagcttctgtccatcatcgcatcaatgatcaatgcctaatcaagattaacaatcataccggtgacaactattgcttgttttacgctttactagcaacaatgatcgccaaaaccagaggatggccacgatggcagtttggccgctacttgaataaccagcatggacaacagggacaactccatcatgatgcagttgagctcatgaagcaggtgaaagcaccaatggacttggatggctacgacgcagatactttcgtgcctctcattgttgatcactggaacaatatgcagcaacaacaccgctttgctgtgttcatcttttggctcgttgggacagtataa

SEQ ID NO: 67734 - DNA, 516 bp, Heterodera glycines
  Genomic contig location: Contig_ID=SeqID_8340; Location=611..1126; Strand=+
  SCN-specific regions: Sequence locations=1-55,92-418,471-516
atgccaaaggaaagggaaaagaagtggcaaaagaaaaaggtaaaaaataacagtcaattaataataacaataattaattagttaattaattgtcttaaaaattaggcccaacaaagcctgaagaacaaattgctatttttgaggtattattttttgcttttgaagtttagatactttcattttttaggaaattgaaaagattttaactgcaattgaaaatgaaagaaaacgaacggactttcagaaaatcatgaaaccatttgaacagtttttgaagcaacaaattcaaggtgaagaaatcagggacggttaatcccgatttaaagttcccttcttaccccggtctcgacttttaaaaactcaaatcccgacccaagttataccttcaaaattcgcaatattaaacttaaaaaagccgaattttttaattttaacgaaaatatttttttaattggttatttttttaaattggctaaaatttttaaggttcctcaattttttttttaatttgtaaaa

SEQ ID NO: 67735 - DNA, 317 bp, Heterodera glycines
  Genomic contig location: Contig_ID=SeqID_8340; Location=1563..1879; Strand=+
  SCN-specific regions: Sequence locations=1-70,92-93,115-125,147-295
atgaaggaagatttgttgcaagtcgaattaattcctttggctgaagaaaaagccgaaaaatgtattgtaattaaaattttaaagtgatgcaatacaatcatttattaattaaataaactttttttccatttaaagcagaagcaatagaaacgggagaaatggacgaggaaatgccaattgaactgtcagtgtacgaattgggcatgtacagaagattcaagcacatggcactgctaataggcgacattggtagacaaatgtttactgtagagtgtacagtaaacctaagaaaagaattatttatttgtcctttttaa

SEQ ID NO: 67736 - DNA, 474 bp, Heterodera glycines
  Genomic contig location: Contig_ID=SeqID_8340; Location=2082..2555; Strand=+
  SCN-specific regions: Sequence locations=1-141,173-273,295-474
atgggtccgtacataaagtacgactttgtggaaggaaactgtgccgatttcacaaaatctttgcttaaattaatttcctggacgaaatcgccggaaatgaaaagcgatggcaccgaagggaaagaaaatggcaaatatccgccagaaaaagtaaaatatttaataacaaattaattgacagtaaaaaaacaaattgttgaggtcgattattcggaatggaacgtaattaaaagggaaggaaagcaaattgaacttgcggaagaagtaaaaacgtttaaaattaaattttgaaatttcatccctttttttcagcccattgttcacaaacaaattgaattggcgaaggtggattttctgcagaacccacgcttggtacaattggtgaaggacggaccagaaattataaaaggttttatgcgcgcagtcacacaaacggtgacagcaatcggaggcatggcaagaagaagaaactga

SEQ ID NO: 67737 - DNA, 56 bp, Heterodera glycines
  Genomic contig location: Contig_ID=SeqID_39084; Location=74..129; Strand=+
  SCN-specific regions: Sequence locations=1-56
actatcgggaagctattcccgaaggattcggtctccccataaatctgggcgcatcg

SEQ ID NO: 67738 - DNA, 646 bp, Heterodera glycines
  Genomic contig location: Contig_ID=SeqID_39085; Location=877..1522; Strand=+
  SCN-specific regions: Sequence locations=1-297,319-646
atgtaccgggagggacgccgaaagattgcaatcgcacgcgaaattggcgtcacacattcatgcgtttccaaagtgatcagaaggtaagtgagtgatcggagatgaccacggaagagaaaagacggccaattgagacggattcccgcagatttgaagagaccgggatgttggagagcaaaaactcgcggaccgcctcttgcgcatgccccggcgacgcggaagggcacggtgagcgattaaaggcaaattgggaattggcatttgcattaagccagctttttatccgtacattttttgtccttccttctttgattaaattttcttccgtcccttcgatttttgcaaattttactgttttaatccatttttttaaaccaaataaatccccgcttagacccgcgcatttgtcggcacgcccgcttcgtccatttcgccgcttcgtcctcctccacccaattgccttcgtacgaaatgaataaaatggcacccaacagaaaaccaatcattcgaagcgatttgccgaagaagttcagcatcgaatggtttttgatcacttgaattgcttagtaattaataacttattaactcaattaatttggcttattaaacgttaaattctttttttaggattctcagtgatcattga

SEQ ID NO: 67739 - DNA, 103 bp, Heterodera glycines
  Genomic contig location: Contig_ID=SeqID_8341; Location=373..475; Strand=+
  SCN-specific regions: Sequence locations=1-103
atgtttggtcaaaaggtgtggtgagctaagttttgacttgttcaaatttaaaatttttttccaggacattaaatttggatgcctaacagttgaattagtttaa

SEQ ID NO: 67740 - DNA, 815 bp, Heterodera glycines
  Genomic contig location: Contig_ID=SeqID_8341; Location=508..1322; Strand=-
  SCN-specific regions: Sequence locations=1-238,260-815
atgtcttctgacgaatcgacgacttcttctgccagtgttgtgagcgttcagctgcgtgaagtgcccatcaaagacttcaaggacgtgcttccggtgctgcagaaaacgctcaacgaattggaacatccgttcatcaagaaggccgaagaaataagcggaatggaacgtgagaaggtggagccagcccaatctcctgtttctttttttaatttacactgtttttcccggtttcagctcttctacatcacttcctctcttgtgctgctcgtgttgatgctctgccctggcaatatgcttctctctactcttatcagtgcgttttgaggagggagttccgttttgtgcccctctgttaaccaatcgcttccctttgtttaagctgtggcctacccaatgtacgcgagcttgttgaccctcaacactcaaaacacatgtgggttttccagctgtgctctccctcttcgagtacaatgtcaattccccaattttcagcggaatacacccagtggctcgtttattggtgcgtgttcgccgagttttgccagttcgactatctctttggctctatcaatgggccttctgctgctgtacgtgcctctgaagaccgtctttctgctctacttggcccttccgcaaacttatggcgctcacaacttgtacgtgaagcatatccgcaaagtgcttgccgtgacgaacgtattggacaagatgaagaagatgttctgatcgagcagataatgtatcactgtgtaatgtctaggatgattctttgttgtgattcctatattatgtgttatgtattgtatgtggagtaa

SEQ ID NO: 67741 - DNA, 668 bp, Heterodera glycines
  Genomic contig location: Contig_ID=SeqID_39092; Location=295..962; Strand=-
  SCN-specific regions: Sequence locations=1-668
  Gene Ontology: Mol. function=DNA binding; Cellular component =nucleosome; Biological process=nucleosome assembly
atgcagctgaagcaggcactgaagcggggcgtttcgtccggcgacctgaaacaggtgagaaatgatgaatgatggcacaaagccaatggcattcggtaatagtaccgatgctacaaagtcgaaacttcaaatttttagagtctcgcattgttgctttttttttgaaaatcttccactacgaaaagttaaaaaatgtttcggcgagatttcatgcctattcaaaaattccgaaaataaatgtttaatgcctgtttaattaccgtttaatattgtgtgtacaggtcagaggcatcggcgcgtccggctccttcaaattgggcgacggcacgcagccaacgttggccaaggcgtcgccagcgaagaagaaaagtccggtcaaaaaggcgaagaaagcggcgcctccagcgcccgcggcggtgccaaaaaagacgagtccaaaagtgccagcaccagcggcggtcaaaaaagtggcagtgaaaaagccgacaccgaagaaggcgccgaaagccatcgcgcgcaaagtggccgcaccaccgccgccagcgccggcggcgaagaaagcgcccgtgccatcgtcgacggcgacaaagggcaaaaagaccaccgccaaaaaggcagtgactactgctaagctgccggcgagtccacctcccgccgcccctcctgct

SEQ ID NO: 67742 - DNA, 693 bp, Heterodera glycines
  Genomic contig location: Contig_ID=SeqID_39096; Location=236..928; Strand=+
  SCN-specific regions: Sequence locations=1-138,161-417,440-544,566-693
atgctgagccacctgaattcgaacttggaattatttggagaagagtcagtccacgcttttgatgattgggctgaccgatttaaggactatctgtcactaacagggaaaaattggaccgaagatgaaaaggtcactcgccttaagctggccctcaaggacacgccgagggaactattcaaagaactcaagtctaatcaaatcactacattcaccagcgctttggaagcactgagggccaaattggactcgcctcaaagacgagaagtggcgaagcggaccctttcagtttgccggcaacgtgaggacgaaactgttgcccaatttttgagacgtcttatgccattaattgactcaacaaatccttctctaacgggtgatttgcgcaaagaaaaaatttgtgaggaatttctgggcagattaagaccaaacatgagctttttgattcgtttggtcgggcttacgcaacccaaaaatttggaaatggtaaaggcccaagcagaggaacttgaggcacttcttctcagtactggaggcggtgttacgcaaatcacacaactcatcaattcaatgacggaacaacgcggaaatgaagaaccgaatgaacaaaacgaagaaaattcgaacaacaatggagcgacaatggtggggaattcagaaatgccacttcacatgacgcgcagtgctcgtacttag

SEQ ID NO: 67743 - DNA, 408 bp, Heterodera glycines
  Genomic contig location: Contig_ID=SeqID_39098; Location=468..875; Strand=+
  SCN-specific regions: Sequence locations=1-81,151-204,324-408
atgaatgtgaacaaaatgcgacaatttgtggtcagttcgcagaatgtcaaaacacaattgggtcatatcaggttcgtttttttggttcattaattaactcattaatgaattattatttcaaaatttcgtttttattaattaattaattaagtgtctgtgcaatgttggtttcattgcgagacctgacggccaaggctgcatcggtaaaaaaataaaataaaaaataatatcattttaattttctatttcatatttttgttgcgcaatgaatcaattttatttttttattttttttgttaatttcattaattaattatttatttggaaatcgtattccttaaaatacttttcaataccgtatttcataaaatacagtctcccacacaaattaggaccatccctcctata

SEQ ID NO: 67744 - DNA, 612 bp, Heterodera glycines
  misc_feature (606)..(606): n is a, c, g, or t
  Genomic contig location: Contig_ID=SeqID_39099; Location=1..612; Strand=-
  SCN-specific regions: Sequence locations=1-90,113-409,431-488,536 -567,589-612
  Gene Ontology: Mol. function=actin binding; Cellular component =troponin complex; Biological process=positive regulation of growth rate
atggcaatcaaacaaagtttgaagcgcgtgctgaaggcagacagggagcgcaagaaggcggaggtgcgcaagcgattggaggaggcgggcagggccaaaaaggccaagaagggcttcctgacgccggagcggaagaaaaagctgcgcgtaagtgacggccaaagggtcgacgggcgaagggatcgcccgtaatggccttcagggccttttacagaagctgttgatgctgaaggccacggaggacctgaagttgcagcaacagcagcgtgcggaggagcgccaaaaagtgctgcacgaacgaattccccaagtgccggacaatttggaaaggatgaacgaaggtcaaaaaaaagaatgatcggagggggggggggttaaatgggagggaaacattgggaaatgaactgctgatcagagtggaaataaatgatcggaaagggtcaaaatgttgaactgatcagactcaaaagtaatgaacaaaggggaaaagagagagagagagatggggagaggagagagagagggagaaagaaaggggtgatcagacagtccaattgccaaatggccatgtccaccacagcccaattgcttgtacttggcgaaaangtttcg

SEQ ID NO: 67745 - DNA, 1493 bp, Heterodera glycines
  Genomic contig location: Contig_ID=SeqID_8344; Location=705..2197; Strand=+
  SCN-specific regions: Sequence locations=1-54,80-135,175-210,232 -813,835-842,874-894,922-966,991-1265,1287-1493
atggacgcaattcttgcaaccgattggctccacaatgcgttcccagagcgaaagacaacaacaacaacaacaacaacaatttctagtgtgggagaagaattagacgatgccgtcaaagcagtgagttttacacaaaaataaatttaaaaaaaaataaataaatgaataaataaaatcaaggaagagcaaatcagttggcttaaaattatcgaagaggaggaggagcgaggaaatgaattgcaaactggtgaaatggaagtggaacgagcgaaaggtttggttgtttacaaaaaaaatgaaaaaaaaatttagagattgagccgccaaagcgacaacacttacagtccaagtgtagctgtaacgaaaagcaaaagagtgtcccgctgattgactttctctgccaacactacaaatgttctgttaaagagcttcacgttctgcttcagacgctgaacaaacgtcgcgaaatttcggaaatgttgcgctctcagcttcagttacgcaccaatcatctgcgtcctgcctggaaaaattttcgcgtccattgcaacgaactgacaattcatcctgctcaaactgcatatgccatgcgcggttatcttggcattacggttttttaatttaaatttatcagctcctcaattgtaagatatacattgtttttaggtccgtatttactactatgtgaagcatggcgtaaagctcgtttatcctcagcttccctgtgttcttcaatttggcggtggtgaccattgttctctgtttccgcttgagtgtctgagcgtcataaaagatgcttgattaatacgcatcgggtgttttatatgtgattaagtttgctgtgttattgttgttgttgttgttgttgttgtttttttttttaatttctcctagataaaaaatgttaattattcaaaattgtaccgcggtgtttaaattacagctgttgcctttcacaaaagagcagtttttgaaaattgcaaaaaatggcttcaattccgagtacgacccccaacgatttcatgcaatcatcatacgactacgtctccccaaaaaacgcactcttgcatgtcttttatttcgatcagcccgtgctgtgttgactggtgtgccttgtccagacagagcggtgcgcgaggcacaaaaaatcagacggagggtgcagcatgcgttgggctcccagctaggaatccacgagttacgtgttacaaattgttggttcttgcactttatcacatcgattgtccatgctgaactttttaccaacactggacccacacaggttccgcaacatcaaatatgatcctacaatttttcccgccatgcgttgtaaaatagtcattgacgacgacgacgatcacactttggtcacttgtctagcctatcattctggaaaaatcattttaacaggatctaaaaggcaggacaatttgaaccacgctttgcattcattcttagctgtcttaaataattgatttgttcatccaattgta

SEQ ID NO: 67746 - DNA, 403 bp, Heterodera glycines
  Genomic contig location: Contig_ID=SeqID_8344; Location=3918..4320; Strand=-
  SCN-specific regions: Sequence locations=1-324,351-403
atgttacgtaaacgacagacacaaaaattggcgggtggtaagacagctgaagacttgtatgaacgaacaaagaggcgattatttgaactggagaatcaacatgggtttgaattggaggttgtctggggatgtgaagtgaagcaacgccttcgagtagacccagaatttcggcggctgtataatgcctcatttgttccaagaccacttgatccaagagaggatgcactgcgtggtggtcgcactgaaccatttattcttcattacacatgcaactcggacgaggagataatcctcattgatatagttataaaataataattgagcaaaaaaaaattttaattatttattttcaggtaagcttgtatccatatgtgatgaaggcattctcgtttcctgttggtaa

SEQ ID NO: 67747 - DNA, 216 bp, Heterodera glycines
  Genomic contig location: Contig_ID=SeqID_39102; Location=738..953; Strand=-
  SCN-specific regions: Sequence locations=1-1,23-25,48-216
ttattaattttttcatcttcatcagtttttggtttaaaaatatatttgaacacttttttatactttgaaggacttttttttattaatacagaattttttgaaatttcctaaaatccgcaatcctgcgcaggatcctgcagattttaaatgcaggatttgcaggattgcaggatttgcaggattaatcctgccggatcctgtcctgtaaaaaatttt

SEQ ID NO: 67748 - DNA, 96 bp, Heterodera glycines
  Genomic contig location: Contig_ID=SeqID_39104; Location=118..213; Strand=+
  SCN-specific regions: Sequence locations=1-63,85-96
atgtgttatgtctcggctgtgtttctgcggctgtgttttggggtgcaccgggggggggggggatcatcacctaattttatgaaggggataagtcat

SEQ ID NO: 67749 - DNA, 229 bp, Heterodera glycines
  Genomic contig location: Contig_ID=SeqID_39105; Location=408..636; Strand=-
  SCN-specific regions: Sequence locations=1-36,92-203,225-229
atgggggtctgggtgagaaaagagtagggaatggtgaagaaggagaaattttttgagaaaaaaaaaattaaattatttattttcatttaaagcatttgttcatatgcataagtggtcaagtggctaaaccttctgattttattatttctcgcttgggtacaattccccactgggatagaatattcttcatattttctttaccattattttaattgaaattttaattaaa

SEQ ID NO: 67750 - DNA, 624 bp, Heterodera glycines
  Genomic contig location: Contig_ID=SeqID_39106; Location=891..1514; Strand=-
  SCN-specific regions: Sequence locations=1-303,332-624
cagacaatggagacggaatatcatggacatttgggcacacacaaaaaacatcgagaaagacagcttcgcaatgggaaaatttgagggtaagcgaatggggggggggatttggacaatttgacaaacaacggcggacactcacagaaatattcggccgactcatccgattttacgagccaaaagcattgctgccgaaggacgtggtgtttgagctgcactgccgcgatttcatcaatcggcatgccatcagcgacaagcattacttaagggtgagtaggtaggcaatggcacggaaagaacggcaaaaaaaagttaaaaatttaaaatttaaggaaattggcaaaggattgtatttggacctgtgcgcatacggtgggtcattagcgagtacggtagtcactcgccgattgtacagaccacagttgtcgtcctaatacggtgtacagttgtcgctcatttgtggccactctccgccccctccacgccaatgtgaaaatgctcgaccgatcgacaacatcttattcgtacattgatctgttatggttgattcctcaaacactcaatgatttttaaacattttgtaatttgacagtgccaaacgggacagacgcaaattgctgaagg

SEQ ID NO: 67751 - DNA, 598 bp, Heterodera glycines
  Genomic contig location: Contig_ID=SeqID_39108; Location=710..1307; Strand=+
  SCN-specific regions: Sequence locations=1-7,29-98,121-190,253 -266,288-342,444-598
atggcatttatggcaattataatggatttttggtgcaatattagccgaatattttggtataatgagaaaaaaattcggcaacgaattgagcaattattaagcaaaattaaaggcaaaaaattagatgatatcgcaaaagcaatggtcaacatcaatgtggatgaagacgaaaatcaaaaaggcaaaaatgtaaaattaaatattatgtaaattaattttaattaattttaaaatataaaatttgaaaaaattcatttaccgggccagggttttgtctctcttttaaatttgtataaattatactaattttcaagttagtttgatttaaataaatcagactacaaaatttattttatttttcaatttttaaagtttttaatttgccaaaattagaaaaacaaaaataaaattagccaaattatttaaaaaaattttttattaatgaatgtcaatccgatttatgttcttttagttgaaagaattgttattgtgggagaacggacccgagaacatgtcaatttatagagcactaacaatctgcattaaaaatgccatctctgaattcaataaaaggttaattaagcaaaaagtgtaaaaa

SEQ ID NO: 67752 - DNA, 354 bp, Heterodera glycines
  Genomic contig location: Contig_ID=SeqID_39110; Location=860..1213; Strand=+
  SCN-specific regions: Sequence locations=1-13,60-131,199-354
ggccgttcttagatcgtggagcgatttgtctggtttattccgataacgagcgagactctagcctactaaatagttggctcattgcttctgtgggcacaacttcttagagggattttcggcgctcagccgcacgaaattgagcaataacaggtctgtgatgcccttagatgcccggggctgcacgcgcgctacactggcaaaatccgcgtgcttgtccttccccgaaaggggttgttaaaccggtgaaaatttgccttgattgggatcggacattgctattattgtccgtgaacgaggaattccttgcaggggcgagtcctcaactcgctctgaatacgtccctgccctttgtac

SEQ ID NO: 67753 - DNA, 766 bp, Heterodera glycines
  Genomic contig location: Contig_ID=SeqID_39111; Location=347..1112; Strand=+
  SCN-specific regions: Sequence locations=1-52,76-126,160-231,395 -610,638-766
atggagaagcaatgcttggaatatttaggcacaattacattatttgccagagcaattcaagcaaaaatgaattttattgaacaaatgtcgaaacattgggcaaataaatcggtgaatggaattgccaaaaaatgggaacattttatttttaatcaaaatattgtattcgaattcgaacagtttgtacaaatcaaattgtattttttgcaaaatcagcttgatgaatacgcttttgagttaatattaataattcacaaattaattcattaaattacaattaattttatttgctttttacgtagttaaaaggtttttttaattaaaaatattattatttaagtaaattattaattttgtctaatctattttatttaatccaatttatttttattcaggcaatcaataaattttgttgaaaattttattcaaataattgacgaaaatgagacagacaaaatcaaaaattatgggaattattcacctcaatcaccaaatgatcaccaaacaacccaatttggcacatataattctgatgaattcaatgcaatttttgccacattggaaatgcatgaatgttcgatgctaattgcaaaaggagtgatcaattttgaaatgatcaaacaaataaaattggcccattatttaaacggtgaaacattttcaaatgcgggaaatccgccgcccaaaaaatgcttgtgtgttgatgctaaaattgagcagcaatatgtcaacaagctgcagaaaatgctgaatcagaaaaaattgg

SEQ ID NO: 67754 - DNA, 1092 bp, Heterodera glycines
  Genomic contig location: Contig_ID=SeqID_8345; Location=531..1622; Strand=+
  SCN-specific regions: Sequence locations=1-828,1031-1092
cgtggagcaggtgcgagcactgcgcaatttgggttccattcagtcgggcgtcaaccgatgcaaactgatcgagacggacgacttcgaaacgctgtacaggtgcgagacagaggacatttgaggaaagtcgaggagagattccccgggactgaaatcacccgaccattttggcattctttgagactgtcgaaaatgtagctgaatctcatcatttttggaactgttgatcggttcagaaaatgataaaaccctgccttatcgatttatttgtcttggttttttgataataagcgaagattttatctgatcactcttactcctctctctctctctctgctgattggctcctcctctttcccttaatttcccttattttctttcactttttgctttttttattcagagactgcaccaacacggggtatgtgtgagaagaacaatttgccaagcgatttgttgttgtggcggaaaagcaaatgcctttttactccaactatttttttttgtgtgtttagcgctcgccccgggcgaccgctgaagcgaacgatcagcgacaatctgcgcaacttcgacagcaacacgcggcaacggcacagcgacgacgcacccgtgccgtgctcattctcaagccactgtaaagatgagttatcaaaacgacattctgaagacgacttttacgcgccgtccaaagcatcggccgaccgtttgctgtcctcattcattcccatccaacaccagcacatgttgcaccaatatctgaatgatcatcagacaacatttgatcagaatcgcaaccagcaacggcagaggcacgagacgagcacatcgagcaataacagcaacaccaccatcacagacaacaacaacaaaccacaaccagcacagcagcagcagcagaaccatcatcacatgttgctgagcattcagcaagcgattgttgcggctgctgcaatggcagcaacggtacaacaccaacaacagcaacaacaacagcttcggcaacagcagcagaacggcacaaacaaaagcaatgctattgttggggatgaacaacaacggcacatgccattgcaacagaacgtccaaatggaa

SEQ ID NO: 67755 - DNA, 1355 bp, Heterodera glycines
  Genomic contig location: Contig_ID=SeqID_8346; Location=147..1501; Strand=+
  SCN-specific regions: Sequence locations=1-571,598-1089,1124 -1156,1183-1355
atgacgcggtggaagcggagagtaacagcacgagcaacgggtgaatggtgtggggaacagatagacagtttaggggtggggggggaaatgcagatcaggcgtgatcagcggatcaccaatgatgttagattggggactgactgatcagtaagacaggaagggaggaggaaggcgtgatcactgatcagacagacgtattcgtatgctgatacgataaagaaatggaaaaaaaatttgtaaaagatagtcagagaccaaacgatcagaaattgattgttgctaaactgagtgacgaaactgaaacaccgcaagtgtttagcaacagcgaaagcccaccgacgcaaagttcgcctccctcttccggcgatgggtactgctctttcaacagttccgactcttacagcaggtcaaattcggacagagttcggggggagggaatcattgttatcttttaataacaatttcagcgaccgacagcaacaccaccacatgctgaaccgtttgaatatggcggtggaccgcgtagagaaagtgttgacggaccaatgccaacactttcacggttggtgcgccaacggaaaacacacaaaaagcaaatccacaatttagcaattgtaaatgagctcaaattggcaagacaaagccaggaacggaccatgacgagagggcgggcggagaaacggcgatcggcaggtaaatacatttgtaatcctcatttttcttttttcaaaatcattgattttgtatatgatttttctcgtgttgttttttttctaaaaagtggtaaaatcccttttctgaatgatgtaaaactcataaatagctttagaggtggctattaaatgtatggcaattttacttttgttttcctattttttttgatgcgatacaaccatctcttagctccgtttccagaacatttctcacataaattcgttcagaactccttcaccaaagacacattagactgaatagaagacagcagatgaaaacaaattcagtaaccacaacaacagccaaaagcaaaccaacggaggaaaaagaaagggaagcgacggaaacggattcgaaatgatatttaatgccacaaaacaaatggaatgattttttcttttgagatgaagagatttaaatttccgttttgatgagtttggcgaaagagagaaacagaaaaagaaaaatgtacgaaaccaacacaaaatgatcattttcagagtgcacagaaatttaagttaacacaatgaaacaacacacataaaagaaatggcagatgagcaacagcagagaatgtcgtacaataataattaggtgtttttcaatgattgaaaagggacggatgagcaaaaataggttaa

SEQ ID NO: 67756 - DNA, 146 bp, Heterodera glycines
  Genomic contig location: Contig_ID=SeqID_8346; Location=1093..1238; Strand=-
  SCN-specific regions: Sequence locations=1-146
ttttgtggcattaaatatcatttcgaatccgtttccgtcgcttccctttctttttcctccgttggtttgcttttggctgttgttgtggttactgaatttgttttcatctgctgtcttctattcagtctaatgtgtctttggtgaag

SEQ ID NO: 67757 - DNA, 392 bp, Heterodera glycines
  Genomic contig location: Contig_ID=SeqID_8347; Location=200..591; Strand=-
  SCN-specific regions: Sequence locations=1-113,135-392
atgtcaaaatttccatccaatttgtctcaaggccgttttgttgctctaattgtccatccattgtcagttcgacgtcgacttgccgttgaatcaagcgcagtgtctgctgcaatatgccttcaagcgatggagcactctccgcgcggataacatcagcataatttgtgtgagtttggcccaatgctcacgacattccatcaaaaaattcaattgctggcattttcaggtcaaactcaacgccaacgaagtgccaaccgatcggaatattgttgtgaatgatgaacagagtctcaatgtgtgcgaagcgattgctgaacaaccgatggcaattcttgtcaccgacaatggcacacaacttttacgtacaaacgcagtccgtctccaataccttg

SEQ ID NO: 67758 - DNA, 168 bp, Heterodera glycines
  Genomic contig location: Contig_ID=SeqID_39113; Location=945..1112; Strand=-
  SCN-specific regions: Sequence locations=1-168
actcattgtcagagactgcgccaacaattgccccaggatcgacccaaatctcaatccgttgactatggaaagtccccatctcctctggaccctaatccacgtttgaaatcgcctcctggcactgcaccgcttgcgcagtcagcgcgtaatttttggaactccgtccat

SEQ ID NO: 67759 - DNA, 418 bp, Heterodera glycines
  Genomic contig location: Contig_ID=SeqID_39118; Location=208..625; Strand=+
  SCN-specific regions: Sequence locations=1-418
atgcagaccggccataaaccattgtctgatgagggttcgtgtccctttacggaaaacttggatacagtattggaggaaatttgcaagcagaaaaacaaaacttcagtatgccaaactggagatgactggaaagcacgcgctaaaagtattattactaaagtgggtacgttgtcaatacctcctattgaagcgtatgttgataaaacccgtaaacaggtatgaattgcaaacaaaaccaatttagtgtattcttatatttctaatttaagcttggagctatgcgaatgttgcaacggcacttgctatagttaaaaaccgatacgcatgaaaactcttcaagaaaaagataaacttaaatctaatgaaagtttaaaaaactgcgcacaattctccaaattcttttcactcgacaagaaaa

SEQ ID NO: 67760 - DNA, 663 bp, Heterodera glycines
  Genomic contig location: Contig_ID=SeqID_39121; Location=175..837; Strand=-
  SCN-specific regions: Sequence locations=1-104,126-268,290-663
gttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtctccccgaaccgatgcgcccagatttatggggagaccgaatccttccggaatagcttccctatagcctgtactttaattctgcgttggatttttgctccccataattgtttgagtaccccaaacggacactcacttgaaaaaatcgatttttttgtt

SEQ ID NO: 67761 - DNA, 587 bp, Heterodera glycines
  Genomic contig location: Contig_ID=SeqID_1095; Location=847..1433; Strand=-
  SCN-specific regions: Sequence locations=1-119,144-197,226-587
atgccgacgaattgccgccgccatcgtttgccgctgttgatgaagttgaagctgatccgccgcttcctccatatgtgtggacaatatttgccgttgttgtactgcttgttgtcgtactcggctgctgttgttgtttgctgtgtgccatgccaacacccactaagacggaaggtgccgaaaacgatgccaaacggtggccactgccgccagcagcagcagcggggaacaatggcagcgacaatggtggcactaccgtaccagcaggactttgttgcctgtgctgcagctgattatgttgatgatgatgctgaaatttgagggctggaaaataatttgaaaacaaaattttaactcgtaatatcaaaaacaggatggggatcagggctgcacgcaactggatttgcaattatggaaatccgtaatccgtaattacggcgattttttcagttacggaaatccgtaatccgtaattacgggggtccaaaaaccccgtaatttcccgtaatccacaatccgtaatccgtaatttttaaaaatcaatttttgtcagaattttagaaaaaattttttaaatagtgattaataaa

SEQ ID NO: 67762 - DNA, 180 bp, Heterodera glycines
  Genomic contig location: Contig_ID=SeqID_1098; Location=990..1169; Strand=+
  SCN-specific regions: Sequence locations=1-180
atgcggcgagaccatgaagaagaagcaggtgctgcagcacatccaccggtgccgaaacgcgcactattcgtgcatggactgccaagtggtgttcgacaaaaacagttaccaagggcacaccaaatgcatcacggaggaccaaaagtacggaggcgcgagacatgtgccaaaagggacaag

SEQ ID NO: 67763 - DNA, 416 bp, Heterodera glycines
  Genomic contig location: Contig_ID=SeqID_1099; Location=584..999; Strand=+
  SCN-specific regions: Sequence locations=1-115,137-206,228-273,295 -382,406-416
ggtgaacaaaagcaggacgcctgggtgtcgcaagtgcgtgccgccatccgtcaggtggacgagccgcggctgaagaatttgttgcgctccgtccaatgccacaccaacataccgcgcaaggaggccaaatttgtcaactttttgcaaaattcgttgcgcattcgggaccgcgcgttgtgtgtggacgcgtggaatgcaatcaaacgggcggcggacgcggaggcggcaaaagcgaaacggacaacggcggaagacgccgttgtaacaacggcgacggaggagaaggagacggcggaacacaacggcgacgacgcggacaaaatcgcaaccggacgaacggacaatgcatcggcgactacagaaaacatggagggacaagcggaggaggaaaacatggaggatgagacagcgaaaag

SEQ ID NO: 67764 - DNA, 571 bp, Heterodera glycines
  Genomic contig location: Contig_ID=SeqID_8348; Location=541..1111; Strand=-
  SCN-specific regions: Sequence locations=1-18,42-421,446-571
atgacaaattctacccattttgtggttaaaatttcaaaaattaaggtaaactgaaggtccggcggtgccgataatcgccgccggaaaattttttggaaattgtaataaaatatggtaggaaaagttgcaaaattttcaaaaaatttaccgttttttcaaaaaaataaatcgcaaggcaaaaaaatgcaccaaaaagttcaagataaaagcttcaaaccaagttaaaaactcgttttcgtgcatattaggctatagcaagttagcaaaaaaggtaatattagagttgcaagggaccgggaattttgacaaaaaccgggaccgggacttaccgggaccagaaaagtcgggaccgggacctcgattttcgtccgggactgggaccaaccgggaattttcctaagtgaaattttttgaaaaaaaatttgaaaatttgagtgcactttgttacaaaaaattgcctatattcaaaaatgtacccataaaatttttaaattctcgtttgtggggagaaaaattcgaagaatttttccattatgcaattttgagtgtaattgttaacagaaataataaa

SEQ ID NO: 67765 - DNA, 320 bp, Heterodera glycines
  Genomic contig location: Contig_ID=SeqID_8349; Location=287..606; Strand=-
  SCN-specific regions: Sequence locations=1-320
atgtttttgactaacgtcatagcactgggtgaattctcctcccccttccctggtcagaagggtgcaccgtcagaagccccgagactcgctaatgagactttaaattctgttgattggcctacctccgcaccaaatgtcgatcgctttgctgtagctgactggtggcagtttggcattgatgccggatgtttgggtggtcattgtgagcagtgtggtgacaccgagtgtgacccgtgcgggcaccgcagtgcgatccaaccaaaaggacacccaaaggaaaatgaaatgcaccaacaaattgttttttgaatttgaataaa

SEQ ID NO: 67766 - DNA, 1347 bp, Heterodera glycines
  Genomic contig location: Contig_ID=SeqID_8349; Location=1..1347; Strand=+
  SCN-specific regions: Sequence locations=1-9,40-163,261-816,840 -996,1018-1102,1139-1208,1245-1347
  Gene Ontology: Mol. function=glutamate-gated chloride channel activity; Cellular component=integral to membrane; Biological process=cell surface receptor linked signal transduction
aaaaaatggatttaaaattaattttattttaaatattttcagttattatttgttgcaattgtacattccgtcgacaatgttagtcatcgtttcatgggtaggatattgcaccttaattatttaatacttcatataataatcctcacaaaaagaaaaatttaccattttaaatatttttaaaaatttatttaataattgtttattatttaaatgaaaatgtataaaattatttagagtttataaattaataaaaatattttcttactttatatcttcgagaataaaatttattcaaattcaaaaaacaatttgttggtgcatttcattttcctttgggtgtccttttggttggatcgcactgcggtgcccgcacgggtcacactcggtgtcaccacactgctcacaatgaccacccaaacatccggcatcaatgccaaactgccaccagtcagctacagcaaagcgatcgacatttggtgcggaggtaggccaatcaacagaatttaaagtctcattagcgagtctcggggcttctgacggtgcacccttctgaccagggaagggggaggagaattcacccagtgctatgacgttagtcaaaaacatcaaaatgggtgttagtcaaaaaaccatcaaatgaaaagattttttcatataactttgctcaaaggcaacgaaattttaaaatcttgttgtcattcgttagcgctaagtgttttctattattctgcaaaatttcaaaaaaatttattaagtttcagaaaagttatgaccaaaaatgttcaagaaaacctggttttttgagtttctcaggtcataacttttttgaaacttgatgaatttttttgaaattttgcatgattattgaaaacacttagggctatcgaaaaatatcaagtttttaaaatttggtacattttaggccaagttgtgaataattttatgtcacaaattttccatttgatggtttttcgactaacgcccattttgatttttatgaaatcctctttggtttttcttacaaatttgtttgttttctttttttttggcaaaaaaccgcgaaaactgctattttcgcccacagcgactattataattttgaaaatttacaacgggaaaaaaggctttgaattccccgattttttttcatttttaaattctccaattatcaaatttcttaattgaaccccagcaaataatttcccaacaaaaaataataaattcttaaaaatttattattttttgggcctttcaatgactttattaagcatgtttggccttcattttctcggcactgcttgagttcgcttgtgtcacctatatttcgtcacggatgttttataaaag

SEQ ID NO: 67767 - DNA, 279 bp, Heterodera glycines
  Genomic contig location: Contig_ID=SeqID_8350; Location=1133..1411; Strand=-
  SCN-specific regions: Sequence locations=1-123,145-248,270-279
atgacttttttggtaagaaaaaataagatatttcttgaagtattgtataaatctgacaggaaattgtatctaaagtttgaaatgttgataattttttctagagagcgacatttggcgaaaatacggatcaggatcaggactacggactaggcatccatacggactacagacttacggactaaaaacccggaaaacccttactccgtataagtccgtatgcaggaaaaatacggacccgtatacggatcagggttttttgaaaagtttttaatcaataaa

SEQ ID NO: 67768 - DNA, 656 bp, Heterodera glycines
  Genomic contig location: Contig_ID=SeqID_8350; Location=2269..2924; Strand=+
  SCN-specific regions: Sequence locations=1-371,393-656
atgaaatctattcactgtaatcagcttaaaattgagtataaaattatttcgagagaattaaacagacaaattaaattgttttataatgagaaagaaaccaaagttgtgccaaagggaaattcctgtattcacagacatattcgaaataaattggggcagaatgcttccttgcctccacttgttagctccaatggagtcattgttcatgaaaaagcggataaatgcaattacacttccttgtggtactccggtgaaggtctcaaactttttagaaaatgcgctatcaattttaacactgaatgatcttccccttaaaaaattagctaaaaaatttaatactttgccacctatacctatttttttgattttgcttaaaaacaattctattggaactgaatcaaaagcttttgcaaagtcaatatatattgtatcaacatgttcatcatttggattgcagaataaagattaaaaaatagcattattagcaatacttccatctgcaacacaatgcattgcggtcaaaatgtgtcgtgggccaatgattgatgcggtgcaaaatggttcatatgctgtctcattgcttgctttgtaagctttattttgcaaaatggttcatatgctgtctcattgcttgctttgtaagctttatttgttaa

SEQ ID NO: 67769 - DNA, 367 bp, Heterodera glycines
  Genomic contig location: Contig_ID=SeqID_8350; Location=3269..3635; Strand=-
  SCN-specific regions: Sequence locations=1-211,236-367
atgtttgccaaattgctgctgttattattcgtctgtataattggcaaaaaaatttcattatgcgaacaaattttgtcgccaccaacacaagattattcggaatgcggaatttcggactttgacccgttcaatgaacaacgaagcgcggaggacacggaaattagccatgtaattaaggagggaggggggatcaattatcattagataattgaaataataataaaggcatattttaatatttgttgatttttaattaggtcgtaaaaggatacaccgttgatgatgaccgcgcattgccatggatggccacattgcaacgccttgagggtcttttctaataaaagcataaataattaggagcaataaa

SEQ ID NO: 67770 - DNA, 79 bp, Heterodera glycines
  Genomic contig location: Contig_ID=SeqID_39122; Location=319..397; Strand=+
  SCN-specific regions: Sequence locations=1-79
tcattttcagtctgtccgttgaatacgaccatacgtattcacggcagccgttgtagtttggcatcaattcacccgcccc

SEQ ID NO: 67771 - DNA, 59 bp, Heterodera glycines; identical to SEQ ID NO: 52422
  Genomic contig location: Contig_ID=SeqID_39124; Location=255..313; Strand=+
  SCN-specific regions: Sequence locations=1-59

SEQ ID NO: 67772 - DNA, 734 bp, Heterodera glycines
  Genomic contig location: Contig_ID=SeqID_39126; Location=215..948; Strand=+
  SCN-specific regions: Sequence locations=1-112,139-672,720-734
atgtgccaaaaatatccaactccaaaactaagtgaccaattaatggttggcaaaatgcgaatgatttcaatggaaaaatgcattgaatatactagcaaagatagcaacaaagaatgtaaaaaataaataaattatggaaaaatgaattaattatttcatttagtcactaatttgtctaatgtccttccttttgtgaacaacacccgtgctttgttaactgaatttaattcagcacatttgaaggacaaactttgcgtgatagctgaacccagcttggctgagaaggtgtatttggaaatacgccattactcaattaatcaataaaactcaaggattaaaacacattagtgaattaaatgtaaaaattctcgaaatgaatttcggaaaatgctcttctttttatgaataaaacactttcgctgcacaaagaatttattatcgaaaactcgaaagataaaatttgtgtgatacctgaacccagcttggcggaaaagttacaataaacatcattaacattacttaaatcacttaatcataatttttttttcagggagacagcggtggccctttgatgtttaaaactggcaaaaataataattgggcacaagtgggcgtcgctagcacatcgacgtgtaacccggaaaagcccaaaagcaccgacggtcttacaagtaattatttctataaaaaaatttgtatcattatataaattatttttagtccaaaaagtttag

SEQ ID NO: 67773 - DNA, 357 bp, Heterodera glycines
  Genomic contig location: Contig_ID=SeqID_8351; Location=1304..1660; Strand=-
  SCN-specific regions: Sequence locations=1-10,58-127,149-208,231 -258,283-357
attaatgtcgaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgt

SEQ ID NO: 67774 - DNA, 3154 bp, Heterodera glycines; identical to SEQ ID NO: 8351
  Genomic contig location: Contig_ID=SeqID_8351; Location=1..3154; Strand=+
  SCN-specific regions: Sequence locations=1-92,145-556,579-846,884 -902,924-1040,1086-1087,1109-1255,1286-1378,1403-1430,1453-1512,1534 -1603,1651-1808,1832-1869,1891-1932,1955-2209,2242-2687,2742 -2791,2813-2822,2847-3154
  Gene Ontology: Mol. function=sterol transporter activity; Cellular component=integral to membrane; Biological process=intracellular protein transport

SEQ ID NO: 67775 - DNA, 998 bp, Heterodera glycines
  Genomic contig location: Contig_ID=SeqID_8352; Location=128..1125; Strand=+
  SCN-specific regions: Sequence locations=1-171,193-631,653-673,732 -753,785-919,975-998
  Gene Ontology: Mol. function=sterol transporter activity; Cellular component=integral to membrane; Biological process=intracellular protein transport
atgccagcagttcaaatgttctcgttgtacgcttcggtggcaattttgctcaatttcattcttcaactcacctgtttccttgcggttttcatttgggacattcaacgccaagaggtaaacaaaaacaccacggggaaaggggggggagaggacgcgcagatctgattgaaaaaatggccaaaaattttattagtcaagcgcctttgaacccgtcgagaaagagaaaaagtcatggtccataaaattgtctggctacatttaggggggggaggggtgaaattcctaaaaatgttggctaattttttttattttttacggctgaaaatgatgcctgtcattagctccaaaattctccttaatgtgtcctgcctaacttttggcgtctattttgtttaataaaaaaaattgttttctttcccagtccggccatcttgaactgtgcggtttttgtgtttcaccggtgccgttccaaccgacggacacggaaagtcggattgaacgatggatgcgcgattactatgcgccggccttgctctacaaattttcacgatgcgctgtggtaaaaattagaacaattttatgtaccccctggggagtttactttatttattaaccctcctcgaatggaggctttattttgggatttgggaaccacattttgggggtgcactccaattttttttgtttaaattaaaatttcaaaaagaaatatcttataaaaattttttattgtttgtccggcgaaatttacacaaaaaataaatatttgttattattattaaaactcactaacttttaagatttttttgtttgccatttggttttcactgtcttccgcaattatgaaccgcataagtgccggacttgatccaaaaattgcggtgcctgaggtacaaaaaaaaatgaggaaaggaaaagcatttaattgaaaatttaagataataataataattattattatttgttttttatttcattttgctaatatattatacaaa

SEQ ID NO: 67776 - DNA, 60 bp, Heterodera glycines; identical to SEQ ID NO: 52045
  Genomic contig location: Contig_ID=SeqID_39134; Location=508..567; Strand=-
  SCN-specific regions: Sequence locations=1-60

SEQ ID NO: 67777 - DNA, 154 bp, Heterodera glycines; identical to SEQ ID NO: 62241
  Genomic contig location: Contig_ID=SeqID_39136; Location=165..318; Strand=-
  SCN-specific regions: Sequence locations=1-154

SEQ ID NO: 67778 - DNA, 384 bp, Heterodera glycines; identical to SEQ ID NO: 66175
  Genomic contig location: Contig_ID=SeqID_39139; Location=987..1370; Strand=-
  SCN-specific regions: Sequence locations=1-20,51-384

SEQ ID NO: 67779 - DNA, 1152 bp, Heterodera glycines
  Genomic contig location: Contig_ID=SeqID_39139; Location=1..1152; Strand=+
  SCN-specific regions: Sequence locations=1-177,200-240,263-557,615 -827,849-871,905-1152
agcggtgtgtttgtgcttgctgctacgtccgtggccgtgatgagacgacgcggtagggcccgtgcttggcctagcacgtggcttaagactcaatgagtgtcagctcgggcaccgccagctttttctttttttcattatttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcggctcggctgtggggttttggtgtgcaggcgcgaacttgtggttctaattcgcgttttacggaccgtaactcgggcgcaccaatgcttcgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcatgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctttctgttcagtggcgaatggggcatttgcaggcggagtgcgctgagatgctcggagtagctgcgtgagctcggtcttgaggccagcctttcggggtctggtaccc

SEQ ID NO: 67780 - DNA, 1423 bp, Heterodera glycines
  Genomic contig location: Contig_ID=SeqID_8353; Location=2141..3563; Strand=-
  SCN-specific regions: Sequence locations=1-129,160-384,411-538,561 -807,850-987,1070-1229,1251-1291,1314-1392,1417-1423
atgtttttcattggtatcactgatctgttgatgataccaataagctcaatcatcactggatatttggccattaccggagcagttttctgtacagcgccgacattcatttatgtctgtggcgcttgtgcaataggtaaaaaataaataaatgtatttttatggcattgtgctgctaaaattgaatagtatcgacagttagcatatgtccagcataaattctcgacatttaaaataaaattaattgagtttttgtaggcctaacggctgttgagaacacggcacaaatatttttggcattgaatcgctgcattgatttggcatacggttatgcagcacgagtactgtttcatggcaaacgcatttatctgtggatgattttctgtgtcatctacggcatgtacttctgcatgtttacaatgccgatcattttctcaagcgtaatcggcacttggttcgtcaacccgcattttgcctacaacgatgacctaagcggcacaattgtatgagacaaaaagattacataattaggctaaagagtataattttctttcttatatttttgagcgattttgtacaagaagataaaaaataataattacgccatttttacagtatcgaagtgatttggcaaccatacacagttacatggtagtcactgtgctaaccggcacatatttggtctttgcgattgttctcctcaccaaaatgggctttaaatgtcagtcaaatggtttgatgaacgcaatcactaacaccaattcacaaatatcttcaatctcgcaaaaaaaggtagataattaaaaagtgattaatatttaatatatttcattgatttttatacaatttttaggttttcgtccaagtgtttttgatcagtatcatcaatgatgttgctgttacaatttgttctctgatgaattttttgccggtgggtaacactttgatcacacttggccaaatcacttggatgctttcattcggtaagcctttttataaagaaaaaatatttataaaaaacaatattattaatttaatatatttaatttttaatttcaataatcaaattttactcgatattctctgaaggtattccgccgttcatctatctgttgctgaacaaaacaattcgccaagaagtgattggcattttgcgcaaattgtgtagcaaattggtgccgaaaatcattagcaaaaaaattggcacaaaaactcaaatagcaattgccgtggtgaaagttgggccagcagaaaatgctaagcaaatgacaatcccttcgtcaacgagaaatgattaaataagaaacacttgaatattcaacccattttattatgatttgacacgggatttatatgtgccaaaaaccgaagtttttgaatctttcgattgatgaaatttcatttttaatgcatttttctaaataaa

SEQ ID NO: 67781 - DNA, 380 bp, Heterodera glycines
  Genomic contig location: Contig_ID=SeqID_8353; Location=6017..6396; Strand=+
  SCN-specific regions: Sequence locations=1-56,126-255,288-380
atgagctgtaagtgaaaaaccgtcctcatggattttgcgatgaccgagaattttggaaatttataatacaataaaaaaaaatttttttgactaaaacaaaaaagattaaaaaatgaattaatttaccttaattttatagatattttcctagactttattgcatattatttttacaattttggggactatgatcaatattttccaaaatgggttcactattaattaaattagtagatccattattattttagactgaattatattaaaatattgataaattaaattttcatgaacaagatttaagtgacgaaattttaatgtaaaaaaaatttaaacgaatataaaaagcataaaagcgaatctcagagatttacacggta

SEQ ID NO: 67782 - DNA, 56 bp, Heterodera glycines
  Genomic contig location: Contig_ID=SeqID_39142; Location=248..303; Strand=+
  SCN-specific regions: Sequence locations=1-56
atatattgtttgatagggccagacaagagaaggcaactgttggtaccaagtttgcg

SEQ ID NO: 67783 - DNA, 289 bp, Heterodera glycines
  Genomic contig location: Contig_ID=SeqID_39144; Location=650..938; Strand=+
  SCN-specific regions: Sequence locations=1-71,94-96,120-262
gtccaacgtaatgaggtggaacggcatggcctcccgttgacggacaaagagcacgagcagtgggaaacaatggccatcggtggtggtggtgctgatcagcaacagcagcaacagccgctgcaggaccatttggatcgactggcacgaagccgtgaagcgatggtaattgacggagagccgcagcaaatgatcagccatgacgagcatgggcagcccattggcatgacgacagtgcaggtgggggtcatcaacaaattcataattacaaattaaaaataagtaattttta

SEQ ID NO: 67784 - DNA, 329 bp, Heterodera glycines
  Genomic contig location: Contig_ID=SeqID_39145; Location=348..676; Strand=-
  SCN-specific regions: Sequence locations=1-329
atgtgtgcaggaaagataggcaggaaagatggatcagctaaaagtatgtggtggcatttggaaggattgcacatgaagagttcgtatgctgaaaaggaaatggagagcaaaaaaaggaaaaggtctgttctaaagggaacaaaggtttattgataatcttattattttacaggaattaattaagccattcattgtgccaaaaaaggatgccacaattgaagccgaagaacaaattgcccgaattatgatccgacaaaacaattattttctttttttttcaggataaggacctgaaagcgctttacgcaaaggcatatccgaatttgtag

SEQ ID NO: 67785 - DNA, 108 bp, Heterodera glycines
  Genomic contig location: Contig_ID=SeqID_39146; Location=361..468; Strand=-
  SCN-specific regions: Sequence locations=1-108
atgccaaccgcacttccaaatgcaggtcccaaattgcgtgatatgatgaaatatgctcctccgccttccacgacgccattggtcgccaccgctgacacactaatgcag

SEQ ID NO: 67786 - DNA, 476 bp, Heterodera glycines
  Genomic contig location: Contig_ID=SeqID_39146; Location=163..638; Strand=+
  SCN-specific regions: Sequence locations=1-190,212-476
  Gene Ontology: Mol. function=potassium:chloride symporter activity; Cellular component=integral to membrane; Biological process =embryogenesis and morphogenesis
gctaagctcggcctcatgctcggcgtgtaccttccgaccatccagcacattcttggcgtcaccatgttcatccgtttggcgtggatcgttggtgtcgctggcgtatcgcacacttttatgatgctcttcatttgctgtctttgtgtagctgcgtttttttaactcgattttttcacatgtccttcagacgttcctcacctgcattagtgtgtcagcggtggcgaccaatggcgtcgtggaaggcggaggagcatatttcatcatatcacgcaatttgggacctgcatttggaagtgcggttggcattctattctatctggccaacacagttgcaacttccatgtatttggttggaggaattgaaattcttctggtgaattcttccggtcaatccattgactttttatccgtaaattttcagttgtacctttatcccgggatgacaattggcggtaaaaatgcgcacacggacactg

SEQ ID NO: 67787 - DNA, 298 bp, Heterodera glycines
  Genomic contig location: Contig_ID=SeqID_39148; Location=138..435; Strand=-
  SCN-specific regions: Sequence locations=1-298
  Gene Ontology: Mol. function=potassium:chloride symporter activity; Cellular component=mitochondrion; Biological process=embryogenesis and morphogenesis
atggcctccaattaccaagggtttggttttacaccattatacgaaaaggaagaacccgcctcgttctatgtagacaaaaagaaaatcgaagaacgggttagtctctctaagccattcgcacacatttcattcattgtcgtcatttctgatacaggctaagctcggcgtcatgctcggcgtgtaccttccgaccatccagcacattcttggcgtcaccatgttcatccgtttggcgtggatcgtcggtgtcgctggcgtatcgcatacttttctgatgctcttcatttgctgcctttgt

SEQ ID NO: 67788 - DNA, 1688 bp, Heterodera glycines
  Genomic contig location: Contig_ID=SeqID_8354; Location=30..1717; Strand=+
  SCN-specific regions: Sequence locations=1-460,482-551,573-1231,1254 -1688
  Gene Ontology: Mol. function=hedgehog receptor activity; Cellular component=integral to membrane; Biological process=regulation of mitotic cell cycle
atgaattgcccagaggatctgattgtgggtggaattcgaagggacgcccagggcgttcaaatccgacacgccgaggcttttcagacggtttttttggttgcttctgctggcgatgtttaccaacgattaattgtgagggctttctttttttaatgtattttggttgcgttcaacaattacttttctttcagcgctccaaaaatcacagaatggaaaagttcggcgtctcctttacccaggctcatgccggtgctattattgcggcatggcaacgaaatttcaccaaagtgagtgaaccaatcgacgaacacagccaattctaattgttcagagtatttacgaccacacattgaataaacctgcccagggaattcgcgtggtgcatccgctggcctcaacttccatccaggacatgttggagcagttcagcgaattccaattcttcgtcatcttcatcggctacgtgcttatggtttaaaacggagaatgtcctctaattgtattttggttctttactaacagattatttacgctggttggtcccaagtgcattggcaggggtggtggttttcggtcaagtcgagttgtctgttggccattatcggtgtgctggtgatcactttggcatcggttgccggcctcggcttgtccaccgccatgaatattcacttcaacgcggccaccacgcaaattgtgccttttcttacactcggacttggcatcgacgacatgtttcttctgctgcacaactacaacgatgtgctggaagctgtccgacaaaaagaggtggcggtgttgctcaaagagactggtgagtcggggaatgcctcgggggtttcccttcttttttcgggtcacttttcgtctttcatcctttttctcgcttttctttcacctttaggcatgtccgtgctgatcacttccatcaacaatatcctcgcctttctcaccggttgcattttgccaatccccgcgttgcgttctttctgtggtcaggtggccattctgctcacctccaacgtcctctgcattattcttctcttccccgcgttcattgcgttggatttgcgtcgacgtaaagcgggccatcgcgacatgagcttcgccgcccttttctgttgttgttgcaacagcagttgttttatcggtggcaaaaaaggcggtggcattgaaaatggaggccaaaagcatgccaaaatgatggagggcggggcattcaaaaagcgaaaggtttttattatttaaattattttgtgacagttttgctcgtaatgtgacgacgtaagcaaagaaaagaaatttaagtaaaacaataaaaaatgaaatgcaaaataccaattcattttctgtttttgatccaacttttgccattctttcaaattcaaaggttttccatttgtcagttggaggagtgcagcagtcgcaaccaattggtgaagaccgactccacggtgaccacccattcctccgaaattgacctgcaacagatgagtgcggctgtgttcggccctccctcgtccggcccactgatggcaaatgtcaactttggcccttcctcctcaccaccttcggcctctaacaataagccggtcacttcttcagcaacaaagtcgttgcacaaatggtacacattggtcgggtttctccacggctattacattccgttgctcaggcggccaattgctaag

SEQ ID NO: 67789 - DNA, 80 bp, Heterodera glycines
  Genomic contig location: Contig_ID=SeqID_8355; Location=2340..2419; Strand=-
  SCN-specific regions: Sequence locations=1-80
tctccatatttttcattgttaaagttctttcaatttcgttgagctaaatgaccattaaaattttgtattttattcctaaa

SEQ ID NO: 67790 - DNA, 1881 bp, Heterodera glycines
  Genomic contig location: Contig_ID=SeqID_8355; Location=1..1881; Strand=+
  SCN-specific regions: Sequence locations=1-1633,1670-1881
  Gene Ontology: Mol. function=receptor activity; Cellular component =integral to plasma membrane; Biological process=signal transduction
tgctaattgcactggctggtggaaattccatgtccaaatgaattaataattcatttcatttccaggtttatgcgcacttggcttcactctctccaatcctctttggaccgtgctgctaaaattggcatttttcctgacgacgatctcaagaaaatggcggctgacgcgttggcacgcaatttcacactttcagacgactttctattggctagaaagttgctttgttctgctggacaacggtttaactgcacggaaatggtatggtttagataaattttaaattataccaccgacgggaggagaaggaattgcacttttttttgtgcgttaatttaggcccgagactctcgggccgagagtcaatttttttaattctgaattactttcttcaatattatacagcgcggtgctaaattgattgaggacggacggatcaacccacgagggttttacaattatttgactgcttggttctaccaagacaatatgatgtaatgccatttaatactttttaattcaaattcttcgtctttttgtgcaggtattacgtgtcccaagcggcctttttcccgacgcctttgccttggcatttttctgccgctgatgaaagcgttgtgccgcccgccgatccgcttctctactcgcaaattcccttttacatgaatggcctcaccgatacgcagtcaattgtccaaatggtaactatttgagataaaataaaacctttgaagcttacaatttatgggttaccccacatttgcgcctatgtctaaaatcggattcaaacctaattttttcataccaggtagcctaaacagcattaaaattatgaaaacacagtattttggtttattaggagcattaattctcttgttcgaatctacgggtttaattggcttttgttagatcaaagaaatccgtgccatttgcgaccggtacagtgcggacggtcttcctgtttacccttccggcattccattcacattttgggagcagtacctgaagctgactttttatttggtgtccgcgattttggttcgtttttacacccattatattatttgacctacttaaattaatttagattattggagttgctgttttgttggtcatttcgattataattgtaattcccgccacaaatgtttttccaaatacccattttccaagttcaacccttgggcagctgcaatggtggcgataatcgttgttaccatgacggttgagttggccggcttcatgggcgtattcggcgtcaaaatgaacccaatttcggcagttacgcttatcactgcagttggcattggcgtcgaattcactgctcacgtcgtcttggcttttttgacctcgcttggctcgagggatgagcgtatggtcgcgtgcttggtatgtttttgttttgccagtccaaatttggtatttaatttctctgggcttaggaacacatgttcatccccgtcatccatggcggactgtccactttgctgggcattgtgatgttggcattctccgaattcgacttcgtcgtcaaatacttctttgtcgtgatgaccgcattggtcatcatcggcctcatcaatgggttggctttgctgcctgttttactttcactaattggaccaccgtgcgaggtttgcctgtctcttttttctttctttctgttattaattttcctctcagatcactcctgtaaatggtagcaatttgttgccgtgtccggcgtctgaacggtatcggcccgaagacagtccgaactgcttcaccaccccttcgtccacccatcatcaacagtcggacgagcaaaagagacgacgagggtgtaaacggatgttagcggtggacgactcatcgtcggcatcgtccactgaagacggtgctggt

SEQ ID NO: 67791 - DNA, 339 bp, Heterodera glycines
  Genomic contig location: Contig_ID=SeqID_8356; Location=34..372; Strand=-
  SCN-specific regions: Sequence locations=1-339
atggcaactttggacgctgttgaggaaccgcttgacctgatccgactcagccttaacgagcgtgtttatgtaaagctgcgccaggaacgcgaactccgcggccgactgcatgccttcgaccaacatttgaacatggtaactaataatgggaattaatagttcatcggagaaattatgtcccgaagggggggggggaggcgacgcagtgactaccaacagcaacaatccccaaacaaccttcagattttggccgatgtcgaagaaacggtaacaatcactgaaacggacgaagaaacattcgaggaaattcacaaaccaagcaaaagaacaattccaatg

SEQ ID NO: 67792 - DNA, 1385 bp, Heterodera glycines
  Genomic contig location: Contig_ID=SeqID_8356; Location=534..1918; Strand=-
  SCN-specific regions: Sequence locations=1-63,165-264,286-696,718 -783,805-1039,1061-1202,1224-1273,1295-1312,1334-1385
  Gene Ontology: Mol. function=RNA methyltransferase activity; Cellular component=nucleolus; Biological process=rRNA processing
ctgttttctttaaaaacggtgaaaaggttagcggaacgtgcggcaaaagcggtgaagggaattaaagaagaggaggaggaaaaagagagcaatgatgaggatgacgatgaagaggaaaaggacgaagagaaagcaacgacaaaaatgaccaaaatggagaaggaatttgatgacggactaaacgaagcaattgaggaagaaggtgggaaaagcgaacccgacaagttgctatggccgaattgtttttcagatgaacataaattgggcaccaaaagcgcgaaaaagccgaagttaacgccggagcaattagcaatgggcgaggaaatgatttactcgaaaaagcgggcacaggacttggaggactgggcctggaataggttatttggcattaaaatgtttggtacattgttgtacatttgatcaggtacacaagcaacgatgaagcattgccggaatggtttgtcagcgacgagaaacgccactgtcagttggagcccccggtagacaaagtgagtaactaattagcataagccattcagagagaagctttttgaatttctctaattgcatttcaactaaaggaacgcgttgacttttacgcgaagcgagaacaacgcgaattgaacacaaggccaataaaaaaagtggcggaagcaaaggcacgcaaaagacaacggcgaatacgacgcatggaaaaggcgaagaaaaaggcggagggaattgtggacaatgagcaaatggagcatggggagaaagtgcgcgaactgcgcaggtcgggccaagaaattggtgatgttggcaggaattaaataactgcaggctatacaagaaggcgggctcaaatgagaaacgcaaagtgacgtaccaagtggtcaccaaaggcaaacgaggctcaatgagccgaccggacggacattatcgactggtggacaaacgaatgaaaaaggtggctgaaggagtcacaccaaacaaaccggggggagcggggctctacggtccagggctatagtaaagtgcttaattccatgattccataataaatctttttctaaaagtaagtaaggagcggtagcggaggctgtcccaaataaagagaattgaatcatatgaaaattcgttttttatttcaggatatgcgtaaacagtcaaaaactggcactaagaggacaaataaggcaaaagctaacacttttggacgaaaaggcaaaatgagagaaaagagccagaatcccaaagaaaggatgaacagtgagagaaaggacggaccgaaacaaaagagaaaaaatggcaaaaacggtggcactcgtcggatgggcggagaaaagagaaaaagtggcaaacccaatggcactcggatgggcggagaaaggaaaagaaaacgataa

SEQ ID NO: 67793 - DNA, 105 bp, Heterodera glycines
  Genomic contig location: Contig_ID=SeqID_8356; Location=1816..1920; Strand=+
  SCN-specific regions: Sequence locations=1-16,45-105
catcctcatcattgctctctttttcctcctcctcttctttaattcccttcaccgcttttgccgcacgttccgctaaccttttcaccgtttttaaagaaaacagct

SEQ ID NO: 67794 - DNA, 504 bp, Heterodera glycines; identical to SEQ ID NO: 60631
  Genomic contig location: Contig_ID=SeqID_39152; Location=130..633; Strand=-
  SCN-specific regions: Sequence locations=1-107,134-263,292-504

SEQ ID NO: 67795 - DNA, 234 bp, Heterodera glycines
  Genomic contig location: Contig_ID=SeqID_39156; Location=40..273; Strand=+
  SCN-specific regions: Sequence locations=1-234
  Gene Ontology: Mol. function=SH3-domain binding; Cellular component =lamellipodium; Biological process=actin filament organization
caaaatagtcagagtgatggacagttcgtcgacggacagaagccgagggatggacaacggcagaagagggaacggaaggggcggcttcggcagagcgaacagaggcggcggagggggcgcagcgggcggaagcggcgcattggcatttattgggggaggcggtggcggatttggcgagggccgaggcaggggtcgctttttccgaggcggaggaggcgcggggggagcacaaat

SEQ ID NO: 67796 - DNA, 341 bp, Heterodera glycines
  misc_feature (330)..(331): n is a, c, g, or t
  Genomic contig location: Contig_ID=SeqID_39158; Location=1..341; Strand=-
  SCN-specific regions: Sequence locations=1-341
  Gene Ontology: Biological process=growth
taacgaatgcgcggaacgttcactgaacacatgcgatgagaacgcggactgtatcgatacgccccaggggtacagttgccaatgctttgccggctacgtcgacgtgtcctcaaatgcgcatttgcccccgggcagagtctgcacaggtagaaaagccaaacttggcatgatgtgattggcctgcacattgttcaattgcagtgcagacgagctgtcccaagcagaggactgatctgatatttctgatcgacggctcgggctcaattgggtcccaagtgagcgcagagaaacgccgaataataatttgtgattggtttcgctcaattaagnngtggacctgc

SEQ ID NO: 67797 - DNA, 505 bp, Heterodera glycines
  Genomic contig location: Contig_ID=SeqID_39160; Location=400..904; Strand=+
  SCN-specific regions: Sequence locations=1-1,23-265,287-390,419-505
caaaagttttttacaaccacttattgccaatataatttcttgcagatttaaagctatccattgcctgccggttctcggcacagcaaagcactaatagggtgtttgactcacttcaaaaaataattccttacacaaaagttttttacaaccacatattgccaatctaatttcttgcagattaaaagccatccattgcctgccggttctcggcacagcaaagcactaatagggtgtttgactcacttcaaaaaataattccttacacaaaagttttttacaaccacttattgccaatctaatttcttgcagatttaaagccatccattgcctgccggttctcggcacagcaaagcactaatacggtgtttgactcacttcaaaaaataattcattacccaaaagttttttacaaccacttattgccaatctaatttcttgcagatttaaagccatccattgcctgccggttctcggcacagcaaagcactaatagggtgtttgacac

SEQ ID NO: 67798 - DNA, 639 bp, Heterodera glycines
  Genomic contig location: Contig_ID=SeqID_8358; Location=131..769; Strand=-
  SCN-specific regions: Sequence locations=1-2,160-613,635-639
  Gene Ontology: Mol. function=protein binding; Cellular component =axoneme; Biological process=eye photoreceptor cell development
atgaggaagaagaagcgaaaggcgaagaaggaaaatggaagaaaaaggagggaagaaaaagagaaaaaagaagagaaggaggaggaagatgaagcgaaagaggaggatgaagaggaagaggaagatgaagagaaagatgaagagaaagaggaggaagaaagggatggtgatgaggtattggcacagtgatgggaatgcgaattagaggagatcatcgccagagaaaaggccaaccggcaaaagtcggcgcaatgttttccctgagggcacttcctaatttaagaattgtttttttgataagcatttattttttaggcacattatgagagatttgtttatgctatcgtatgacaatattctttttcctgtttaccacataattagagacaaaaacttgattaatttatatgtgtgggtgggaattgcggggggagggaatttggagctgttgagtaaccgctcgcgcaactgataggttttgattggatttgggggaaatccctcagcggagggcaaccttttgaggttactcaatgttaaattagcactcattgaggaggaataatatcagagagagagaggaaaagaggcgcaattcggacaaagcgacgcgggggcaaaaggaaaagggcaattaaa

SEQ ID NO: 67799 - DNA, 1127 bp, Heterodera glycines
  Genomic contig location: Contig_ID=SeqID_8359; Location=573..1699; Strand=+
  SCN-specific regions: Sequence locations=1-66,136-1127
atggccaaacaaaagcgcaacgagttcagaattgagcgccaaaattcgtatggccaacaaaattgtgggggagatgaagcaaagagaggggggagaggaagcggaagagaagggggaggagcagggaagtggggacagcggaagaacaaccgagagggcagcgaatacaacgacggggagcacgacaacgccgtggacgagcccaacgacgcgggcgcctcccgcatgggcggcaaccaaacaatggtcactgccacagagaggttatatgggggggggggggaaactctcgacacttcttaactcacgaacatgctctaaagtggtcacttttgcgtctctcgcattaaactctctccctctgttcagtgcccccatactttcgccaattggatgaccattcgctctctcacattgtcatccccgcggggcgtacgctgaaactttcttgtgcgttggttggctttaaaacggtgaataattttaattaattgcatttgtcattttgctgaaggcaaagccggcggtcagcccgaaccgcaagtcgtgtggagaaaaggggacgaagagattctgaggaacagcgagagcagaacgggctcactgttccagctgaagaagtggactttggagttggaagacgccacggaagtgagggaaaagggcaaaaggaaaaaaagagaaaaacaatggccaaaagaacgacagcggggaatacgcgtgcgaagtgttcaactccgccggactgatcgtccgccgcttccgcgtggaggtgcaggaccgaatccgttcccggcccattttggtgccgaatgtgctgctgaaccaaacggtggacgtcaacggcaccgtagactttgcgtgccaagtgatctccgatttggttcctcacattgtgtggataaaactgatcaaaaacgacggcacttttattcgatgggacaccaaacggcgccagtacaccttcaacttcatggacatgagcacacacaaagtgcatataaggggagcacaaattgaagagaaatggccaaattgcagagaacgaggatattccacgaaaaacagtcgaacaaatacacaatggaaattgccaatgtgaccatggaggaccagggcatttactc

SEQ ID NO: 67800 - DNA, 1183 bp, Heterodera glycines
  misc_feature (195)..(195): n is a, c, g, or t
  Genomic contig location: Contig_ID=SeqID_39162; Location=256..1438; Strand=+
  SCN-specific regions: Sequence locations=1-797,859-909,973-1183
atggtcagatcagttcacgaaaatgtaccgaatgtggtttcattttcccaaatgacaactgttatgatgcgcaactccaacaatatatcaataatgagaatggggtaggacaaattcgccttgtaatcttcgaaaaggagcaagaataccgtattgtcttcaaggggagagggggtaatatttttttgttatctnaattaaaaaaaaacatttgaagaactgcagcgcaattcaatttatgtatcctgctagaacgaggacacttcaactatattggacgaattgcacagctcttcaaggttcctggatactgcattgactgtgaacggagagcagacgcgcgttaccatgcgattggttgcaaggcggcatgtcgtctttgttttcgattcgggggtggatacccgtgtcaacgagaacgggttttaatttgagcttatttttttcagttataaaatttttttagttgtctgatggtcagatcagttcacgaaaatgtaccgaatgtggtttcattttcccaaatgacaactgttatgaatatcatttggcgaatgatgcccctgctccaattgatgggcgcggacatagacaacggcgttcactttgtcaatggcgacgtttttgtcccacatgcggtcgtgttgcctattttggaatccatcaatgcccctcgatacgtcgtgctattgggccagttgattgctttcgttgcaaaggtccacatatgttggatgaaccttgctacatccaaccgattggtgttgcaccacctttaccaatgcttggtcctgttcacaacaacgacgacaacaacaacaacaacaacaacaacaacaacaacaacaacaacaacaatgaggatgaaaatgatattgatttcataatcaacaatctgggaggagaaggtgatgaagatgaagatgatgttgaaaacggggatgatattaatgatgatgatgatgatgatgagcgagatgaactgctaccacttcgtctttgcttcttcgatgccgaaacatcccaggagcgcccactacagcttaacaaccaagtcgcccataaacatgtacctttgctaatagttgctgaattcatttgtgaaccttgcattcgagctggaatcaacatcaacgatgggcaaggtcagcgcgcacccggttgcgtttgcctatgtggaaga

SEQ ID NO: 67801 - DNA, 200 bp, Heterodera glycines
  Genomic contig location: Contig_ID=SeqID_39163; Location=197..396; Strand=+
  SCN-specific regions: Sequence locations=1-148,172-200
agcttttccatctacaatctgtctggcacattgttggacgacgacgcaaaacggcaaaaggtattatgtatgtgaatcgagtaagaatgtattcatttgacgaaatcacgcggagaaaagtgccaatgaaagggcattttatgcggacatatattataatttaattaaattcacgatattgcgtctctgggtgtcattaa

SEQ ID NO: 67802 - DNA, 108 bp, Heterodera glycines
  misc_feature (15)..(15): n is a, c, g, or t
  Genomic contig location: Contig_ID=SeqID_39165; Location=556..663; Strand=-
  SCN-specific regions: Sequence locations=1-108
cattatgaacgctanaattatcagagtgccgaaaatcgcatgtgatctaagcctagcaaaaaaaggtgtaagtaaaaatcgtaactacgctcaaaaagcttctcaacc

SEQ ID NO: 67803 - DNA, 692 bp, Heterodera glycines
  Genomic contig location: Contig_ID=SeqID_39171; Location=111..802; Strand=-
  SCN-specific regions: Sequence locations=1-40,62-325,393-429,455-692
atgggacgaaaaagccgaggaaatggagagaatgaaactgatcaaaatttgcaagtgaaacaagaaagtacgataaattgtgaccaattagaacaattggaaacaaattttgaaaaattttttgacaatttttcaaatgaaattgataaaaagaaaagagaatttgtggaaaattttcaatgaaaaattggatggaaaaaggaaaaatgccaaaaaatattagcaaaacatttgggcatcataattagagattttagatgttaaaaatagggttgcgtccccgaccccaccccgaaccccgacatttttggccattttcggggaaaaccccgaccccgaaccccgacgcttccaaccccgacaaccccgaccccgaccctcaaccccgactcggggtcggggttaaatatacacccctaagaatggcatttttgtgggaaaaggcaaaaaagttataagaaatttgaattttgtctttgaaatgacaaaaaattttgaaattagaacatttcgccaattttaacaataaaattatctaaaaatgtaaatcgaaaaatgttcttcttcctgcatttgcatttttcaggttaatattacctatgaatttttctaatttagataaaatgtctgaaatatggtctttttataaaaaatcacaaacgtcggaaacggctttatgtcctttgtcataa

SEQ ID NO: 67804 - DNA, 1358 bp, Heterodera glycines
  Genomic contig location: Contig_ID=SeqID_8362; Location=371..1728; Strand=+
  SCN-specific regions: Sequence locations=1-380,403-872,894-1318,1348 -1358
  Gene Ontology: Mol. function=glycine transporter activity; Cellular component=plasma membrane; Biological process=alanine transport
gtctttgataaagaaaaagctgacaatgagcccaagggaaaagacccaacatggtttctcgtcatattgcttccgattgtcgctctcgtaagtggatgagtcatttgttaattgctgtgcactttaacaccttttcagaattccattgtgtccatgcgtatcctctcaattatgtgccttctcggaaatgtgttgatgatcaccagtttgacactcattctctttgttggtgttggcgttttttttcaatttatttcttttcactttcagatgctgtcccaaattgtattcacggaaagagctcattccattccgtttgccctgccatccgcagaaggctttttcaaagcgtgtggtaccatcattgtctcttgcctcgctcagtcattggtacgatgtcataatgttgataaagtagtcacttatcttcggttgtttttaggtgcttcctatggagaacaaaatcaaaaaacccagtcaaatgttgggaccctttggcgttttgtccggtggtatcgctatttcgactatcgtttacgcaattgtcggttttctcggctatagtgcttatggagagagccttcgtgatagtgtcttggaccatcttgaatgtgttaggtaagtgtggagttttgtgcatcattgtatagcaaatttcttttttcagtaacgcaaaagagttgactgttttgacttatatcattcggattgccctctgtctgtccatcttcgcttcttttatgctccaaatgtttgttatcgtcggcgttttgtggcctctactcgaaaaacggatcgaaaaactttctcgtatttggaaaattggcattcaattcatctttcgggctattttggtctccgtatgccgtgcgttttgttttccaatttaatttctattcacacatttttagtggccatttcttattccatcaataatttggccgctatcattcgtttgattggcgttaccaccggttagtcgtactcaattttcattcccaccaattcatttcgcaatgttttttaggcactctcctcgccttcgttttgcctgccattttcgaccttctcaccttcgtccctctttttcgcagtcagaatcgccttcgcgaagcaaatgttcggcttggcataaacattggtattatcggtttcggatttgtcattcttgttggcggattggtggtgaatgtcattacgatggctaacaaagaggaagattggaagtgcgctgcaaatgctacgactagcggaaatgtcacggcgacaacgcaatcgtacaccacaccgatttaattatcttaatcgcatttgcttaatatatattgtatgtatgtatatgtgtaatgtattggcta

SEQ ID NO: 67805 - DNA, 292 bp, Heterodera glycines
  Genomic contig location: Contig_ID=SeqID_8363; Location=680..971; Strand=+
  SCN-specific regions: Sequence locations=1-292
gtcgggacttatgggtttaaagggggcttaacgcctaagtaaaaaagcaaaaattgggtgggaaagaaagagacgaatgaaacggaaaagcatcagaatggctaaaaaaacgccaaatttattagcagaaaatttaaaagccgccttcgttttctctcagatggccccacaaatttcgaattgaaacatcggcacaaccaaagcatcgatttgtcctcttcactttcgctgttttctatgcccaaaattccgtttaacaacagcagacaaatgcccatttgtgcgcagtgtt

SEQ ID NO: 67806 - DNA, 1137 bp, Heterodera glycines
  Genomic contig location: Contig_ID=SeqID_39172; Location=173..1309; Strand=-
  SCN-specific regions: Sequence locations=1-192,216-358,380-824,846 -977,1004-1086,1129-1137
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattattgggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 67807 - DNA, 272 bp, Heterodera glycines
  Genomic contig location: Contig_ID=SeqID_39173; Location=698..969; Strand=+
  SCN-specific regions: Sequence locations=1-134,157-272
ggaccacgcgcccctttcactttcatttgaaatcactccgccgatcattcacaaaagctcaaaaataatcccccgtaaagcgaacacaaaatgagaatgacccaagacgcaaatttgagcactttttgtgcccttttcactttccttctgattgttgaaggaactttcggcatttttggcattggcagcagtgacaatgacacaacgacgacgacgacacagggagggggagggacatcgacgacgacggcaaaaccaaagggaggagggac

SEQ ID NO: 67808 - DNA, 432 bp, Heterodera glycines
  Genomic contig location: Contig_ID=SeqID_39174; Location=170..601; Strand=-
  SCN-specific regions: Sequence locations=1-279,309-309,334-432
ttcaatcggctagtgctttaaagttttgtctttgaatttgcttttttgtccatttatttcaatcggctagtgctttaaagttttgtctttgactttgcttttttgtccatttatttcaatcggctagtgctttaaggttttgtctttgactttgcttttttgtccatttatttcaatcggctagtgctttaaggttttgtctttgactttgctttttttccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttccta

SEQ ID NO: 67809 - DNA, 993 bp, Heterodera glycines
  misc_feature (943)..(943): n is a, c, g, or t
  Genomic contig location: Contig_ID=SeqID_39175; Location=287..1279; Strand=+
  SCN-specific regions: Sequence locations=1-194,216-357,382-492,518 -693,715-993
atgtttcgaagaattctcagtaacgctaaacgacaacgaatttatgtggatgatttgatccgaaatgctaaaattgaaccgaataagaaaaactatggaattgacgagttgagacaaattcaagagtatttgaaccaagaatttcccggaaaatttttaattgcggcttttacaaaggtaaatttttaagattattttttccccaaatatatttaggaatgggggataaaaccaatatacaagggagatggaccaaaaaaatacattgtttgcgtttttcatgagaatgatcactgggatggtaagcgggtttttcaattagattattacaaaaaaaaatttaggattaaaaagcgtaaaacaatttttcaacataaaacattattattgtatatattgtgaacagacattccgagaaaaaattagacacacggtcaactgtgtaattaaatgtcagcgttgtggcggatggggtattattttagggacgggtaataataatttataaaaatttttaggtttaaattttccatgtgaaaaagaagggcgtgagcccattgaatgtttaaaatgtaatcgacttttctttagcgatttctgttttcaaaatcatctaaaattagcttgcaaattatacagaaggtgtacattatgtgatagcgaatacaacactcgtaacaaacatatttgcggtaaaatatttcttttaaaaatgtttttttcacatgtttaggaataaaattctgtaacttttgcaaagtaaaacacgccaaatcagagagttgttacatcaagaaaattaatattcccaagaatttaccaagatatcgtattgttagctatgatatagaatgttcagtaagcatcgaaaaaagctaatttacaaatttttaaattgaatttagacggataattctttttccgagggaaaattcgagcatanagttgtctttttatctgctcgattcacgtgcagcgattgtgacaatgaaa

SEQ ID NO: 67810 - DNA, 106 bp, Heterodera glycines
  Genomic contig location: Contig_ID=SeqID_39180; Location=239..344; Strand=+
  SCN-specific regions: Sequence locations=1-106
tgtccgtttggggtactcaaacatttattggggagcaaaaatccaacgcagaattaaagtacagactatagggaagctattcccgaaggattcggtctccccataa

SEQ ID NO: 67811 - DNA, 517 bp, Heterodera glycines
  Genomic contig location: Contig_ID=SeqID_39181; Location=415..931; Strand=+
  SCN-specific regions: Sequence locations=1-144,184-320,343-393,415-517
atgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcggttcttatagcaaatattaatttatatttgcgtagcttcaaatgagcattctgccttcaatttcgaagggaagtgaatttttttataataaattgatagagagcaaaaagcacaattgtataatatacaaaaaatttatctatgcatttgttgaacgtttctaaacccgatcgaattttttaaacctttatatgaaaacatttattacaggaaatgacaaattccaacctgggagagcacacatttcagataagcttcctatcattatttctttagaacaactaataatctgttgaacagttatttcaaa

SEQ ID NO: 67812 - DNA, 595 bp, Heterodera glycines
  Genomic contig location: Contig_ID=SeqID_39181; Location=164..758; Strand=-
  SCN-specific regions: Sequence locations=1-2,25-161,201-350,372-595
aaattttttgtatattatacaattgtgctttttgctctctatcaatttattataaaaaaattcacttcccttcgaaattgaaggcagaatgctcatttgaagctacgcaaatataaattaatatttgctataagaaccgactatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggttttaaaatttgatcgggtttaggaacattcaacaaatgcatagataaattttttgaatattatacaatcgtgctttttgctctctatcaatttattataaaaaaattcacttcccttcgaaattgaaggcagaatgctcatttgaagctacgcaaatataaattaatatttgctataagaaccgactatttagtcaacagaaacaaataaatcataaaatt

SEQ ID NO: 67813 - DNA, 860 bp, Heterodera glycines
  Genomic contig location: Contig_ID=SeqID_8364; Location=2586..3445; Strand=+
  SCN-specific regions: Sequence locations=1-226,376-557,579-860
atggccattttttttctctctccccagcgccgtgatgccccataccgtcgaccggatccagccacaaagaaagccgatcccaaaaaagttcccgctcctggggtcaagaaactcctcacggaggtgctttctgagatcaatacccttagcgatgcgttgaacaagcacgcggccgaattttctcgtttcttccacttcatcgtgaaacaggcccaaattggtgaacaggaagatgagaaggagagacaggcgagaaaagcggaagatgagaaggagagacaggcgagaaaagcggaagatgggaaagaaaaacaggcgaagaaagtggaagatgggaaagaaaaacaggcggagaaggcggaagagggggaaaagcaaccggagccggctaaagaggattaagcccggggggagttttctgtcgccgacagaaaaaaaaatcggcggtgatcattgatcaccaactttgttaactttacttttttgccgtattcataaatttttgtcttaatgagagccactttttgaaattaatctgagaaatcccttaaaagtggtcatccatggttctttccctggccccttaatccgtttttccccattttttcttgtcattgatgtccaccatttgccccatgcgctcttcaacatgctcatctgtgcgaccgccccctttttggatccgcgcccaagcccaagaagaacccgtataaaagaacgaaggaagagccactcgacagaattcaatttcccattttaactgccatccaacagttatcaaacgatctttttccaaacgatcaaacgatccaattttcatcacacatttcaatttttcacatttttcattgcgtttttga

SEQ ID NO: 67814 - DNA, 1138 bp, Heterodera glycines
  Genomic contig location: Contig_ID=SeqID_8364; Location=3690..4827; Strand=+
  SCN-specific regions: Sequence locations=1-325,347-587,609-1001,1023 -1138
ggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgtggtcacaaataaaataaaaaatggctaatatgtaaaattggcgtccagaaatttttagactaatccgaagcaaagcacgaatgaattaaagaggcgaaagaattcacagtattgtttctaatagggaaatattgacaggatattcggctaaaaacgggtttgatcatttttagcgcatttttaggtatacatttgagacaattgggcaggacaagaaaagaatgaagttgatgcctcatgaaactcgtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagtggatgcctcatgaaaactcagaat

SEQ ID NO: 67815 - DNA, 378 bp, Heterodera glycines
  misc_feature (368)..(368): n is a, c, g, or t
  Genomic contig location: Contig_ID=SeqID_39182; Location=9..386; Strand=-
  SCN-specific regions: Sequence locations=1-5,27-95,165-378
atgtttattgttttgccatttgtacgagttgtcattgagtcgtctgcaaagggtattcggaaggacttttcgacactggactttttgacagtccgtataaaaaaatttttattttaaaataatttcatagttctatttaatttattttaatatttattttttaagatgacaatcctattaacttcatccagccagaattggcattttctcaacaaaaaatggatatcttatttatttgtcttgcttttatccgttcaagcaatgagaaacgtgctgttatttttgaattattatcatttatgcaaagctaatttgtaagaaatattttcaaaattgtaagaaggggtactaccttattaatcaaaaantataattaaa

SEQ ID NO: 67816 - DNA, 660 bp, Heterodera glycines
  Genomic contig location: Contig_ID=SeqID_39184; Location=94..753; Strand=+
  SCN-specific regions: Sequence locations=1-660
gttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttcgggagtagcttccctatagcctgtactttaattctgcgttggatttttgctccccataattgtttgagtaccccaaacggacacttgaaaaaatcgatttttttgt

SEQ ID NO: 67817 - DNA, 577 bp, Heterodera glycines
  Genomic contig location: Contig_ID=SeqID_39185; Location=455..1031; Strand=-
  SCN-specific regions: Sequence locations=1-43,65-577
atggcatttcaatctctgggactcaagccaccagcagcaattcaatctctgagactcaagccaccagcatttcaatctctgggactcaaccccccagcatttcaatctctgggactcaaatctccggcattccagacactgggactcaacccaccagcatttcaatgtcattccaatctctgggactcaccccaaccagcatttcaagctatgagactcaattctcaggctttccaatcgctgggactcaacccaccaacatttcaatctctgggactcaaatctccggcattccaaacactgggactcaacccaccaactttcattggcattccaatctctgggactcaacccaccagcatttcaatctctgggactcaacccaccagcatttcaatctcggtgactcaaatctccggcattccagacactgggactcaacccaccagcatttcaatctctgggactcaattctcaggctttccaatcactggaactcaaatctctggcattccaaacactgggactcaaatctccggcattccaaacactgggactcaaatctgcggcattctaa

SEQ ID NO: 67818 - DNA, 819 bp, Heterodera glycines
  Genomic contig location: Contig_ID=SeqID_39187; Location=38..856; Strand=-
  SCN-specific regions: Sequence locations=1-267,289-530,574-586,608 -642,670-819
atggctttattgcgttttaatgcggctaaatcatcgcgtgggaaaatcctgctaacaaatgccgggtttgagtatgcatttgaggtccaacaaactaatgtcaaaaatctgatcagtgattttaaggctttatctaaagtcaaagatgggtgggaatattggcggtgcccttgccgttctccttattgtcctggtcgtgcgtgcgtccaaatcgaatggcatcaagaagctgatggagtacagtataaattgggcagggttacaaaagaacacaaccatccggctacatttggtgctgaattggtacaaataaattgcttctaagggtataagacaaagttggacagattcgagtatcagctgaaaggcttcgccaagaagcaaggagcgaatacccaacttcaagccgaaatattgtcagtgacgtccgttcgaatttgcctcttaaagttcgagttgcgtctgcaccaggcccttcttgcatgagatggacatataattatcaccgccgaaagcaacaaatggcggtcaaaaaaataaaatatagaaaaaaattatttttattgtttatttgaggaaggcgacgctgggttggatgctgttccaacccatgatattgtaatacccgatcagttggttgatcgagtcatctacaaccaaaatctcaaaggaagccgaatgattattttctgttcacaatttgggattaacaccctccgggcctacagagacgaagtggcagttgatggaacgtttgaagttgttagaaaagtcggctgtcagataaatgtcgatttagacgagtccacgtggttttga

SEQ ID NO: 67819 - DNA, 383 bp, Heterodera glycines; identical to SEQ ID NO: 51114
  Genomic contig location: Contig_ID=SeqID_39188; Location=428..810; Strand=+
  SCN-specific regions: Sequence locations=1-20,42-275,297-383

SEQ ID NO: 67820 - DNA, 375 bp, Heterodera glycines
  Genomic contig location: Contig_ID=SeqID_39189; Location=177..551; Strand=+
  SCN-specific regions: Sequence locations=1-375
atgtccggttacgtgccgaccgtggcgatgttcgccgtcgctctgctgctccactgcttcgcgctgtcccgcgtgttcatgatcgtccacttcaagctgaacacgcacaaggatatgtcacccttgctgatggcgctgatcctcaactggacattgttctgccttttggtcatcccctacgaggtgtacagcatcgccaactggcgacccacccaaggcatgtactgttctgcagcattcactctctattgtcgtccgttgttgggagaagtccgagaggcaagagtcccgtcccgatctcctaatcaggctccatctcgggactttttgatttcgggaatcagttcgagagtgaggaagacccactatttttga

SEQ ID NO: 67821 - DNA, 168 bp, Heterodera glycines
  Genomic contig location: Contig_ID=SeqID_39189; Location=718..885; Strand=+
  SCN-specific regions: Sequence locations=1-168
accaatcaatcctttttggattttgcccattgtttcgtccccccttagagttgtaccaccccggcttggtgctgtttgtcatcgctttgccatgccatctctttcttgccatgatccccgtctcggtgttctttctcactttcgaccgtatctgcatcatttactatg

SEQ ID NO: 67822 - DNA, 650 bp, Heterodera glycines
  Genomic contig location: Contig_ID=SeqID_39192; Location=298..947; Strand=+
  SCN-specific regions: Sequence locations=1-136,176-394,416-494,517-650
atggacgcaaataaatgcccaacagcaaacatgccgataatacggggaacttattacggcaccagaagtaattcaattagataaacaatattttaaccccggggcggcggcactcatttcgcgtcaccaatggcacaaaaatagaaaaatatacttaaaaattataaaaaaaaatgttgggctatctttggcagtgtcggcacgaaaagatacaaaaaaacggaaagcgaatcatatgatgtcacgaaatatatgcttgaaaactacggtaacaaaaaaaaatgaaaaattagttcagcagattataagctggccgcgcgaaagtcgaaattttcagagacccaaatatatgtgccattttcatcaaatttgtgggccctcggttttttttaaatttcaaaaattttcaattttagttagggtctattcccgaccctggtcatctgtggcatatcaaaatcagatgagagtgccaattaaatgaatgagtttctgtttctatgattttttaaaaatctattgtctttttctctttcctgacgagcgtatttctcgccgacattttttaaagcggagtaggacaaaacgtcgtcagccgaaacgtcgtcgaacgaatttttcgaccataacttttttctttctcaaccaaa

SEQ ID NO: 67823 - DNA, 65 bp, Heterodera glycines; identical to SEQ ID NO: 54797
  Genomic contig location: Contig_ID=SeqID_39195; Location=176..240; Strand=+
  SCN-specific regions: Sequence locations=1-65

SEQ ID NO: 67824 - DNA, 279 bp, Heterodera glycines
  Genomic contig location: Contig_ID=SeqID_39198; Location=206..484; Strand=+
  SCN-specific regions: Sequence locations=1-66,154-279
atggggaatgaaaaacaacagagtcaagaagtgaaaacagattcaaaaatggacagtgagaacgggggaagaacggacggaggaaaagcggatggaggaaaagcggatggaggaaaagcggatggaggaagaacggatggaggaagaacggaccaagttgtgtcggagccgcacagattgacacgcgtttttgagaagaaaagaccgtgaaataaacccaaaccgagaagagataatatgaaaatgcaatatgtacgccaacagaagacattgttgtaa

SEQ ID NO: 67825 - DNA, 1822 bp, Heterodera glycines
  Genomic contig location: Contig_ID=SeqID_8369; Location=1516..3337; Strand=-
  SCN-specific regions: Sequence locations=1-384,419-733,755-1077,1099 -1195,1221-1452,1487-1562,1584-1698,1720-1822
atgcccataaaacggaatttttgccttatttcacaaaagccaaatggagactggactttcaaatcggaatgccgtcggtcggacgcgtctgcccccgacggtggcacctcaaaaagtggaactgttgaacatcgaggactacaagaaggaccggacaatgtgagtttataaataaacagttgtcattgatttcatccggaattggcatgggcaagttagtaattgtacattatcctcattttaatcaaaatgcaaaactgttgggattttcagggtcgctgttaactaaggctgggaatttattatgtcgaatgctttgctgactcgaaattgttctaaaatgactaaaaaagttttctgcatttttttgaagcttctaacatgtattttattttacttttgtattttattttacttttctctttcgggataactttggagcttttgccctactggttacgaatacgaaacccatttcgattgccattaaatatttccgtgctgattgattcattagcgtcccgctgtccattttcccatagaacaactgttgacgaagagaccaaaataaaatagcagaagggggaaacagaaaacggaggtcaatcgaaaggacttcataaagattttaaagatttgacaaattagtcattcttacattaattagctcaaaaattcaagaagaaagggtattgtgtctttcgacaaatctcttctccattagcctttaaaatttcaattttccgatagttttgcgaaacgatcaatggtctctccagtcgatgattcctcgggatttcacattctcgagactgctcctttttcaataaatatttggtccttgcaggataaccgccattctctacgaggaggaccacacagttggcaatgccctcaaacacatcatttgccaaatgtgagtatatgagcgattgtgttggtcttccaaacattttttgcgaacattttgccaggcccggcgtcgagttttgcggttacaacgtgccccatccgttggaggacaaaatcctcgtccgtatccaaacggtcgaaggggtggccgcgggggatgtgctgctgcgtgggctggaagatttggcacgcatttttgacaccatcgagcgcaaattcaaagcggcacatcgtgcggcccatttcggtgtcagtgagcgcatggaggaggacagaaacgaatacgaggaagaggaggaggagatgaccatttgaacatgggcaaacgacgcaaatgccatcgagaaatattacggggagggggcgaaagtggtggcatatttaaggggggatagaacggcaaatacactctttcacaatgaccccatcaactgctctttatcgccttcggcaatttgcatgtctccaaatgtttgagttcgtctgtttccttttcccaattcgttgcttttgtctgtcgttcccccagatttccacctcggattccatttttcctttttaaagttttatgtacgttctttcttcatacacatttatttgcttgttggttttttttgtttgttttccatttcagttttatctgtcaactgattttttaaactttatatcaaatacaatcccaattttggtgtttcaaattatctttgtttacatattaattttgtacttttttgttttttgtcccattatttaattgcccctcaatttgccccattttcagtatccatttctttttctgttcaatgtcttcgtttttcatgcatcaccagcagaagcggtcgtcccaccaacaagcggccgccgtcactttggcggacattcgctggatggaaccgatggccgcgactga

SEQ ID NO: 67826 - DNA, 56 bp, Heterodera glycines; identical to SEQ ID NO: 52733
  Genomic contig location: Contig_ID=SeqID_39202; Location=106..161; Strand=+
  SCN-specific regions: Sequence locations=1-56

SEQ ID NO: 67827 - DNA, 168 bp, Heterodera glycines
  Genomic contig location: Contig_ID=SeqID_39206; Location=371..538; Strand=+
  SCN-specific regions: Sequence locations=1-168
atgcagcaaatttttgtggacaatttgcccggtttccctgacaacatccgaatttcgcgcagcgcagattcattttatgtggcgttacctttccatcgaagtgaacagaagccacacatttttgacagacttggcccatggcctttggcaaggaaattcattggcgaa

SEQ ID NO: 67828 - DNA, 424 bp, Heterodera glycines
  misc_feature (32)..(32): n is a, c, g, or t
  Genomic contig location: Contig_ID=SeqID_39207; Location=1..424; Strand=-
  SCN-specific regions: Sequence locations=1-205,227-424
atgtcgaaacggatggatatgcccccgctggngtcacaaacacttgcaaaggcgcgattctcatcgcaacatccgactggcaagatgtacacaaactatgaccggaaaatgggcagtgaaaatgcgtcattgaatcaggatttttttaaaacgagatacggtagtagtatagtttgtaatgttaagcttaattaattacaggatatctgattttggaaattttccaactgtttaacttttttaactttcagaaaattgaattgaccaatttagaaatagatatagtttcgaaaaaattttttcgaaatacgaaattaatatgacgcattttcagggcgcagtattaatatgtattaataggggtgggattcttctaggattcaattcaaaggatgtccttggttggatccgttctcatgaataa

SEQ ID NO: 67829 - DNA, 557 bp, Heterodera glycines
  misc_feature (116)..(116): n is a, c, g, or t
  misc_feature (206)..(206): n is a, c, g, or t
  Genomic contig location: Contig_ID=SeqID_39211; Location=271..827; Strand=+
  SCN-specific regions: Sequence locations=1-64,101-315,337-434,479-536
atgccaggctgcggtaacaaatattatgaccatgtgaagcattgtgccatggtatgccaatatcatataatttgtttatttatttatttttacaattttaggtcaatttctatganaatgaaccggacaaaaatcctaaagaagatcctccccaatgacgtcgtaattaatgaatatttttgtgcccaattttttgtcccattttncgcactctcgcacttttttgacggatgcatcacccgggcaagcaaaaactgtacgggaaaatgtgaaaattgattacaatgaaacctttccaattggccaaatgctattggggaaaaaggcccccaaaacacttttgaggggaccgaaatccgaaaaacccagtttaaattcccaaaaaacccaattttttccccccccccccaagggggaaaatttttcaaaaccccaaaaaaaatttttttataaaaatttttataaaaaaaaaatttttcgggtttttatttttgttgtataagggggccccttaaaaaaaacaacttttttttgggaaaaattatatttccaaaaaa

SEQ ID NO: 67830 - DNA, 63 bp, Heterodera glycines
  Genomic contig location: Contig_ID=SeqID_8370; Location=356..418; Strand=+
  SCN-specific regions: Sequence locations=1-63
gttccgtaagaagtgcggcctgttgtccgacttttccctctcccccacggaatgtgaacggtg

SEQ ID NO: 67831 - DNA, 63 bp, Heterodera glycines
  Genomic contig location: Contig_ID=SeqID_8371; Location=388..450; Strand=+
  SCN-specific regions: Sequence locations=1-63
atgagaaaaaagatgtttgatagggccagacaagagaaggcaactgttggtagcaagtttgcg

SEQ ID NO: 67832 - DNA, 63 bp, Heterodera glycines
  Genomic contig location: Contig_ID=SeqID_8372; Location=243..305; Strand=+
  SCN-specific regions: Sequence locations=1-14,42-63
atgaatggagggagtataaaagatgatgatgatgacgagttgacgacgaaagcgaccaaaacg

SEQ ID NO: 67833 - DNA, 1179 bp, Heterodera glycines
  Genomic contig location: Contig_ID=SeqID_8373; Location=700..1878; Strand=+
  SCN-specific regions: Sequence locations=1-196,218-384,407-1119,1141 -1179
atggagcagcaggacggcctttggccactctcttccacggaccgatgccaaagccgagcgaattgcaatgccatcggagaaaacggcggactcgtagcattgagcggagaagagacagacgaatcgcagtgtacgacgccaaccgaaacactttcaccaattgtacgacgtaaaacgacggattcaaaagaaggcaccaaaatcagagaggaaaagagagcggtggaaggaacacatggaaatgtaaaagtgacggacggaattatgttggaaaaaaggggcacacaaagggcgacggagcggcaaaacgacgacgaaagggagacggacaacagagcaccgctggacagtccccgtagtcagaaccaacactgtacggatgtgctcatcccaacttcaaatcccattttcgccccgtgcgcccggcctttctttcacaacaaaatgccaatcttacgtccaaacaaaagaaatggaccatcactggatgagttacacttggccgatgggattggggccgaatgttttgctgatggaactcatggggaacggaggcgcacttctcggcatcaaattccatccgtttcaatggaaaaatcgaatctccccagcaacaaaaacacgtggcgcactccgtccagattgatctgcaatttcgaggaaagcattctcaacggacgcatcccagcaaatagtgttgtcagcgggtcgttgaaaaattaaatcaatgacagctgaacttcccttttagtttccgtctccaacttacggtcatcggtaacggagtgtctacggacaatcgcctttcattcccggcaagcaaacgcctgacattgccagtgcttacttacttcttcaacgatttgatgtctcaacattcgggacggtttccagtggcggttccgccttcgccgttgcatttggtgaaaaatgcctcgttggattggtccgactaaaacttttttccatttaggctcgctgcgagttggcggcggagacggtccccattccgaaacggtgcacactgcaaatagtgctcttacggtggttacttttcgtagttaccaaatgccactcatttccgtcggttcagtccgtgcggttcggtcgttaagctgttcatggtcgcggtgaatgtgctcgacatgccttccaattcgaggacggtgagcaaaatga

SEQ ID NO: 67834 - DNA, 296 bp, Heterodera glycines
  Genomic contig location: Contig_ID=SeqID_39215; Location=31..326; Strand=-
  SCN-specific regions: Sequence locations=236-296
  Gene Ontology: Mol. function=protein binding; Cellular component =actin filament; Biological process=actin filament-based process
atcatcgacaccaccgccaccaacaccaacgccaccactagcaccgaccccaccgccaccaacaccaccagcagcagcaccgctaccaccagcaccaccagcagcagcaccactaccaccagcaccaccagcaccagcaccaccaccagcaacaccacatgcaccatcagcatcaccagcaccaccaacaccagcagcaccatcaacaccaccaccaacaccagcaccaccaccaacaccagcagcagaaggcgaagaagcattggaaaatgcaacagacgaaggagcatcgacta

SEQ ID NO: 67835 - DNA, 561 bp, Heterodera glycines
  misc_feature (6)..(6): n is a, c, g, or t
  Genomic contig location: Contig_ID=SeqID_39216; Location=43..603; Strand=-
  SCN-specific regions: Sequence locations=1-14,37-233,255-345,374 -504,543-561
atgccnaattcacaatttcattattattattttacatggatgccacctcatgggtgggttgtgtggggttgttcatgttgaatgtgcatgaatgaatgtgtgggatggcatattttatgtgtaagtgggcaaaatcagtggcacgggcaaaagctgcacataaaaaaaagaagcgccagcgcaatgaatgcggcgcagcgcagcgcaatgccatttttattttagcaaatgctaacaaaatgattaatttttaatgaataaaattgttgaggaaaagcattcattcatttccttctatcatcttcttatcctcaattcgatggaaaatttcgtaacatcaaaatgatttttaataatttttttgaattttaatcttttcaattcttctttacgttattttaaataagaatttatatacaattcattgaaatgctttttagtaattaagtggaataattaattaattgaagatttgatatgtttatttgagcgataagattaatcaaatattaattaattgaaaataatttcttttaattttagataagagtttaaaataaa

SEQ ID NO: 67836 - DNA, 71 bp, Heterodera glycines
  Genomic contig location: Contig_ID=SeqID_39221; Location=1..71; Strand=-
  SCN-specific regions: Sequence locations=1-71
aatcgaacgctaacggacgacctaatggaaaaaaatccccgaaggagagaatttaattaaatccattcctt

SEQ ID NO: 67837 - DNA, 89 bp, Heterodera glycines
  Genomic contig location: Contig_ID=SeqID_39221; Location=910..998; Strand=+
  SCN-specific regions: Sequence locations=1-89
cggacgaagcagcaaatttggaccgagcggaaaaattgctgacccggagggggaatgctaagaacttcaacagaatgggcgagaatgtg

SEQ ID NO: 67838 - DNA, 2246 bp, Heterodera glycines
  Genomic contig location: Contig_ID=SeqID_1102; Location=1261..3506; Strand=+
  SCN-specific regions: Sequence locations=1-890,912-1346,1368-2246
atgatgatgaaagaagaagaagatgaagaagttgaaagagcaagaaatgagaacagagagccagccgagatcaagcttttgtttgagaccggaaggcaattggacagacgcttggggtacaatgtacctcgagcgaatgaagttgctgcagtttatgtacctggggctgacggtgaagtacctaatgccaagattgtggtgagagaacgtggaaaggaattgaagattttgaagagtacagattcaatggtgactccaatgacttacccactgttttatccgcgtggtacgcttggttggcaccctgaaatgaagcatagaaatagtaatagaagagtaacgagattacaatatgtttcctatacagtcgcaattagagaaagagagtttaacccaattttgtacggtggaaagctctttcaacagtattgtgttgatgaatatgttaagattgaaggagacagaatgaattggataaagtgtaatcagaaaaagattttggctgatgcatataagaatgttgataatatgttaatgagaagagcagaagaaagaggtttgccactgggtaggaaggtcattcttcctccgagtatgacaaacagtccgagatatgttgagaagcattttcaagatgcgatggctgttgttagacggtttggtaaaccagatatgtttttgactatgacatgtaacccgcaatgggaagagatttcagagaatttgtttcatgaacaaaagtcaagtgatagaccagatttggttgtcagagtttttaatttaaaagttaaagctattatgaatgagatagtcaagaaaaaggtttttggagaagtgattgcatggatgtatccggtagagaaccaaggacggggactaccgcacatccatttgcttttgacattggcggagcaagacaaattgattaatggtgaagatgttgaaaagaaaggaattagtgcgagaataccggacaaggaattagaagcagaactgtttgatttggtgaaaaggtttatgatccatggcccatgtggtaatttgaacccaaattgcccatgcatggaagagtttgttgacaaaaatggtatgaaaggaaggaaatgctctaagggataccctaaagcatttcaagaagagacagttgttcttgaaaatggattggctttgtatgcaagaccaaatgatggaagaacagttcaaatatttgcaaatggaagaagacatgaattagacaacagatgggttgtcccgcacaacctgtacctgttgaaaatgttcaagtgccacattaatcttgaaaaggttaatagtgttagttcagtaaagtatttgcataagtatgtgcataagccaccagacagggcaagactggaactagaagagagaaatgatcatgatgaagttaaagagttcattgatgcgcggtatgtttgcccgcaagaagcagtgtggagaatttttgaattgcctatgtatgatagaagccattgtataatgtccttgcctgtacacctacaaggtgaacatatttgttattttgacgagaatatggaagaagaagagattcgtgaaagaattgcgaatggttctgagttgatggcatattttgaattgaataagacaaatgttttggcaaaaactatgttttatcaccagatacctgaaaagttttgttttaagaaaggaaaatggacagagagaaagacatattttaacacaattggccgaatggtgaaggtgtcaccggctgagccggaacgataccacctgaggctgttgttgttaaatgtgaagggagcatgctcctatgatgatttgaaatcagtttttgatactaatggcaatgcaaaagtttgtgaaactttttcagccgcatgtttagaaagaggtttgattagaaatgatgaagagtggaaaagagcattagaagaagcagagagttttgagatgccatggaaattgagagcgttttttgcattgattttagtccattgcaatccggccaaaccggaagagctttggaatatgtttaaagactcattgtctgaagattttagaaggaattttagaaaagaagtagcttatgctaaagcttatagagaaattgcacttagcattattaaggctggaaaaacgcttgccgattttccaaccatggaacagataaatgttgatgatgatgttgaacaaatgtttgacctagccgaagaattggatttgggacaaagaaatttatgcttgat

SEQ ID NO: 67839 - DNA, 1653 bp, Heterodera glycines
  Genomic contig location: Contig_ID=SeqID_1103; Location=242..1894; Strand=+
  SCN-specific regions: Sequence locations=1-18,40-328,360-430,452 -499,521-652,675-676,699-1026,1050-1653
  Gene Ontology: Mol. function=ATP dependent DNA helicase activity; Cellular component=nuclear telomeric heterochromatin; Biological process=DNA replication
atgccatggaaattgcgagagttttttgcattgattttagtccattgcaacccggccaaaccggaggagctttggaatatgtttaaagactctttgtctgaagatttttgtaggagttttagaaaagaattggcttatgctaaagcatataaagagattgcacttagcattatgaaggctggaaaaacgcttgccgattttccaaccatggaacagataaatgttgatgatgatgttgagcaagtatttgatttagccgaagaattggatttgggacagagaaattatgctttgatgtatgatgaacagaggaaaattagtgatgaaattttgcatagaatatggaattctgtaaatgaacctgcgttctactttcttagtggaccgggtggaacaggaaaaacacatgtgaataagacaattgtacatatgctgagaggtcagaagaagaaagtttgtacaatggcttttactggcatcgcagcaactttgctgcctgctgggagaacattgcacaatagatttggactgactttggatatgagtaattcgagtattagtccgagatcaagagtttggcaagaattgaaggaaacagatttgtttatttgtgatgaggcgcctatgataaataagcgcgcaatgagaactttggatgagaaattgaaagagataatgaataatggaattgcatttggtggcaaggttttgctctggacgggagactttcgtcaaacccttccgattcagaaacatgccacgagagctgagatggttagttcaaccataaagagaagcgagtactggaggttggctaaaagatataaattgacgaagaatatgagagctcttgcaacagagcaagaatttacgagagatttgttagagattggcagtggaaaatggaataatgaaaacgatgagataattttgcccgacaattgtattagcaatggtgatttagcagaagagatttttggtcaatgcattgtcttagaaaattggaatgaaatggccaaaagtgccattttagcaccgaagaatgttgatgttagtgaaatgaataataaagttttagaaatgttgtctggagaagaagttgtgtataccagtatagacttagctcaagatgagaatagacaaagagccgatgattatttggatgagtatttgaatgctttaaacccttcagggtttccgcggcataagttgagactgaagaaaaatgcaattgttttgttaatgcgtaatttgaatatagaaatgggcctttgtaatggtgcgagaatgaaagttgagcaaatgcaaccgaatttgattgtgtgtaagattttgactggagacaaggcaggtcagactgtgtacattcctcggatcacgctttgctgttctgaagattacccttttgacctgcataggcaccaattcccgttggtgttggcttttgcaatgacaattaacaaagcccaaggtcaaacccttgagcaagttggaattgatctgaggaaagatgtgtttagccatggacaattgtatgtggctctttcgagagcaagagcttggaataagttgagaattagattagatgatggcaacttagagagaaaggtgaagaatgtcgtgtacagagagttattagataacagtgattag

SEQ ID NO: 67840 - DNA, 795 bp, Heterodera glycines
  Genomic contig location: Contig_ID=SeqID_1103; Location=2919..3713; Strand=+
  SCN-specific regions: Sequence locations=1-278,300-795
atgcaacaagaactcatcaatcaggccaccgctgcaattgcgctttgtcataaaaagttcaggttcagtgggactcttcaagaggtttgtgtagatggtacgacatgtttcatctaattcaaacatcgacaatttagctcagcgcacagcgacttcttttggtttctcaggagcgccttgcgttgctcaaccgtcaaatggaccaattgaacgaacagcgaattttgaccaatttgtccgtccagcagttggacgatattccggaaagtgtggacttcgacaatgaggacgaactggagagtgtcactcctttggcgcgctgcactctctacattgacaagatagtgatcttttgactaattttcgaatcccggacgcgaattcgagcaaaaaactcgaaaactcaaaattcacttttatgttcatagctgtacaaaaatttgggtccgggattcgaaattaggtagtcaaaattgaatgtcggattcgggttacccgacacataaaacccccatgaacatgttttcacgactttatagaacaaaaaaatttttcctcaaaaaagggggcctaccatctatagtattaccgcaaaaattgtctttttttggtgaaaatctgttaacaaatcaacgaaatacaaaaaattttccggcgacgcctatcggcaccgccggacccccttcccccgcccgttcacctaaagttttttgaaaaaatgcgccgcaaaaaattgttaaaaatctgattttttgatactgacaaatcagtgcacagctattcattgtttctgga

SEQ ID NO: 67841 - DNA, 2757 bp, Heterodera glycines; identical to SEQ ID NO: 1106
  Genomic contig location: Contig_ID=SeqID_1106; Location=1..2757; Strand=+
  SCN-specific regions: Sequence locations=1-648,670-1079,1102 -1176,1198-1311,1333-1355,1377-1458,1558-2011,2033-2163,2185 -2450,2472-2603,2639-2757

SEQ ID NO: 67842 - DNA, 234 bp, Heterodera glycines
  Genomic contig location: Contig_ID=SeqID_8374; Location=20..253; Strand=-
  SCN-specific regions: Sequence locations=1-234
ggtgcaccaatatttgagtaaattgcgccaaaaatgctagtgctcgcctaattctaagcctctgccacgcgttcagcatcaaataagcatcatcgacaccgagcgcaagcaccaaaaagggcgtaacacaaagcagtgacccttttaattgggaaaatttaaaaaaaacgacaaaattaaaattaccgaaacgaaagccgagccaaaacattcagccaagggctgtgcctgttg

SEQ ID NO: 67843 - DNA, 387 bp, Heterodera glycines
  Genomic contig location: Contig_ID=SeqID_8375; Location=517..903; Strand=-
  SCN-specific regions: Sequence locations=1-387
gaacgggccaactccgtctggccaactccgtctgagccaactttgagttaatataactcttgaagttattgaccgaatcaaacaatcttgatatcattcgaaagctcttcacaggctctattagcctactaaaaagtacagaaaatttcgaactataaaaaaagatagaaataaaaaacttcgaaaattctgccttttttgcggttttaaactgacaacttttttgagagctgattaatcactgagaaatagcttataaatatcttctaaacatctagggctttcgaatgataccatgattgtgaagtttggccaacaaagaaaaaagttatagttttttgaacattgctgagacggagttggccagacggagttgacccctaccgt

SEQ ID NO: 67844 - DNA, 286 bp, Heterodera glycines
  Genomic contig location: Contig_ID=SeqID_39223; Location=253..538; Strand=+
  SCN-specific regions: Sequence locations=1-31,60-93,139-286
atgattgctcaatctgtgccgaacattggccattattatgatgaagaggaagtgatggaagacgaggaggaatattcatacgaagagattgacgaagaggaggaggaagaagaagaggaagtggagaaggaagagaagcgaacagtcgccgcaagggcactgccagcggcgcaattggcggagggcggcggacagaaccgcactgcccagggcaatgatcaactttgccatttggcggatgagtgccgcaggcaatttctgaatatattttaaggggcaattccca

SEQ ID NO: 67845 - DNA, 903 bp, Heterodera glycines
  misc_feature (30)..(30): n is a, c, g, or t
  Genomic contig location: Contig_ID=SeqID_39224; Location=21..923; Strand=+
  SCN-specific regions: Sequence locations=1-227,252-296,319-484,506 -708,731-800,823-903
atgttaatgattcccgaggcggaatattgngctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaaggcgtacggtaaaggggatacttgaaaatagaccacagaaggtagtgattgagaatcatgtaccaggtccaaatgttgcaccatatctgggcctcaataaccaatccaaaccacaggagaccgaagaaccacggaaaataattattcctaggaaaagacttaaagagcaaactcctgatcctgaatcagataatgatacacttgaggagttaactccggagccccaaacaacatccacactcaaaacacccgttccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattttaatttaaaatctccggcaagttttgctggaattcaaaaaattttaaatgaggccaaaaagattgacccgaaaattacgaccgatgacgtta

SEQ ID NO: 67846 - DNA, 707 bp, Heterodera glycines
  Genomic contig location: Contig_ID=SeqID_39226; Location=36..742; Strand=-
  SCN-specific regions: Sequence locations=1-66,88-629,652-707
atgggcgaggatgtggagcggcttgacatggtccaactgttcaacacaatgcgccaggagcagcggttggcccaagcgtttgcccaaatgggcctaagggtttggaatatttttttcaaaaaaatcccaatttttggcatttttccagcgcgactaccagcccattctgcacctgatggacttgtcggaggagaaaccgggcgcatacgcactggactatcgcgaggcgaacccggaatggctgaacaatctggacaaggacaaggtggacgaagggattggaacgggttcggaattggaaaaaaaatttcagaatgggggaaaacccatttttcgggtctcatttttttattctcattccgttgattgccataaataggaactgcccaggcccatatccagaaaaaaatttcggggagggcacccgaagagctttttttttttgctcttcgggccaacaaaaattttttgcaccagtgttatgttgaaattcttcagcgccggcgccaaaaaacaggaattattatcggttttgcgccgaaaaatcacaaattttccattttgggctcaaattttcaaaaaattatgatccaattggggccccggcggtgccgataggcgccgccgggaagaatttttggaaaattaaatgcaatatgataagaaaatgtgtaaaattttcagaaattttgcccttttttgcttga

SEQ ID NO: 67847 - DNA, 996 bp, Heterodera glycines
  Genomic contig location: Contig_ID=SeqID_39229; Location=119..1114; Strand=+
  SCN-specific regions: Sequence locations=1-329,351-763,785-786,808 -813,838-866,893-996
  Gene Ontology: Mol. function=microtubule binding; Cellular component =cytoplasmic microtubule; Biological process=vesicle-mediated transport
atggaaaatgaaaatgaaaagagcaaaatggtagcaacaaataaagaatttatagcagtgatagaaaaaataaaaagcaaaaaaacaattacagcgaaagataaaaaagctctgcaaaatttgtgtatattcaacaaattgtacataaagcataatggaacaattgaaggaattgcaacgaatttggagcaaaagatcagcgaacaaaagaagaagcagcctaagctaatggaaaaaatagaaaaaaagttacatcttaaaacaaaggaagaaaaacagttggaacaagtgaaaaacatccagcaaaaattgaagggcattgtggacaaaattcatggaattgaaaaaagttcaggaacggatttgtgggatattgcgaaagaattttgtgctgaggaagaaagtggaaaagaaaaaaaggtggatgaacaaaataaagaaataattgagacaaatgcatcatcatcatcatcattatcggagccgaagcaaaaaaagagcaaaacgaaaaaagaggggacggcggacggaggaaaaaagagaacacatttattgggtaaaattgaccaaatactacatcatgaagaaacggatgaagaaaagctgttaaatgaaataaatcaaattgtaacagacaattttatgaacgaatttgagaaagcaaaaaaggcgtatcagaatgaagcggatattaaagaagccgaggaaaaattggagcagataaagaaaatccttaaaattttgaacaatgaattatttacactaaataaaaaagaaagccaaattagcacagaattagaaagcattgaaacagaaatggaaaaagtgggaaagaaaattgcagatttggacaacgaaatcacaacgaacacagaaaaagcaaaaagacaggcgaaaatcatttgggaagagctcaaaaaaatgaaagagcatttcgccaagaaattggaggcaaacaattcaaatgttggagaaggcgccaaagaaaccgcttga

SEQ ID NO: 67848 - DNA, 635 bp, Heterodera glycines
  misc_feature (69)..(69): n is a, c, g, or t
  Genomic contig location: Contig_ID=SeqID_39230; Location=771..1405; Strand=-
  SCN-specific regions: Sequence locations=1-135,157-417,440-635
atgaaggcacagtcggagttgcgcagaatcacttcttccgcctcattgcattggcccatcggttgcctnaataattccgagagtcagtcgattaattttcctatcgaactgaacaacggctgccccttttagatgttctccatattctttattctttatcccattttcttcccacgaaaaagtgattcttgaaaatccatggacactgctgcttaagacccctcccattagcaatgcccccaagggtttttcggattaatcatagaaatcaacccttaataaaacataaaattcatacttttagtgcaatgtttctcgcattgcgattttgcagtgcgaattgtgaataacccaaaaagtaacagcgaaaatgaaacgacggacgaattcatccgctgaattttaaaacaaaattatgggaaaatgaattatagttttacaaataatggaaatacctaacattcaagaataagtgtttggttatatcgattttggccttttataagaaaatttttgagggaaaagccacgtcaaaatgccctttctcttgacgtggtgccaaccgcagaaagagggcccctcacaccaaaggagaagctaatacattatggaaaagcaatgaatagtgaaataaa

SEQ ID NO: 67849 - DNA, 392 bp, Heterodera glycines
  misc_feature (324)..(324): n is a, c, g, or t
  Genomic contig location: Contig_ID=SeqID_39230; Location=1014..1405; Strand=+
  SCN-specific regions: Sequence locations=1-236,258-392
atgaattcgtccgtcgtttcattttcgctgttactttttgggttattcacaattcgcactgcaaaatcgcaatgcgagaaacattgcactaaaagtatgaattttatgttttattaagggttgatttctatgattaatccgaaaaacccttgggggcattgctaatgggaggggtcttaagcagcagtgtccatggattttcaagaatcactttttcgtgggaagaaaatgggataaagaataaagaatatggagaacatctaaaaggggcagccgttgttcagttcgataggaaaattaatcgactgactctcggaattattnaggcaaccgatgggccaatgcaatgaggcggaagaagtgattctgcgcaactccgactgtgccttcat

SEQ ID NO: 67850 - DNA, 678 bp, Heterodera glycines
  Genomic contig location: Contig_ID=SeqID_8377; Location=1243..1920; Strand=+
  SCN-specific regions: Sequence locations=1-285,334-346,368-634,671-678
atggctaccatgggtaggatggtggtagcatttctaaccaccaactcccgtcaaatgaccatgaactacgttcttattgacagggtaaaaaagagggtcatggtcatggttaaatgaccaccaacttcgtggttgtttgaccaaagttcgtggtagctcttgttgaccgaggtttaccaccaacttcatggttttttaaccattaccaccttcttattgaccgggccccgttctctagttttttccacataaaattgttccatattttgacggttgaacattttgaaaatttatcattaaaaaaatattttttttcttaaattagaatttttacaggcaaaaattgattgagtcatttcaaaaataattccatttccaccgtaaccccaattaaaattggtcacctaccgtttccgctctgttcgaatgcttcgatattttcatcattcagcgattcttccgtcctttccattcgttgcaattttgcgattctcgcctttagaaatcgtaattcgtcggttatttttcgtttagccatttataaatcttaatttgtaaccaatcttaaaaatggagggaaagtaaagttaaattagcatattacaaatagaccaatttattctctaaatgagtttactttaaatactgttaaaatttattgaacaaaaaatatagaga

SEQ ID NO: 67851 - DNA, 525 bp, Heterodera glycines
  Genomic contig location: Contig_ID=SeqID_39232; Location=517..1041; Strand=-
  SCN-specific regions: Sequence locations=1-306,343-525
atgcatttaatttggttttgcatttttgccaattgcttcttacatcgaaacggtcacgaaacattcgccatggccacgctgatcgataattggacgaactgtagtgataaaaagcccaatttggagtgtgcattcccaaggcatcagccaaattggccggtggttcaatcgatagatgacgagttaatggcttaatgtaattaataaccattaattaatggcttaatctaattactgggtaattaatcccaaatccatagataaatctttaattaaaaaaaggaaagcttcacattattaattttcaattattaaggaatttaaaaacattttaatgtttaatttgtagaagcccgtctttaaaaaaagtctcgaggtcggaaataaccctaaaaataaccaaaaagttcggtgtcgggatttcaaacattgctgaaaacaatccttacattatacttgtagttatgttgacagactcaacattcgaaactctaatgaagaggtaaaatatcataatgaaataaa

SEQ ID NO: 67852 - DNA, 221 bp, Heterodera glycines
  Genomic contig location: Contig_ID=SeqID_39232; Location=1239..1459; Strand=+
  SCN-specific regions: Sequence locations=1-72,112-160,183-221
atgtacaataagcacttctctgtgcagcccatctacagaaatgtgccattgaatgtgccatcgcacagaacgtaaaaaatatttttttaaaatgaataaatttcttatttagcaatttttccaaccaccaaagagctgggtattggtcatttgactacgattatatgtaaattatatgtataatgaaaaagtgtttagttaattaattaatggaaccacca

SEQ ID NO: 67853 - DNA, 287 bp, Heterodera glycines
  Genomic contig location: Contig_ID=SeqID_39237; Location=415..701; Strand=+
  SCN-specific regions: Sequence locations=1-235,257-287
atggcacaaccatctgaagaagagccgtcgacatcagaagcaccggcgcgggacaacgacggacaaccatcatcaactccaacaccggtgacaccgctggaaatggacgtgccgtcggtggagatggtggacaccgatgtgcaaatccctttcacgcctgccgacgaagaccaacaaattcaccaatgccgtcacatccacggcacgctgtgacctcatgtcgacaccatcgacttcaaaggggcccgtggctttggtctcgatgggggaaaaaaattcaaccaaaa

SEQ ID NO: 67854 - DNA, 437 bp, Heterodera glycines
  Genomic contig location: Contig_ID=SeqID_39239; Location=302..738; Strand=+
  SCN-specific regions: Sequence locations=1-437
aaaatggtcaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 67855 - DNA, 938 bp, Heterodera glycines
  Genomic contig location: Contig_ID=SeqID_8378; Location=1613..2550; Strand=-
  SCN-specific regions: Sequence locations=1-763,785-938
atgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaatgccatccgcccatcggagcgtgttcaggaagacagggaagccatcacaaaaatcctggaccatcttgaagttgaggcccaaccaacggccgtctttcgactcggacgatacgacccgcagcgaacaacaccacgcccgctcaaggtggtcatgccaacacccacacaccaacatgtggtactcggaggatggaagcgcgagcgtgctcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacaaatgaccagacacccgatgttgctaaaggaccaaaccagaacgaggccagtgaagacgtttccaaaccaccggatgtttttgaccaaaaaatcctcgcatgttatgcagcattaatatcattgccacccaccgacaaaattgttcaccaaattcaatcgctcaaaaaacaataccctcatctttttaataaatagttctgtcagacctccaaaatatttcctctaaacaaaaaaaaaaacattttcttccagtacttccaatttctcaacaaaattttttcctcaaaaaaaatttttttttctcgctggaggtctgactatatgcttctagaaattcaattgtcttttttcatctattcatttacctttcctcattttcatcaaaagtgtaagtggcatatgcccttcttttggttattttatttttgaataaa

SEQ ID NO: 67856 - DNA, 579 bp, Heterodera glycines
  Genomic contig location: Contig_ID=SeqID_8378; Location=1972..2550; Strand=-
  SCN-specific regions: Sequence locations=1-579
atgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaatgccatccgcccatcggagcgtgttcaggaagacagggaagccatcacaaaaatcctggaccatcttgaagttgaggcccaaccaacggccgtctttcgactcggacgatacgacccgcagcgaacaacaccacgcccgctcaaggtggtcatgccaacacccacacaccaacatgtggtactcggaggatggaagcgcgagcgtgctcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacaaatgaccagacacccgatgttgctaaaggaccaaaccagaacgaggccagtgaagacgtttccaaaccaccggat

SEQ ID NO: 67857 - DNA, 306 bp, Heterodera glycines
  Genomic contig location: Contig_ID=SeqID_8378; Location=2647..2952; Strand=+
  SCN-specific regions: Sequence locations=1-233,255-306
atgtccaaatcagtgattgatgggataaagttgatactgagcacagctgagcattcggatgtccactttttggtggacaaaatcttctaccaaatttcataaaaacaaaaaatatttctcttctcaattagttttttgaatcaagccttaaatcagcaataagttacatctttttatattcttcataaatttatttagcaaatgaacataaattttcagagttttcccggagcgcctattggccctccggacgcttgctttgtaaattggtttttgacgagaattcgttctttctcagatttttaa

SEQ ID NO: 67858 - DNA, 1101 bp, Heterodera glycines
  misc_feature (1093)..(1093): n is a, c, g, or t
  Genomic contig location: Contig_ID=SeqID_8378; Location=2960..4060; Strand=-
  SCN-specific regions: Sequence locations=1-186,208-231,261-324,346 -443,466-644,666-838,860-1101
atgccatggaaaattgtggcactaataaataagaaagatgaaagcactgacaatgagaaatggttgggctttttccttttgtgcgatgcttctgaagaaggtttgcttatcaaattatataatagaaatgtaattattttgtcataaaattggtgtaattaattattgaaaagacttaaacagtaattttttaacataaaattagaagtgattttttaaaggaaatgcgtgaaaatataaatttgattattatttaatttgctttaagatggaaattggagccgcaaatgttcggcaacacttcgaattgtctctcaaaagaacggtgtggatgattttaagaacgaattccctgtaaaaagaatttttaacaatgcaacgctgatttggggttggcactatttcatttcatttgtggtgagtggaaattaattagttaatttacattttaatattgtaatggtaaattaaggaattaatggacccaagcaaagggttgtacaacaaagacgaggacaacgtcaccttggccattgattttacatgtgaatagcgtaaacatttcgagaaggattgaaaagggaaaggaaggaaatcagcaggatgagaagagagtcttggagggcacaaaattttcttggtgcttaaattttatatttttttatgttttgtaaagtgttttggtttcataaagcaacatattacaatgatagggatggatttttatgtgctaaaaatcgagaaatatatatacctaaagagttgataaaaaggcagaaaaatttgctaaaatgcagaaaaatgccaaaatagttgccaaaaaattggaaaaaatgtcaataaatatgtgagttttccagaattgcccggattcatgatcagctaccctgaaaaccattcgaaatacgctttcatgattttggtaagaataatttttttgaaaatatgttcggatgcggggttcggaattggcagaaaaagaaagcctaattcttattcagaactctaaaacgcgccttgaaacgttttaaaaatttcgagaccagtaaaacacattactatcgtttaattttagctggcaaagaaaaattcnaaaataaa

SEQ ID NO: 67859 - DNA, 694 bp, Heterodera glycines
  Genomic contig location: Contig_ID=SeqID_39248; Location=185..878; Strand=-
  SCN-specific regions: Sequence locations=1-338,362-436,458-488,510-694
gaggagccaaccactttcatcagcatccgttccgttctcataaatggtccgtccgtcgtcccgttgccttttttatcctcccttttccatttgtgcctttgctcaggccaacgcttcttccaaccgctcagtgtccccgccgctctctgtccgtccgcgtcggcgccgccggtcgacccaatgggccctttgttggcactttcggctgccgacaatggccaaagccatccgaagcagcaaaaggtcagtggccatctcgcccattgcttttaaatgctaatttctcagcaggatgctccgctcgctcctcgcgtccctttcatttaccagcaatctctcgccgccgccgccaccgccgccgacggggaggacaatccgccgtggcttcgtggaaatccccagccgaagaacggactgcgcggttctaacgcgtggcaagaagcatttgaagggggaaaggcgaaggttgcaatcaaccaaaaaaaaaattcagtttccccttcccttttattgtttaggccaattttggagcgtcttttggaagtgaattgggagaggcgtggattgaggcgaacaaagcgacggcaaaagaaaggcatcggatggaattgatggcacaaattgaggagaatcgacaaaggaaaatgagagagagacagcgtgattgggagagagaggagaaagagcgcataaa

SEQ ID NO: 67860 - DNA, 273 bp, Heterodera glycines
  Genomic contig location: Contig_ID=SeqID_39249; Location=345..617; Strand=+
  SCN-specific regions: Sequence locations=1-165,187-273
ccccccaccaccgccgtatgacgccggcgccagtagtccatttgaacaaccacaccaacagcatcagtcaccatcgccctacggaatgatgtacagcggtggcaatgtgccgtcgccaccaccgccgtcctctccttaccaccaataccaacagcaggcgccgccgcaaatgtccccgccgttccaaccaccaattggggacccacaacagcaggttgggggcatgccaagccaagccaaccaagagaaaatcgatgcaaatgatgggattgg

SEQ ID NO: 67861 - DNA, 841 bp, Heterodera glycines
  misc_feature (7)..(7): n is a, c, g, or t
  misc_feature (51)..(51): n is a, c, g, or t
  Genomic contig location: Contig_ID=SeqID_39251; Location=86..926; Strand=-
  SCN-specific regions: Sequence locations=1-76,99-195,217-430,455 -716,738-773,796-841
atgttantgcagcagggactcatgcaaatgctcatgaaaacagacttggancctatgaatgttagatgtgaattttgtgatgctttgcattttgttgaaaagaaaatgagtggccgaggtaattccttcaaggattgttgccactatggaaaagtttttgttcccgagattcctaagcaggattttcctgaggaattgaaggatttgtttattaaattttatgcgagacacgtgaatttttttgagaatattagacatttgaatagtagtgtgtcgtttgcttcaatgaatccggtgagatatagatcagggatgggccgaggtttcgcttttcgcatttcgcctttcgcattattcgcattttttggcgtttcgcatttcgctttttggcgcgaaaagcgacttttacacccctaagaattggattaaattcccataaaatttttcaaaattttacctataaattggctaattttcagtgaaaaactgtttataaatgatcaaaatttccaattatttccccggcggcgcctatcggcaccgccgcgcccacaaaactcctattttttcttagaaaatggcccaaaatcgcaaaatttggtaatttgatgaaaaactgttctcagcggcgcgccaaaactcttatttctcattagaaaaatgataaaaatcacaaaatttgatcattttttagtgaaaatctgtcaacaaattttaatcaaattttcaaaaattttcccggcggcgcctgccggcgccgcctgccccctcttcccaaaaagttttttggaaaaagcgcgcctcaaaaaagcgttttattgatttttaaattttgaataaa

SEQ ID NO: 67862 - DNA, 272 bp, Heterodera glycines
  Genomic contig location: Contig_ID=SeqID_39251; Location=348..619; Strand=+
  SCN-specific regions: Sequence locations=1-125,150-272
attttctaagaaaaaataggagttttgtgggcgcggcggtgccgataggcgccgccggggaaataattggaaattttgatcatttataaacagtttttcactgaaaattagccaatttataggtaaaattttgaaaaattttatgggaatttaatccaattcttaggggtgtaaaagtcgcttttcgcgccaaaaagcgaaatgcgaaacgccaaaaaatgcgaataatgcgaaaggcgaaatgcgaaaagcgaaacctcggcccatccctg

SEQ ID NO: 67863 - DNA, 1772 bp, Heterodera glycines
  Genomic contig location: Contig_ID=SeqID_8379; Location=73..1844; Strand=+
  SCN-specific regions: Sequence locations=1-621,644-708,730-1439,1463 -1613,1635-1683,1705-1772
atggtttcattttttagaaaatttatcccaaactttgcacaaatagcatacccattaaacaaattaacccgaggaggagcaattgaatttgaatggggagagaacgaggaaaaagcaatgaatttgttaaaaaatcacttacttaagtcgccgagtcttcgggcgccaaattatgcactaccgttttacttattcacggatgcatcagctttggcttatggtggagcattaatgcaagccggaaatggagaaatgtttgcaatcgggtattggtctcgaaccttaactgacgtggaaagtcgtctcccccccacccatggtgagctagcagcaatagttcatgccgtgcataatttccgaccaattgtttatggaacagagcttgtaattctaacggatcatcgccctcttacttttcttttcaataaagcaagttcaaacccaaaattgaaccgttggcttatggccatacaagagtttgaaccgaaagtaatttatctcgagggacgagccaataaagttgctgatgcattgtcccgtgtccccattgcatggaatagtattgaggcacaatttaaggacgaaatacctcatttgctagcgatcgaagaagcaattgatagggaaaaattggaaagggagacgaaaagtgatcatttattatcaagagtgatcacaaaaataagggagaattggatagacccgattgaggaagaattattaccatattaccaatctcgagacagtctgtatatggaaggagggttaattaggaagcgaccaaacggattaattgttgtgccaaagacaatgcaaattcaaattttggaagttattcacaaagcacattttggtattgttcggagtaaggccaaagcgcggaagcatgtttggtggccaaaaattacggaagatatagaaaattttgttaaagaatgtgtaatttgtcaacggaatgcagcctctccaccaagaattgaccctgagcatcgttggcccgaatcgagatttccctttgaaagggtgcatgcagatttagcaggacctatttggggcgcgtattttttggtgatagttgacgcttattcaaaatttccttttgtgcatcaattaaattcaacaaattctttctccataataagtgttttctgcgaaatatttggcatctttgggtcaccccgtctttggtgacggataatggccctcaatttgtgtcagcagaaatggaagaatttttgtttgctgaaggggtaatacacaaaacatcggccccttaccaccctgccagtaatggggaggcggaaagatttgtgagaactgtgaaggatggactcaaaaagttgctggaggcgggaaataacctcaaaagggcccaatttatatttctacaggaataccgctcatccccgtgtcctacattagatgggaattgcccggcacaattgtttttaaaaagggaaatgcgcaccggcatggaccgaataaaaatgccgaaaatgaaagacactaatggggcagaccctcaagtgggggatgaaatgaggaatgttcaaaggaaaggcgcggagagtcgccacaattcaaagcgtaactttgagccaggggatgcggtgtgggcccaacaggcgggtgagaaaaacagatggggccctggagtactgcttgagccaataggcgaacggatgtggagaatggaattggaaggaggcggagagaagactgtgcatgtggaccagataaaagagcgaagaattgcgtccgctcgtcattga

SEQ ID NO: 67864 - DNA, 1033 bp, Heterodera glycines
  Genomic contig location: Contig_ID=SeqID_8380; Location=845..1877; Strand=+
  SCN-specific regions: Sequence locations=1-46,85-88,143-257,303 -401,424-512,544-630,669-709,747-854,876-951,973-1033
atgtgccaaagcaatggtactacggttccgttggttcgctttataaaagaaaatataaaccagcaagaaattaagaaatttgtcaatgtatttattttttaaataatgggataaacgaaaagaaaatagaaatgaatttaaagaatgaataattacaataaaattctatacattgatcaaagattatatattattataacaaacattgaacaaagcattattaagaggaacaaaatacaaaataatatagcatcagcaaaataattatgaatttttaaaaaaatttaaatactataaataaacctaaaaagaatttattgctagcaacataatcagtatgcatcatgagtcactcagcacaaaacccaacttttaacccggacccgttatccgggcccagttttttgaaaatccattatcctttacccgacccggtaggtccgggtacccggataccaaaaataccctggtaataatggggcctgggtcaaattgttgatcaaagttgacggaaatttttttaaatataattaaatttaaaaacgaatgtttcggtgttcatgtggcttagtggttaatcttttggattcgatgcattcgttctcaggttcaatcctccttcctcattgctaactattttgtactttttaaatattttattgaaaactgttattatcatttacataaggaaagctccaaataactatccttattttaatagaattttataaaaatcttaaattttacaatatccccataagaaatttagaacaaattaaaaaacattctatttttcatgccttttcaaaagtataagcttttattctcttgaaaaaaaatttgaaaaaatggattttttaatacccggtttttccgggtacccgacccggtacccggtttcaaaactggtacccgacccggtacccggcatttcaatactcggtaatacccgggcccggtttttcccaaatacccggtaccgtgcaaccctaatttggaacaagagttttacttaattgaaatttccatttta

SEQ ID NO: 67865 - DNA, 846 bp, Heterodera glycines
  Genomic contig location: Contig_ID=SeqID_39254; Location=35..880; Strand=+
  SCN-specific regions: Sequence locations=1-302,352-612,639-718,742-846
atggtggccgaaatctacgcaataaccggcaacctcaggccaaatgaagaaattttgactgaatacactggcggacagaggagtcatgtttttgccagaaatgatgacatggagcagtttttccaagccttggacgaagtccgattcaaaaaaatcaaaaaataaaaatcctaaaatttccattttttcagaaaattaacccttgtgaaagctctaaggctgaacttttgaaaaagaatttgccatctccagcggcaaaacttcgtgatgacaaaaatcggactggcgttgaagtttgtttcaataataatttttctaaattcatttttttataaatatttttaattttttggttttttcagcttttgatactgccccaaaatgacagtaattcaccaaaaaattttgtaaaaaacagccaaaagacagagcaacaacaacaattagtcaacaaccgtgaacagttgccatttttaccaaagaatttgaagttggaatgcaacaacgttggaaaggtgacaaaaatttagattatgtcatgaaaaaaaaaacaaattttccgagaaaatttttattatttgggttttcttcactatgattcattatttttgttaaaaattttaagaaattaaatctgatttttataccaaaagaagcggttttgaagttgtttcggaaaatttaattttcctgaccaatcattgatgattgataattcaaaaatttaattattattttttaggttgacctgatgcttgtgttagacaccagtggctccatttaccattcattcccacagcaacgtcaaataggtgaatttaataagaatttttttatcgaaattaa

SEQ ID NO: 67866 - DNA, 699 bp, Heterodera glycines
  Genomic contig location: Contig_ID=SeqID_39257; Location=394..1092; Strand=+
  SCN-specific regions: Sequence locations=1-206,231-252,277-337,381 -475,513-564,615-699
  Gene Ontology: Mol. function=protein phosphatase inhibitor activity; Cellular component=cytoplasm; Biological process=muscle contraction
atgccgttgtcgttgttggttgaagagcaagctcatgtgtcagcagcagctgaggctgctgccgaggcagcgagtgctgttgaccaaaagatgtcggcagcgccaaatgacactcccgccatcactgacacgaaaattgattttatgactgatgaacaaacagtggcggcagcgccgccgcctctattcagtgagattgaaccgacgcagcagcagcagcagaaacaacaacaggtttgctctaaattggtgtcggttatttaattttttatcaagaagattcaggggcgtacagcggaaatcatcgcaccgaaagtggagctgtccgccgaggacaatggtgatgatgatgatgatgatgatgatgatgatgatgatgagactggacaacaggtcaaacaggaggcggacaggaacggcatggatgcacatcattcaaattgtgcaaaagggccccttttgttcattgatgaacaggagaatgaggaggaggagagtgaggaagatgaggacatttcaacaacgcatcgaaggcaaggcatggactcatcatttgactacgaagacgacgacgatgatgatgacaatgacgatgatgatgatgatgacgatgaaatggaatcagtcagcggatgtgcggaatcggacaaatgtggtcactgtcaccacccgcatcagctaccacgaaatgctttggag

SEQ ID NO: 67867 - DNA, 650 bp, Heterodera glycines
  Genomic contig location: Contig_ID=SeqID_39258; Location=11..660; Strand=-
  SCN-specific regions: Sequence locations=1-66,140-363,385-650
atggcaaaagaaactgatgattggacaataaaagccgattggactcataaagtgcattagagccgcaaaattttaaatttaatctacttacaaagaatttatttgaaaaaacaaattaataataaataattatttttaagttcgaagatggcttggcagtcaatgataaatgggcaatgagcaatttattgggcatggcatctcaactaaattttacattccaattgggaccacttggtggaaaacgtggctacatggttcaactcttcatattggagacaacaatggtgttcggaatggtcaacaacagataaataattcagtgatcaacggatcccgtcgagttgggcgccgacacgtttgggcgccagcaccttttcagctataacttttttctttgtcgaccaaattaaacattgttggtatcattcaaaagccctaagtgtcctctattagtctgcaaaattttgaaaaatttcattaaggttcaaaaagttatggccagaagaattcaaaaaaccagattttccaacctttttggtcaaaaatgtgttcaaaattgacgaaatttttaaacttttgcaggctaatagagcatattaagagatttctcatgttaccaacaatgttttatttggttgagcaataaa

SEQ ID NO: 67868 - DNA, 1851 bp, Heterodera glycines
  Genomic contig location: Contig_ID=SeqID_8381; Location=2433..4283; Strand=+
  SCN-specific regions: Sequence locations=1-210,232-279,304-709,753 -1293,1315-1851
  Gene Ontology: Mol. function=copper-exporting ATPase activity; Cellular component=integral to membrane; Biological process =intracellular copper ion transport
atgcaaagttggaaagcgctcaaacatcggacggcaaatatgtaaattaaattggcaaaaaaagtttagttaatctccttaattttagggatgttttggtcgttttggccacttcgattgcttatgcttattccgtctccgttttgattcttgcctttctgttgcaatggtcgtccagtccaatgactttctttgatgttcccccaatgctttttgtatttatttccttgggccgatggttagaaaacaaagcaaaagtgagtctctctttgaaatgttttaaactttttaaattttattggtttcagggcaaaacctcagaggcattaagcaaactgatgtcaatgcaggcgaaagtggccattttgatcacccgagacgagaaaacgggtcaaatcacttcggagcgcggaattgacactgaattagtgcagagaggcgatctgatcaaagttatggctggggagaaaatccctgtggacgggattgtcgtggagggcaaatcatcggctgacgaatcactgatcacgggcgagtcaatgcacgtcgtgaagaagccaggtgggccggggtggtggcagtggggcaatcagttggattataaaatttctttactataaaaatgacgggggaatgcgggtacattaggtcccacttcagtgttagacaaagttattaatcaaaatgggctatttttgagtgatattcaaaaataaacagatcactgttttgttgttgttgtttcttttgattaaccttaactcgcttcatgccaaataaacagaagaattttgtattcattcgaaagtctgtttttttcaaattgtaagcaaatgtctgtcaatttgacgcacagaaagagttaagagcctttcaaatttgcatttgcttagattctcccgtcatcggcggctccctcaaccagtccggtctgctcatcatccgtgccactcacgtgggccaggactcgactctctcccaaattgtccgactcgtcgaagaagcacagtcgtccaaagtctgtttctcccccccccccccttattcatctttttgctaaggctcctctccaacaaacagcggacaaagtcgccggttatttcgtcccatgcgtcgtcgtcctctcacttttcacttttgtcgtttggctttttgttggagtcttccacaagggacaaacgaaccataaaatggcgacgaatgcttctcatcttcagtctgtctgctctctttttctccctaccttctcacttttcccttagttctcttccccaatccatcgaagggataagcgtggagcaatgggaattcattttgcgcaaggcctttgaatatgcgatcactgtgctgtccatcgcctgtccgtgttcgcttggactggcaacaccaacggccattatggtgggcacgggagtcggagctcggaatggcattctcatcaaaggcggagagccattggagcaggcgcggaaggtaaattgtttaatgttatcggaaacagtcaaaagcatcaattcataatattttaatcccgaaaatacaaagtcccacccccttttggcctaccaattataaggacggttgtggtcaaccctcgcccccccccccccctccatatatatgctacgaatttatagtttggttatttaaacaattctttttatacagattagaacagtagtgtttgataaaacgggcacaatcactgaaggaaagccgcgagttgtcaagctgttcacaactttgcctccgagccaactttcgatccatcggttggcacttttgatgggcagtgccgagtcgaacagtgaacatcccatcggcggcgcaattgtccgttttgcccagaag

SEQ ID NO: 67869 - DNA, 445 bp, Heterodera glycines
  Genomic contig location: Contig_ID=SeqID_39262; Location=39..483; Strand=-
  SCN-specific regions: Sequence locations=1-227,260-354,378-445
atggtttgcggttcgtttgtcgcaatcgccatgaatgtgttgatcatttactgtgcactgcgcatttttaatcgcaaaaatcgcgacacaattcatgtgtatataatcagcatgacgatgggcgatctgattcttggttagcgaaaattgacaaaaaatattttaaaaatgcataaaatgtaaatattcgatgttttagataataagtcaaaatttactcactttccaaaaatttaaattattttaaaatttatttattgcttttcctctttaattacttctatttatttcaaaaaatctttgtttttcgcaatgaaaaataaaattcagagatatacataatgcctaattaattgattttaataaattatcatttttagtgatttgccaatttctcgagtcgatgaaccgcttgacacccgtccagttcatctccagctcttaa

SEQ ID NO: 67870 - DNA, 140 bp, Heterodera glycines
  Genomic contig location: Contig_ID=SeqID_39263; Location=861..1000; Strand=-
  SCN-specific regions: Sequence locations=1-13,47-140
atgcatagaattattgctgcggttaaaaagctcgtagttggatctgtgctagccgtccggtgcacactttgtgtgttactggtttggttggcttttctgccggtctttcccccggcgttggcctttaccggtcggcgtcg

SEQ ID NO: 67871 - DNA, 634 bp, Heterodera glycines
  Genomic contig location: Contig_ID=SeqID_39263; Location=1088..1721; Strand=+
  SCN-specific regions: Sequence locations=1-28,54-57,93-142,164 -176,207-336,381-447,478-634
atgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcagcgaaggagaccgagcaagtg

SEQ ID NO: 67872 - DNA, 78 bp, Heterodera glycines
  Genomic contig location: Contig_ID=SeqID_39264; Location=250..327; Strand=+
  SCN-specific regions: Sequence locations=1-78
aaggtcacatgtgtggacgtgtcgccggacgagaattggattgtcagcgcatgctatgaccgcacattcaaactgtgg

SEQ ID NO: 67873 - DNA, 706 bp, Heterodera glycines
  Genomic contig location: Contig_ID=SeqID_39270; Location=67..772; Strand=-
  SCN-specific regions: Sequence locations=1-182,215-409,431-706
atgtaccatcggaataaaggatattattccacgtattgtactttctgtggtgggcttatcaaaggtacgataacaccataatcagggtcatctcacaacaatacaataacaaataacttttttgacaaattcaacacatgtgctctctctaaagcatgagaggcacaatagtgtgcgtcacaaaataatacattttaaaaaacgttgacaaatttcacttctgtgtctcatggattaaagatggggtgaaaataaggaagggatgcgatacgaatggggaccggtaaattggacaccggaaaattggacaccagaaaaaaaattttgtttttttcggttgcgggattccgactcctgaaatgttgtgcaaagttttgaaaaattttgcggaagttattttcgaatttttatatccagtaaaaatttctttaagggcaccgaatacatattttccatatatttatacatttcagtccattttttatccaaatttcggcatttcatggaaatatttttttttggaaacaactcttaatttaaggaaagttttcgtccaatgtcacttcttatttgttcgttacttgtcttttttatttggcaattgtaattcgtctggcatggattaagggttaattaaggatttaatttcctaaaagattggcacatctcatttttgatagagaatttgcaatttttgaaaaataaa

SEQ ID NO: 67874 - DNA, 775 bp, Heterodera glycines
  misc_feature (729)..(729): n is a, c, g, or t
  Genomic contig location: Contig_ID=SeqID_39271; Location=94..868; Strand=-
  SCN-specific regions: Sequence locations=1-775
atggatgatttttacattgtactaccctcgaacacaccgggaccagggaacagtacatcaaaattcacagttcgactccccgagactctggaattgggcacaaattggtcagtagctctctcatcaattatttacccctactcattcaccgcactcggtataaacggtcaagagtttattaaagtatgggaaaacgacagcagtgtcccgactcaagtttatttaccggacatgaattttaaaaccgccgggggcctgggaaataaaattaacgaggcattcagccatcattacaaaatcaaaaaacaacgtggaaggagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactacgagaaacaaatcctcacattttagaagagcctgatataaaaatttggtttgacaaaatggttgagatgggaaccgaaattcaaacatcccgaaatgaacttaagtcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcnggaaagggttttagcgggatagtgaataggcttaatgaggctttgg

SEQ ID NO: 67875 - DNA, 541 bp, Heterodera glycines
  Genomic contig location: Contig_ID=SeqID_8383; Location=75..615; Strand=+
  SCN-specific regions: Sequence locations=1-68,90-373,397-541
  Gene Ontology: Mol. function=metallocarboxypeptidase D activity; Biological process=amino acid metabolism
atgacgtcggcggttacctcggggtcagtttttcggccatttgtcccctttttccgtcgcccgtctgtccctttccccaaattttccctcattttgtccatattcccaaaggacgcgttgccccggtcggataagcccggactaaagagtctgcgcaccacacggacactgaaggagcgcatgtgcatcaccattgagccgggctgttactttattgactcggtcaatggggagatggaaattcattttgctttttttgaaatttcagttgctggacaaagcactcgccgactccgagctgtccaagcacataaatgccgaccgattgaacgaatttcgggggaccggaggggtgagaaaataattgaccctttaattgctcaataatttaaataattaggatgtccaattaatgccttttaaggttcgcattgaggacgatgtgatcatttgggagaagggcaacgagaatatgaacgcggatgtgccaagaacggtggaagagattgagcagtttatggccaaagcaaagggactttag

SEQ ID NO: 67876 - DNA, 615 bp, Heterodera glycines
  Genomic contig location: Contig_ID=SeqID_8383; Location=1191..1805; Strand=-
  SCN-specific regions: Sequence locations=1-436,458-615
gaataaatttatgcaatatattctttcttttaaagtcaaaaatgaacaataaatggcaaataaatcatttgctcatcaacggtttcatttcgcactgatcgacggacacaaatcactcaaaaagtgatcaattgtcagacggcggtcggttggcggggcggttaaatggcgacggcattcgtccaaaaaagggcaaaaaggcaaagggcggcggtgccgaaccattggacgaagaggggccaaaaggcactttaaatggcggcattcgtccaaaagggggccaaaagccgaagggcggcggtgccgaactgttggacgacgaaggaccaaaaaatggccgaaatttgaatgggttgaactgctgctcctcactgcccgactcttccgaattgctctcctccgatgccatttccgacgaattgttcggcgcctcactttgtccattgacaaaaatggcaattgtcaaaataaaagcagcaattaaaaatttgttggccattatttgcgataattaattaatgattttgacaattcggaagcacagtcaaattaaagttgaataatttcactgattcattcgctccttttatgtgctttcatttcccattcaaatca

SEQ ID NO: 67877 - DNA, 670 bp, Heterodera glycines
  Genomic contig location: Contig_ID=SeqID_8383; Location=1307..1976; Strand=+
  SCN-specific regions: Sequence locations=1-42,64-670
atggccaacaaatttttaattgctgcttttattttgacaattgccatttttgtcaatggacaaagtgaggcgccgaacaattcgtcggaaatggcatcggaggagagcaattcggaagagtcgggcagtgaggagcagcagttcaacccattcaaatttcggccattttttggtccttcgtcgtccaacagttcggcaccgccgcccttcggcttttggcccccttttggacgaatgccgccatttaaagtgccttttggcccctcttcgtccaatggttcggcaccgccgccctttgcctttttgcccttttttggacgaatgccgtcgccatttaaccgccccgccaaccgaccgccgtctgacaattgatcactttttgagtgatttgtgtccgtcgatcagtgcgaaatgaaaccgttgatgagcaaatgatttatttgccatttattgttcatttttgactttaaaagaaagaatatattgcataaatttattcaggcactaaccttccctaattatcatttttaaagaatttgaattatttttggctctccgtccccaacaaaacgtttctcgagatcaattttcggtctcagttctctagtcttggaaaattttgactctcgagcagccttatcacatcaacagtcccccttaattatctcta

SEQ ID NO: 67878 - DNA, 743 bp, Heterodera glycines
  Genomic contig location: Contig_ID=SeqID_8383; Location=2640..3382; Strand=+
  SCN-specific regions: Sequence locations=1-97,122-172,195-703,735-743
atgttcgcctccgcttgccgcttcgttctgccgcttttccttttcgcccttttggcacttcccccggccaatggcacgggacttcccatgcagaaaatggagtgctgccaacaacagcaaatgtgttgtgccgcaccaatgcaatgcacgccatcgtgcggagggtgcggacggcgccggcggagagaggcgagcgattggggggataactaacaattaacagttcgaatttttaggccgccgttcagccgctgctcagagggaaagaaacgccgtgcccacagacggagtggcaacagctgatggaaaatgtgggaaaaagtgctaaactcagcagctaacccggaaaaatgttaaggcaattgtgccactcgacgacgtccaatcggtgaactccgtccaaaaggcgctcctccgacgctttccggacaacaaatttttggtgatgtgcgcaatggcgggggagggacgcgcggaaggcaaagaagcgctgccaaatgaggtgagccgagggatttggaggatttaaacaaacaattgagcaacaattacaacaataataactcttgcctttccgtctcaaatccgtcgcttatttctaccgtatgcttaggtccacctcagctccagtggccacggctactgtaacgttgtcagcgaacgcatttggtgccaagcggccgcagtcgtcggctgatggcacttatttattattttttcttttatattatattgttttttga

SEQ ID NO: 67879 - DNA, 958 bp, Heterodera glycines
  Genomic contig location: Contig_ID=SeqID_8383; Location=3647..4604; Strand=-
  SCN-specific regions: Sequence locations=1-522,544-795,817-895,917-958
atggccaacaaatttttaattgctgcttttattttgacaatggccatttttgtcaatgggcaaagtgaggcgccgaacaattcgtcggaaatggcatcggaggagagcaattcggaagagtcgggcagtgaggagcagcagttcaacccattcaaatttcggccattttttggccacggcttttttggtccctcgtcgtccaacagttcggcaccgccgcccttcggcttttggcccccttttggacgaatgccgccatttaaagtgccttttggcccctcttcgtccaatggttcggcaccgccgccctttgcctttttgcccttttttggacaaatgccattgccatttaaccgccccgccaaccgaccgccgtctgacaattgatcactttttgagtgatttttgtccgtcgatcagtgcgaaatgaaacggatgatgatttacatttgctattcatttttgaatttaaaaagaatatgttgcataaatttattcaggcactaaccttccctaattatcattttaaattattctccttctccatctgggtttttagtaaaatttaaaaaaaaaatcgattctcgggggtcaattctcagtcacagctctcgagtctcggaaaaccttgactctcgagcaggccttatatcaaatccctaaaagaagttacaatttttgaatttactttttttcacgctcatttagtctcaaatatttttttttttcaaattttccagaatttcttcgaacgcgtttatcggacaatacggagccatctttcatttatttcaaaaatcctataatttgcaatttggccaacagtcgtaaaaaagaatagggattgttgtcgggggctttaataatgtagttgcagcacgcagcaaagacaatagcccaaagcaaacacaaaacactgccaaatgccgaagacagttatttatttcaaattaataaa

SEQ ID NO: 67880 - DNA, 1410 bp, Heterodera glycines
  Genomic contig location: Contig_ID=SeqID_39272; Location=1..1410; Strand=-
  SCN-specific regions: Sequence locations=1-280,302-704,726-819,841 -1154,1405-1410
  Gene Ontology: Mol. function=3',5'-cyclic-nucleotide phosphodiesterase activity; Biological process=apoptosis
agatgaagcatcatcctcgaggaaatgaaccttttaaagtgaaaatctgccgctaatttctccgttttcactacgaaattcccttttcctccgcactttttgatttgtaaaattggcgacatctctccctccaaattagtttgttttcctcaattgcattaccctgtaattactttgtacgatgatgatcatcggggaccagtacggtttctatcagttggtgttgcggaagcacgcgtgcaggtgaaaggaatgcgatagtgtgacaagaagtgactttgaggcgggcggggggaaaggggataatgaggataatgaatgttggagcactgtttaatggtaatagtcaatcactttcattggcatggcttttgaagattgtttcgttcaccatccaatcgcttctccccctcagattgcgttacattctccaccagcttaatggcggtcagttgtcattggaagaccttaaacggaacatcgaatatgcggcgcttgtgctggagacggcgtacatggacgagacacggtgggactgtctcaaattgtgtcgataattccccgccctcggcgatttaccgtctgtctctaggcggatttgcgacgaggacgacgacttggcggaggtcacgccagaggcggtgccggacgaagtgcgcgaatggctgacggcgacattcactcgccaaacggtgcaatcgcggaaggaaaaaccaaaattcaaatcggtggccaatgccatacggacgggcatctttttcgaaaagtttgtccccacgggcaacagcagcagaaatcagtcagttcaattgatgcaattaattcactctgttcagaatttaccgtcggacgcagtccgttttggtcagtggggcgaaacggacagacatttttgaacattaaaaatcccaatttttgttttattttaggctcccattccccacgaatatttgccatttttgcgggtcagtttctcttcctttttggccattttccctcccactttagcaagtgaacaattggaacttcgactctttcgacctcaacgaggccaccaacggacactctctcaagtacatcggcttcgagctgttcaaccgttacgggttctttgagcggttcaaagtgcgttgggatttgacgttgacatgtcctcttcttcctcctctgtttcccctcctctttctcccttccttctcctctttctttcccctcctctttctcccttccttcctctccttctttcccctcctctttctcccttcctttctcctctttcttttcccctcctttttctcccttccttctcctccttcttttcccctcctctttctccctttcttccctctttctttcccctcctctttctccctttctctcctctttcttttcccctcccctttctccctt

SEQ ID NO: 67881 - DNA, 447 bp, Heterodera glycines
  Genomic contig location: Contig_ID=SeqID_39273; Location=117..563; Strand=-
  SCN-specific regions: Sequence locations=1-249,273-447
atggaagtcgaacagcggctcccacggtacattttggatgaaatttatttggcccgggaatcagcgggacaatggtccactgatcggctgcgagataagctccgttctattctcaagagaaaggaacaaatcgacactcttttgcccaaaaccgaccatgggccccgtcctaagccatccccacggcctcccggattcggttcttctttcaacccccagcctactctcactttccatactcaatcccgtactcagccccaacaaccccccgggtctaaaatccgtcccaaattgccctgtctcttctgcgattcccccgaccatttttccagtaattgtgacaaatttggcacccccgaaagtcgcttacaacgtttgcgctcccttaaccgttgcttcaaatgcctcaagaccggacatccggcacgccaatgtccctccccagcc

SEQ ID NO: 67882 - DNA, 424 bp, Heterodera glycines
  Genomic contig location: Contig_ID=SeqID_39274; Location=107..530; Strand=-
  SCN-specific regions: Sequence locations=1-248,270-424
atgaccatcagtgacggagatcgcagatacgatcagcaacggggaacagaagtaagtgatacagagcagatcccataagccggactttagaaagtggttatcagtaaaaattcctagcggtgatatcaatatctctcatttcattcctataatctcgcgatttcgttcacggattgagcctgggataagtcctactggaaagagcagctcgagctctacatgaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttataatttttttgaacccaattcaataaa

SEQ ID NO: 67883 - DNA, 50 bp, Heterodera glycines
  Genomic contig location: Contig_ID=SeqID_39275; Location=738..787; Strand=+
  SCN-specific regions: Sequence locations=1-50
atgtgcgacgaagaagttgctgctctcgtggtggacaatgggtccggaat

SEQ ID NO: 67884 - DNA, 784 bp, Heterodera glycines
  Genomic contig location: Contig_ID=SeqID_39277; Location=853..1636; Strand=+
  SCN-specific regions: Sequence locations=1-223,247-784
atgggcatcacattgaaacatatgggagatgggatggataaacagaggagttggggactgttcatccacaaaattcttcctctgatcggcatccccaacatccacaagttgttcgttactttcgggtatgttttggccaacaatgactctttgggcatctcagtgatcaggattaaatagatcagtagggtggggaattagattacaaaaaaagcccgaaatatttaagaaaatattgatgaaatatctattttctatctatttcggtatttttggtacgtgtttttagaaaaacccttaacagaaatgaatttaaagacgaaaaacgcacttatacgaatctacctaaaaaatttctaaagggcctatgtaaaatttcaagaaaatttgaattttttacaagaaaaaagttttttctttttctctcattttggcgtattatttcaattgtacttggagcccaaaattgaatcgccatattttaaatacctaaaatttgcatccttagcaacaattattcccaatttttagtggcgctaaacgactgcgtggactgctcacaagcacttcagcagcttttctgatcgaatgcccaaatctccgatcaatttactatgattggtattgcaatggccatgatcgtcccgttgacgccaacgcaaaagtgcgggaatggcttctgtggccgcgcgcggatggccgtccgaaagtgttgtaccgctccttttgctacgatataagcgacgaatacaatcaggcaagcggcggaaaagcaaatccataa

SEQ ID NO: 67885 - DNA, 915 bp, Heterodera glycines
  Genomic contig location: Contig_ID=SeqID_39279; Location=309..1223; Strand=+
  SCN-specific regions: Sequence locations=1-312,337-380,403-412,434 -456,480-486,508-841,863-915
atgttcgccattgccgcctccgcttcttcccatgccagcaacaacagtgaatggcaggcattgagtgccaagtttggtcagcaaatcagtgaaattgaatcgaatgtgccgagtttggcattggcatttccaaagtgccttttgacggccctaaaggtaaaaccaattagaatttgtcactaattaattatgttgtacgatttaaggagaccactcccaacgtaatgtgcctggcaggaacagtgtgatttccatgcccggattgaccggctcacacaaacactgaatgatgagttgatgagtgactgaatagaatgaaatgattgtggtgagttcgttttggattttgtacagcaattagctgttgtatttctgtatttagaataaaataaataataaattgcaattgcaattgaatttttctaaatgttgaatatgaattttcttttatgagagtctttgtactttattccaattttggcacatttttgtcctcgttttctgtcctaaaattcaaccctttcatgacaagcacatcctgacaacaaaagaagccgcccccccccccccgttcatgttctttcttcccaatcgcatcatttttattctccacccaattcattcgcaattcattcttctgttatggctccataaagtcgcctgggaaagtgctaaaaacgcgatgaaaattggaagacgaagacgaagttgatgatgatgatgtgatgatcaaattcagcgatcggagcaatgagcggacgaatgaatgaatgacccgcgcgacacgccgaagagagtcaataaaaagggcggcgatggcaaaacaaacgaaggcattctcaggagaagaagcagcggaaaggacaattcaccagcaaagactcatttcagacaatcggacaatatgtatcaggg

SEQ ID NO: 67886 - DNA, 478 bp, Heterodera glycines
  Genomic contig location: Contig_ID=SeqID_8385; Location=972..1449; Strand=-
  SCN-specific regions: Sequence locations=1-105,127-354,378-478
atggcatcagaatttgttcttgtgcctgatgaaatttatcgcggtctcacaaacagtgattcgggagacatcaacttggattttgttcagcgcgctttgcaaaggacaaaaagaaatgttagtaaatttaacagcaaaaaatgttcattataaccaggaattgtcccgttatctccacctgagagatgaacaccaaaataaaccagcaaaagtagaaattacaaaaggtctgaagacactgagaggcaacgaaagcgacgatgatgatgagcaaattattgatttggggcctgaaggacccaaacctccagcttcacttagtcgccaacgacaacgccgtcatcaccgttacaatgacgatgatgtagaaatgccaccagtcccaccttcaccaactcctcaagctggcactagggcccaaaaacggaagcaaatgaattttattcctcatgggaggagggggtcaaaagacaattaa

SEQ ID NO: 67887 - DNA, 1119 bp, Heterodera glycines
  Genomic contig location: Contig_ID=SeqID_8385; Location=2534..3652; Strand=-
  SCN-specific regions: Sequence locations=1-321,344-425,461-1033,1085 -1119
atgagcattaaccttcgtgacaaaaaatcccttatggaaaatattttgcccgctgtcgacatcagccacaccattaatggaattactgtgagcagcgaacgcattgccgtggcaagaacaattcctttcgacattgtcggcaagtgcaaggagtgcaaggcaaccgaatgcgagacggaatggtgtatctcaaaggagggtgtgacaatttggtgcactcgatttaaaatcagcccccgttttgtgccttttgatgtcatttacgagcttcccggttatacctttttcaaggtattttcaacaatttttcttaccacactacattttttaaatttgtagatccgtaacaagggccgagtctttaacgttgaccatggcagtcgcagcgatgcttgcactcagacgcccgcaccgatctaccacttaccgcctccaccacccccaccaaaactcccaaaaagaaaacaggaacagcaacaagcggacgccccggcgttcttttccgctctttcggcagcctctttgggagttgaatttggcgcaactaccgtcaatccttcagctcaacaaactcagccccaagagtcaaatttcgcttcttctatttcggcggcaacaacggggctcgactttgggcaaatgtcaactcaacaaccgacacatcagaaccgttccgaagcttctgatttcttttcgccaattgccgcagcgacaatggcaatggatgtggaacaaaagaaaaccaatccaaagccgagacagcagcaaaccgacgcctcgaatttctttggacctatttcagcggcaaccatgggaattggtgcagaacaacccaagccaaagatgatacaacagcaacaaggggtcgcctctgagtttgcttctgccatttccgccgcaacaatgggtatgagcaatgaacaacctaagcagcaacctccgatcgaaaaacagaaggaacagacagacgaagaaattctggatgaatttcttgagagtgtttcggctgcaactacctatttggatgtttcgcagaagaagaagccaaagaagaaaggaaagaaggaagcagaagatgaagaagcggcagcaattgcatcgatttcccgtaaacagtaa

SEQ ID NO: 67888 - DNA, 514 bp, Heterodera glycines
  Genomic contig location: Contig_ID=SeqID_8385; Location=4314..4827; Strand=-
  SCN-specific regions: Sequence locations=1-76,98-204,236-292,336 -363,424-514
atgatgagggccacccgcgtacgcttcgccttcttgtccgtcgtgaggtgagtgtgaacgcacccccccccccccattttttcatttccttccttttggataatctttggcaattcagcgttcgtttgatcatcgattgccggccgggagtgccgggcgagagcgcccaattgtaacggtgggggagggggaggggaggggatgacaaacaaacaaataaataaaatcacaaatttttacaggcttcaacggaatttgtcggtggtagattgaccccaattgaggaggtggcaaattaaaaaaaatcaatttgtaaattaaaaatttttttatttctacaggcagacgaggccgttgagaattgagaagtgaagagaacaagagaagagaagaggagaagaaaatatgaaaagagaaaaggagcacaaaggaaaaatttttaaaagaaataatcagggatcattataagtttgtccatttatttaaataatttggtgaaggtcatttaaataaa

SEQ ID NO: 67889 - DNA, 108 bp, Heterodera glycines
  Genomic contig location: Contig_ID=SeqID_39283; Location=276..383; Strand=-
  SCN-specific regions: Sequence locations=1-108
atgtactccttgaaacgcaatcaagtggccacaatgttctggaataccgaaatgaaaaatcttcatcatgctccttcctttgaagcagccattgaaaagctcatagcg

SEQ ID NO: 67890 - DNA, 186 bp, Heterodera glycines
  Genomic contig location: Contig_ID=SeqID_39284; Location=82..267; Strand=-
  SCN-specific regions: Sequence locations=1-131,154-186
atgttcccacacctgaaaattcaaagtcacgaaatttgggagaaaatcgacgaccgcttcggcaaggaaaagaacgccggtgccggaaaaggacgaagacgcagcggaacagcacgcgacgccccacccgttcacttcgcctccgtcgtcgctgctgctcgctgtggtggtcaaactgccagccga

SEQ ID NO: 67891 - DNA, 960 bp, Heterodera glycines; identical to SEQ ID NO: 39284
  Genomic contig location: Contig_ID=SeqID_39284; Location=1..960; Strand=+
  SCN-specific regions: Sequence locations=1-114,137-369,391-960

SEQ ID NO: 67892 - DNA, 439 bp, Heterodera glycines
  Genomic contig location: Contig_ID=SeqID_39286; Location=483..921; Strand=-
  SCN-specific regions: Sequence locations=1-200,223-439
aaaatggtgtaagtaaaaatcgtaattacgctcaaaaagctcctcaaacaattttagcgcttccaattacttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcttatccaattccttctacaatcgcctttatacatcccattatgagcgctaaaattatcagagtgccgaaaatcgcatgtgatctacgcctagcaaaaaatggtgtaagtaaaaatcgtaattacgctcaaaaagcttctcaaccaattttagcgcttccaattccttctacaatcgcctttatacatcccattatgagcgctaaaattatcagagtgccgaaaatcgc

SEQ ID NO: 67893 - DNA, 720 bp, Heterodera glycines
  Genomic contig location: Contig_ID=SeqID_39289; Location=1..720; Strand=-
  SCN-specific regions: Sequence locations=1-75,102-102,124-162,184-720
ttaaaaaatttttttttcccaaaaaaaatttttttttttggggtttttggggggaggcccccccccaaacccagagggcccccaaattttttggggggaggcggaaaccttttgggaaaaaatctccccataaaagtgggtatttaaattttggggggggaattttgttccccaaaaatttttggaattcccccaaaggggcccctgaaaaaaatggtttttttgtttttgggggaagtccccccggaaacgatcgccccaatttatggggaaggcgaaatcttcccggaaaagttccctataacctgtactttaattttggcgtgggattttggctccccataatggtttgagtaccccaacggaccactgaaaaaaatcgatttatttttgttttcggggcagtccccccgaaccgatgcgcccagatttatggggagacgaatcctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgattttttt

SEQ ID NO: 67894 - DNA, 49 bp, Heterodera glycines; identical to SEQ ID NO: 60106
  Genomic contig location: Contig_ID=SeqID_39293; Location=114..162; Strand=+
  SCN-specific regions: Sequence locations=1-49

SEQ ID NO: 67895 - DNA, 885 bp, Heterodera glycines
  misc_feature (42)..(42): n is a, c, g, or t
  misc_feature (83)..(83): n is a, c, g, or t
  Genomic contig location: Contig_ID=SeqID_39296; Location=110..994; Strand=-
  SCN-specific regions: Sequence locations=1-363,401-518,540-553,599-885
ggttgtacgcgaccgggacctgatactgaaagaacgtacacntgagtacctacgtcccggttttgaccgggaccgggaaaagntctcggtttttccctgttttgccagccaaaaattcccggtttttcaacccgaaaagtactggtcccggtttttcttaaaatttccggtcccgtacaactgtaatttgttgtccatattttagctttttgtctatatttttcgtttttcgtctataatataatctatattttggtgtttttttttgtcaatataaatccgggccctataaataatctaaggataaattctcaaccgaaaacatcggtaaaattctatggtacggtccccgacgagttaaagtaataattatataattttttataatatttttatttttgggctttttctctgcgttgtttgcactacattgatcgaaatatcagtgcgttggtcaaatcagaagcctttttacaaattgaccaagatttgttgtgtgaaattctcaaaagagatgagctgagaagcagtgaaatcgaaatttggaatgcggtaaattaaatattttaaattacaattatttattttctaaaattaaggcactccgttggtccgacgaacagtgccgtcaaaaagtcatcgaatgttcagctgaaaatcgaggcaaaattcttgacccaatattgtccaacattcgttttccactcataccaaaagaggattttacagaaagcgttggtaatgaataatattttgatgattagagagtttgctatcttgaaaatgcttgagcctggcttggattccttgttggacctggacctgtaatggttccaagtctggattaagggcttttcataattataccgtatttcctcgaataaa

SEQ ID NO: 67896 - DNA, 523 bp, Heterodera glycines
  Genomic contig location: Contig_ID=SeqID_39297; Location=11..533; Strand=-
  SCN-specific regions: Sequence locations=1-375,409-523
ggcccgtttgtcgttcggtggacatgttggtccaaatgatcgaaaatgggatgaacgtcgcccggatgaacttcagtcacggggaccacgaagtgaggttttcactactgtttaattttgagaatttgaatttccgacggccaccgttttgtaaaattttcaatccaaaacttataaatgaacaacatcccgaactgtgattgctcagatcacttaaactacacttttatcgtgtagagcatggtcaatttgctgttgccgattttcaaaagtcgtaaacatgtttgagagattttagggtcgctgattatgaatatggcattcattttggcttaaacgattaaatttcgaaaaaatttgaattttctgcaggccaaaaattaatttttacaaaaaattacagtatcacggcggtaccatcaaaaatgtgcgtgaagcagctgccaaatgcaccaagaagtacaacgtggctattgcactggacacgaaggggcccgagattcggacgggacttttggcaggg

SEQ ID NO: 67897 - DNA, 549 bp, Heterodera glycines
  Genomic contig location: Contig_ID=SeqID_8389; Location=30..578; Strand=-
  SCN-specific regions: Sequence locations=1-17,43-134,157-252,292-549
atgcttggaaaaatcggatttttaaaaaaatatttatattttcatggtgacaagctcatcaaaaattgcgcaagatgcatttttcttattgtccgagaattcttcgacggattaggaagtcgtaaaagcgtaaacaaaacccaaaacaaccaccactacttggcacatcatcaaaaaactcatcaatcaaaaaacagtgcccatcagaaggggggggggggggggaaagtaaaaatggaaaaattcaccccgaaaaataaatttttttaaatgatttaaactttaataattgtgatcgggaacagtttttttttgctaaacaaattaaattaagatttaacaccggcgggctatttccgactttttgccgattatcccatttgagggccgtgtcggaaatcagaaattgtcggcattttgtttatgtttcagttatttaattatagtccgagtttcacacatttattttacaagtataatattcaaaaagaaaattttcagcattttttgtcagattttttccttgagaatttgttaagttacagttaa

SEQ ID NO: 67898 - DNA, 246 bp, Heterodera glycines
  Genomic contig location: Contig_ID=SeqID_8389; Location=973..1218; Strand=+
  SCN-specific regions: Sequence locations=1-210,235-246
atgggaatgatgtggggaaactcagcggatttgcttggaaaaagtgccaatttgttcgcttcaccaatggcatatgacaatgctccggcatcacccgccggatttggccttccacatattgttttagtgattgataattattggattaatacttggagggtcccattttgtaatgggatctgctgtcgaaacaatatttagccgaaattaagagaagaaaatgggattaaaatgacctttcactga

SEQ ID NO: 67899 - DNA, 476 bp, Heterodera glycines
  Genomic contig location: Contig_ID=SeqID_39303; Location=535..1010; Strand=-
  SCN-specific regions: Sequence locations=1-161,183-476
aaatataaaaacatttttggcacgaaacatacttatggatttgccttcgaaagttaatgtagagggtgcagaagtgccgtgccaaaatgaaaaggcgaaaatcggttttggatgttttggcacgaaaacaatggacactcgagagacaatgcgaatactgtaaccccccaaaaggcaggaaaaaccaagtccaaagttgtccattcattaaatctcgaagattttgacttaatggaaggtattgtctcgagagtttaatggaaaacattatgagatgtaaacattttattggaaatcggccaaaaaagaaaattggattaaaaaaaaggaaaaaacaattccaaggcgttgaaattttgtaaaattttttttttgccatgtaaaatggttctgatattttgggaattccatttatcaaattttaaattaatcaaaaaagtggagtgccaattttggtgaagttattttataataaa

SEQ ID NO: 67900 - DNA, 657 bp, Heterodera glycines
  Genomic contig location: Contig_ID=SeqID_39305; Location=374..1030; Strand=+
  SCN-specific regions: Sequence locations=1-9,52-134,161-292,314-657
agtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtcccccctgaaccgatgcgcccagatttatggggagtccgaatccttccggaatagcttcactatagcctctactttaattttaccttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttattt

SEQ ID NO: 67901 - DNA, 710 bp, Heterodera glycines
  Genomic contig location: Contig_ID=SeqID_39307; Location=112..821; Strand=+
  SCN-specific regions: Sequence locations=1-157,179-380,433-710
atggctgaagaccgacaaataaaacttttaatggagaaaatggatgagaaattcgccgatatgaaagctgaactgaaagcggaaatttctgggaaattcgccgaaattgatgggaaattcgccgaaattcaggaccaaatccaggacttaaaagccgaaataaatcaaaaggtttactggaaggggaaaaattttagccattttgtattgcaaaaatggttctagtgctgaatacgcgtcccatggacttttacgcgtcccattaacttttaagcgtcccatgggtttttacgtatcccataattttttatgcgtcccatcaaattccaatttggacataggtgagaatttctgggcacaacttgggacgcgtattctgcactagaaccgaaaaaatatttattttgctagttttttaattccaataatttatcagatttttttggccgaaatttgtcctttaaatttgttaggcggccaaaatcagcattgaagtgcccgctcagggactcaccattcaacaggcgaccaaagcaggcctgttggacttggaaagcgggcaattaacgattatgtgtgacacggcgacaaacttgtcactggcgaaggctatcgaaattggcatgttggacccacactcgatgactgtgtgcgactcgagccatggtgaaaagcgagaactccacctcgataaggcgttgaatgaagga

SEQ ID NO: 67902 - DNA, 381 bp, Heterodera glycines
  Genomic contig location: Contig_ID=SeqID_39308; Location=1353..1733; Strand=+
  SCN-specific regions: Sequence locations=1-20,51-381
atgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacgagcaaaccccggtctggaggctagcaggccaacgtacagcaacaaacgggtga

SEQ ID NO: 67903 - DNA, 683 bp, Heterodera glycines
  misc_feature (83)..(83): n is a, c, g, or t
  Genomic contig location: Contig_ID=SeqID_39310; Location=141..823; Strand=+
  SCN-specific regions: Sequence locations=1-229,251-552,575-683
gttctcgaatcctttttggattccgagttctcgtcagagaacctccgcttctggtgttgcatccaggacctcaaattctctcncaattgtcaagttaaaacaaaaggccaacacattttggacgagtttcttgctcccggtgcgccctgtcaggtcctttcctccgttttttgcttccttcggtcaattttttacattaggttaacgtcgactctagaacgcttgaagaaacattaggatgcttgagggagtcggaccaagcattgcgaaaccagaggttcgctttctcagtttcggaggaacacgtgttcacactgatgagcaaagactcgtacccacgttttctccgatccggcatttacaaggctgttttggacgctgccaaggcaaagggtggcagaaaacggatcattgacctgatcagagagctgtcagggagtgccgtaaacactaagaaagtgcctgccaaataccacaaaacatcgcgggggagtgccgatgtggacaatacacaacaactgtcgttgaacgccaacaacttccccaaacagtgctcctctgactcattgcctgtgaaagtgggcagcttgggcggcacttcgccatcactgcaactgccttcgtccggcacttctagcgccagttctcctgctcttcagacaaaggaaagcaataaaagatag

SEQ ID NO: 67904 - DNA, 632 bp, Heterodera glycines
  Genomic contig location: Contig_ID=SeqID_8391; Location=13..644; Strand=-
  SCN-specific regions: Sequence locations=1-81,104-115,211-396,428 -449,479-539,568-590,626-632
  Gene Ontology: Mol. function=phosphopantothenoylcysteine decarboxylase activity; Biological process=G1/S transition of mitotic cell cycle
atgtttaaaagccttccattagtggaggtaaattagaaaaaaatgcgaataaaatattgaaaacccccctttttaattctacaaattacagaaagatgaaattgatttccatttggatgatgatgacgaagaagaagacgatgatgatgacgaagaagaagacgatgctgatgatgatgatgatgaggaggaggaggaggaggaggaggataaaagaaggccgaaaaagaaagcatttggatttctgaaaaaaatgttcaaaaagaaacgccattaattcgaatggcacggggaaaagtgcaactcttttgctgcatttgtgtttttttttctgattgattggcctattagtgcaagtgcaaatgcaatttttttctcctgaaatgcataaagaaaatttattgttttaaaaaactcaattgaaatcggcaaaattgttgtatgaattcaaaaaaaaaagttttttaatttaaattaagcatgactcactgtcattaaattagcaattatattatgcaccattccgttaacatttgctgcctttgttgtttgttgtgtaaaaatgaaattgatactatttagctgaaatgatttatttattatgaaaatttacaaaaataatttacaataaa

SEQ ID NO: 67905 - DNA, 1465 bp, Heterodera glycines
  Genomic contig location: Contig_ID=SeqID_8392; Location=976..2440; Strand=+
  SCN-specific regions: Sequence locations=1-182,241-258,285-361,384 -697,721-752,819-863,886-1169,1224-1465
atgcttctttcacagaatttggcatggtcctccattcactcgctgttcggcttcatcgcttttctgttgaccattttccaaccaatttcggcactcttccggtgccatcccgattcgtcctcccgtgtgctgttcaatgttttacacgcattcaccggatacattggatggctttgtgcatgtaataaaattttatatatttaatttaatttttaaattaaattatttttattaaataatctaatctttgaaattgtagtgacaatttaattttggtaaataaaatttcaatttttatttgtccgtattaacagaataattacataaaaattccaaaatataattggattttatagaatccataaaaataagaaggaaaaaactaatattcgcttaattatcagcaactgaaaaacggttttttttcatactttttagagtttcctaggagttcaggaaaaaatcctttactttatttttaattgtattttttgggcaattaaattaattatgaatttttcttcgtatttatgccatattttccaataattattttccagtaattgccatttgcattgcctgcgtacattttggtctgttcgcaaatacaagcgcagcaacagtgctgatcattgtgttccttgtactgcttggcattgttgcactgataatgcaaattgttgcctttcggaagggtcatcaacagcagcaggaacagcacggaacggtgggaggagggggggggggagaacattaattaaaaacaacaataattttaaaaatgaattaattaatataaatgcaaataatttaattatggtttaatattaatgagaatcattttcattgttgataaatatgaaaaaagaatttttgtgcattttttgataattgaattctaaattttttcccgtaatgcgcttatttataatttgaaattcacttaaaaaaatttgaggatgaatcttcaaattccaccctccccctaagtggaaataaaatcataaaattgttgcaaaatcgttctttgtgtgcttgtgcaactatggcttttgaactaataatttttttttgaaattttatgggttaaaaaggaatccaagagccgtcgaatggcactaacaaataagcacctttttggtcgcttatgaatgagcgaaattatgaagaattaaatttcataaatattttatggtaaaaaaaaaatttttttaatttttttagagccgtctaaactgtaataaaggcaaacaatattggcatcattaagttacccattcgattctctctatttacccataaaatttcaaaagatttaatccggtttaaaaacgatcctttatttacccttggcggactttaagaaatggcctcttcacgttttctgattaggacctagttttcaaaaaattcttttctcaattagataatttacatcgtcaatgtggaaagaaaggataaacaa

SEQ ID NO: 67906 - DNA, 504 bp, Heterodera glycines
  Genomic contig location: Contig_ID=SeqID_39312; Location=655..1158; Strand=-
  SCN-specific regions: Sequence locations=1-2,25-183,205-290,313 -443,465-504
atgcttatttctattccaaaaatgctcaaattgatcatggacaatcttaatctaacatttgatcattttataccggtttataacacattactgaaaagaactgagtgcattattgacccaaaaagagtgcttctcttgcctgccaaatgaatgtctgatgaaaattatctcctgaaatccctgataaaaaatatttaaatactccaatcgaatgctgctcttgtgctctacatgatgcaataaaaaaatcgctcagattccttctaggaacaatttctagcattctaaactttttctaaaatatttatacaattcttacgcaatatttcttaaacatattgccgaatgaatatttcttttagaatgtggcaacatttcctttagaatgtggccacaatttttctatgcaaattcagatgggcataactcttcagcaaattgagataaaaaatatttaaatactccaatcgaatgctgctcttgtgctctacatgatgcaataaa

SEQ ID NO: 67907 - DNA, 144 bp, Heterodera glycines; identical to SEQ ID NO: 57282
  Genomic contig location: Contig_ID=SeqID_39313; Location=286..429; Strand=-
  SCN-specific regions: Sequence locations=1-46,89-144

SEQ ID NO: 67908 - DNA, 113 bp, Heterodera glycines
  Genomic contig location: Contig_ID=SeqID_39316; Location=743..855; Strand=+
  SCN-specific regions: Sequence locations=1-113
tcgctttgcaatttcccgagggcctcacaatgttcgcctgcgtaatcgtcgacattctcgagaagcacaccggcgccgagttcatcattctcgcgcgacgtcacttatggaag

SEQ ID NO: 67909 - DNA, 1353 bp, Heterodera glycines
  Genomic contig location: Contig_ID=SeqID_1107; Location=6353..7705; Strand=+
  SCN-specific regions: Sequence locations=1-240,385-625,647-1302,1339 -1353
atggcttcgaatggcaaggcaacggaagcgtcgtcagaagaagtgcgttgttcgtcgggtgctgccgccgcgtccaccgcttcgtttgtgccgtcgtcggattcgccgcacaatcagccggggtcgcatgccatcgactggaagacgtacgccgctttgttatcctcgccatcgggcgccgatttgatggcagcgatgttttcttccgctgctgcgcttggaccgacgaaagcacacggagaggaggaggaggaagaaagcgaaagaggggagggacaagagaatgttggagaggaagagacgacgaggaagggacggacgacgaaacgaactgtgaaagacgaagagacggaagaagcggagggagaagagcgggagggaaagcggatggaactctaattgaactgtcattaactgaggagagggataatagatgattatttgtgaggagtgaccatgaccagccagtagaacacacttttgctttatttcctcagatatttttgtttaacaattctacttcattctctttattttctcggcattttaatttatgtgctctctttgaagcgggagattaagcgggcactgtccgctttcactattaatgacttgctctgatgattattttaattgtaagtaggcaaagaattgaccgtttcgtcgtccgttaattgcccgcggctgttgcattttcactttgtctacccaattgaaaaactaattatatgtataaattcttttctttactttgtgattctccttttacatattcctgttttcctaaatttacccattacattttatatttcgacatgaaaagattttgatggaatacgaacaccaacaaaaaatttgtcgcctttttagaaagttagctaattaaactttagtatcttagaaaatcgaatatcaaaatgtctttttttattaagtgtatgatgctcatattcacaatgctaaggataaaaatccgcatatacctagctgtagctatggtagctgcagatcgattaatctacggcttgaaacccgtattctcaactctgaatacgactggggatagttcgatccccagctacctatccaaaagatacggataagccactacttttccctttgttagtgtattctatgtctagtggtttgtgctttggacgaaaaagcgtctgtgggttcgaatcctttaggggctaatgtagtttgttagttttctaacaatatctatgcacctctaagaattgaaaaattttctcaaaaatgaattccctaaaatacattttttttcttgataaacttttgttaaaattttcttattcataaaaaattttaataattgcatttacaattgaa

SEQ ID NO: 67910 - DNA, 137 bp, Heterodera glycines
  Genomic contig location: Contig_ID=SeqID_1107; Location=8067..8203; Strand=+
  SCN-specific regions: Sequence locations=76-116
attccattttattttattttactttacatttcatattgttgtattttttgacattatttattttgattttttttttatgcgccacataagagcactaatgtgcctgtggtttgctcaataaatataattataataat

SEQ ID NO: 67911 - DNA, 407 bp, Heterodera glycines
  Genomic contig location: Contig_ID=SeqID_8393; Location=578..984; Strand=+
  SCN-specific regions: Sequence locations=1-407
tatttagaaaggcggggcttggtcccaaagaagcggagggctcgaagaaggaatggacgtcggagcagctgcgtgccggtgacgctatcatcggcttgcaaatgggctcaaacaaaggcgccaatcaaagcggggtatcgccacctaattttgagttgctaatcgcattttaaaaagatgattatgggaaacacgcgtcacatgtgaaaagaagggacagactgtgaaggaccggaattttgtgtaattacttcacttaaaagccttttgtttgtgatagtgctgaattgaccttaccacggataacacccttaatacattccttcttgccttgacacttttgcaattccatttaaaatccaagatgcatatttctaaattatcatagaataaattagtatgttttg

SEQ ID NO: 67912 - DNA, 1018 bp, Heterodera glycines
  Genomic contig location: Contig_ID=SeqID_8393; Location=1158..2175; Strand=+
  SCN-specific regions: Sequence locations=1-488,515-674,696-1018
  Gene Ontology: Mol. function=ATP dependent DNA helicase activity; Cellular component=nucleus; Biological process=nucleotide-excision repair
gacaggctccacatcgatggcctaagtgtactgtttccctatgaatatgtttatccggagcaacttttatacatggaacaactgaagaaagtgttggatgcgccagtaagcagttgggagtgttttcggtgctgtcctttgaatgggggagagatttgttttgagtcgataactgcgaatatgacatccattttgacattaaaactattggctaattaattataaagaaaatgtattttagggccattgtttgcttgaaatgccttccggaactggcaaaactgtttctctactggcgcttgtcgttgcttatatgagaaagtatccggtattttcacgatctcccatttaggctatttaaatttttacaggaaagactccacaagctgatttattgctcacggacaattcctgagatagagaaatgtgtcgaagagcttaaaaggctgtttcgctattataccaatgtcaccggagtgcgtttcacattttctcttttttaaattgttttctctaagtccgcccccgatttccttgccctcactctctccgctcgtaaaaatctgtgcatcaataaatccgtcgtcagttttcggtatggttcggccgtcgacggagcttgtcaacgtttgacggcgagttacgttcgggcgaaaaggcggctgaatccgaaccttccctgttgttcctttttcgaaaaatttgacgagaaaagggacatgactttgccgaagggtgtttacaatttggtgagttgattttctcatttctttcctaattgagtgctgatgcctaatcagtcagacttgcgggggtggggcaaagagcactgcatgtgtccgtatttcgtcgcgcggcacttggtaaatcgtgccgacatcatcgtctattcctaccattatctgttggacccgaaaatcgccgaattggtatcgcgtgaacttagaccccagtcttgcgttgtgttcgacgaggcgcataacatcgacaatgtgtgcatcgagtcgatgagtgtgac

SEQ ID NO: 67913 - DNA, 2022 bp, Heterodera glycines
  Genomic contig location: Contig_ID=SeqID_8394; Location=197..2218; Strand=+
  SCN-specific regions: Sequence locations=1-450,474-728,772-1377,1399 -2022
  Gene Ontology: Mol. function=ATP dependent DNA helicase activity; Cellular component=nucleus; Biological process=post-embryonic development
atggaatatgtgaagcatcgaatgcgggtgaagaatgtgcaaatcgaaagtccggccgcctttctcagagacattaagtccagggtttttgtcgaccgtaagccgatgaggttgttctgtcgtgccttccttcatttccctcttttcattcatacgctgttttaggttttgctctgagcgattcgcctccctctcaaaaacgcttgagttgtccgacatttctgacttcagtgcccttgtcaaactcacgactttcgcgaccattgtcagcacatattccgtcgggttttctctcgtttttgagcctcctgaagatggaagttccgttggtgactacgccattcatctcaattgtatggacgcctcaatcgcaattcgacccgttttggaacgttttcagtcagtcgttatcacttcaggggtaattctattctttatccagctgtttttactttacacatttttacaattagactctttctccgttggatatgtacccaaaaattttggactttgaccccgttgtaaaggcgagcctttcgatgactttggcgcgccaatgcatttcaccaatgattatttcaaaaggtaatgcaaaattggacctgtctaacaaaacatgaagagatttgcttgttcaattgagtgttagacagaaatttaatggtctataaaaaattttaacaatctgtttttataatttttaaactttaatttctcctttttttaagaaaacattttaaaatttaaatgacaaatgagtttatgtttcttcgttttccaggaaatgaccaagtcgaaataacaagtcgttttgagagtcgggaagatccttcggtagtacgaaattatggcactttggttttggagttggcctcaattgttccggacggaattgttgtctttttcaccagttacgtatatatggaaaatgtggttgctgcgtggtacgaacaggtgaattcaccaaaaatcattgctttaaattgttttctctgtccagcgaatgatcgacgaattggtgaagctgaaacttttgttcatcgaaacaaccgatgcactcgaaacatcggtggcattggaaaaatacgtcgaagcgtgtgaaagcggacggggggcaattctcttctcagtggcgaggggaaaagtgtctgagggaattgacttttcacatcatttgggtaggggaacaattcgtttattcactcctttcgctttgctaacacaggaagagcagtcgtaatgcttggcattccgtatgtttacacggagagtcgaattctcagggcacggctcgaatatttacgcgaccaattcggaataaggtgctgggggaggggcagaaaggaaagaatttcgtatttaaaggcattttttattactccaaaattcaagtcttttccccaatgtttctctgttgtatagagaaaacgactttctcacttttgatgcaatgcgccacgctgcgcaatgtgtgggccgagcaattagaggaaaaaccgattacggactgattatcttcgccgacaaagtctggacggaatggagaagactttttaattttttttcggtttttagcgcttttgtcgaaatgacaaacgtggaaaattacccaaatggatccaggaacatctgacggacgcgcaaaccaatctgagtatcgaagaggctgttatggcagcaaaacgatggtttccgttgatggcacaaccattcacgaaagagcatcagttgggagtttcgctgctgtccaaagaattgctcgggagtaaacaagacgacatattgagcaagtttcgaggaagtgttgttactgaaatggactgaccttacaagcaggttgcaaattggccgtcattgatctatttataccatttttaatttgcatttttaccatttattgttttttgatcacacaaatttttacctggaaaataatcttcaaatggtatttcttaacttgtttttttttcatttaaatattgtatggattgtcctattgtctcatcttttcattagtaa

SEQ ID NO: 67914 - DNA, 1024 bp, Heterodera glycines
  Genomic contig location: Contig_ID=SeqID_8395; Location=464..1487; Strand=+
  SCN-specific regions: Sequence locations=1-908,930-955,977-1024
atggaaggacaacaaacggacagcggaaaaaacgcaatcgccgaacagcagcaaaaggacgaatggaagagacggccgaatccgtcacggagggcgcaaatgcattacgaagacaatgtgagggacacgctgaggacggcggggctttccgaacaatcggcggaggaaatttggcaggcgcttggcattctcgcgaggcaccaaataatggtattggtcaatcagggaagtgtttggttatgcaatttgaatggttaattcagccacttggcatgggacttggacttgtaaaacggcgagcgggaagaagacgcattgaaatggaggccaaaaacgaagggaaggcagaattttgaagtgacatggacacattaattattctttgtgacaaattgtataaaagtgtaattaaatggacccatcccggataagaaaaagacaattgccaccatcggttgccctgtcggtttattgtattgccttttgtttgtcttgtatgtttctttcgaattatatcttttaagccttttcaatgccgttcttccccaatttgcctctttttcggtgttcgcctcaattgcataggtttcgtcctgcgccgctttctctctcattccgccgtgccatttcactgagtgtcgtccatcggaagggccattcgcattggcaaaacaccaaagacgtaaaggcaaagaatgacgcgattcgcgcgagtgggctgaacgaaatgatgaagcagacgaggaaggcggtcaaagatgggtacgacccgaaaaccaacagacggctccagaagataatggaagtgagattctcgccaaagggaccaaattcaaagcgcgaaataaatctttcccatcgttccaggacatgaagaaacagtcgctgcctttggataaattccgcacttttttggaaaagttaaaggtgataaatcacgggctaatttattacgaaaaggaagggcaacaaaagaatgtttgaaagaccaaattggcatttttacgcccttttaccgacgaga

SEQ ID NO: 67915 - DNA, 593 bp, Heterodera glycines
  Genomic contig location: Contig_ID=SeqID_39323; Location=560..1152; Strand=+
  SCN-specific regions: Sequence locations=1-26,49-362,384-540,562-593
atgcgcttcccggcctacacaattgcgaatggggaggaggacgaaggacaacagaagcaggcaaatggaagtggaaacaaaacacggaaaagcaatggacgaagacggaaaaatggacgaggaaatggtaaaaaaaacaaacaacaaaaacatcaatgacgtcaattaaattataagtgttagcactttcaaagggtagccgccctagacccttgggctttgggtgggtggagggggcttacccgcccgcggggcgacctattttaatgagttttcaggtcaagcggtgccgataagcgccgccagcacaaaatggatttttatacattttttagcaaatgttcatcgaaaatttggcaatattgcaattttatggaaattttggaccggtggcgaaaatttgaatataattttttgaagaattttttattgaaaagtcttaatatttttttactaaaaaacccactaagaaaataattttcaatttattagctccccgtagcgatcagaccaatgagaatgatcataatttcttccgaaactttcttaaaattctgaatcacaattcttccacaaaaaatgatctagattaa

SEQ ID NO: 67916 - DNA, 1097 bp, Heterodera glycines
  Genomic contig location: Contig_ID=SeqID_39325; Location=22..1118; Strand=-
  SCN-specific regions: Sequence locations=1-360,383-535,557-738,761 -1097
cggaaaaagcacaaattgagggaaaaaatgaggtggaagtcacgagaacgcaactggggcagaacaaagccaaaaacgacactttacgaaaagaaagcgacgcacagcaaaagttggcttcagaattaaacgaagggtcgtccttctgcccagcaaaacaacaagtcagttggatagaagtgaatggaagcgaaattggacaaattgatggagagagagtaccgatttggaagccaatggaagagtttgaagaagaagagaaatgggaagagaggaggacacaatgcaaagagaacgatgagatggaccaattggagaagaaggcaacggatgtggtggaagaatggaacgcacgagtagggggaaaagtgggggaggaggagacggaagtcgaattgcattttgtgggcggagagcggacggaaagggaagcggcgacggaagtgtgttttggaagggattgggcgaacagacggacaaccgtacgagaaactgaagacggagtcggacggaaggccgaaagctctgtgcattttgagaaaagaaaaaatgagatgccgggaagagcgtcttactttcaaattcatcaacggatgaagatgggacggaaattggaagacgacgaatgcgacaaatcaatgccaaaagacacgatcattttggaacatatgaacatcacggaattggaatacagtggagggacaattggcagacgaggacaatgcgttcagacaagcataagcacacaaataaacagatgggcagcggatgaatggttcaaacaaattccgacgagggaggagttggaggaggaaaaggacgaaagagttaagacaaaggaggaagtgagacggaggagaaacagtcggatggatgagtcatccgagagagtgaccaaagttagaagcatccggcggaagagtggaacggaagaggacgacgaggaagggggaggaacaaaagggaatggagagggacaacctccccaactgtacagcgagtttgagacgattcatcacggcaaaacggaaggaagcattacgagaacacggcaccgacaaaaacggcaacagccgaagtcgccgtcacgcgtcaca

SEQ ID NO: 67917 - DNA, 189 bp, Heterodera glycines
  Genomic contig location: Contig_ID=SeqID_39330; Location=554..742; Strand=-
  SCN-specific regions: Sequence locations=1-20,42-156,179-189
atgcttgctggtaggaaactaagttgaagtgttttctaattttcaaaaaaaattccaggcctctacctatacttggaagggctgcagaaattggcaacttttcagtaccaactttttccagttcagtccccgttgaataactcattaggctttgacctgagcgcagggtggccagcagacttattgtag

SEQ ID NO: 67918 - DNA, 1074 bp, Heterodera glycines
  Genomic contig location: Contig_ID=SeqID_8396; Location=383..1456; Strand=+
  SCN-specific regions: Sequence locations=1-154,176-733,758-1074
atgagcaagtgcgcattgactctttatcaagtgacattttatcggaaggtgacaaaatttctgacatagcaaatgaagacgcccaacaaaacgacgaccttggtctgtttttatatgttgtcacgtgttttagtttaaaactgataaaaatcttaaggaccaagggccgggggacgaccatcaaaaaagatccgcggaccaggacggaagaccttaacaaatgatgttgggagaggagtcacccctttgtttgaagacagtccgtccggcaggggcgaaggtggcgttaacacgcgtcggattacggtgatttcggcgcttttatatgttacattgctaattaattcttaagcttcgaaacaagcatatttgtcaaatcgaaaaggccctttacaatgttttagaggattattcaaaacgtccttggccctcgaagaatcagagtctggattttcaattcataaatgaatttcaacatgttttcagctaagcaaacttggacccgttgcagtgaggggtgtgagtgtttgtctgctgctcaatgtcaacaaaatgcgcaggcttatattgccgtttcgaagtatgaccaagaatttactccaaagaagacaatgccacaaaaaatgaccaaaataaccaaaggctgtcatcataagcatgtttgcgcttccgcaggggcgcatcacagagtaaatgatcgctacgaccaacttttaaattccgctttacatttttcagattgattattatgacagcggtcaattcggcgatgccaactgcaaatattgtggtgctgttcttttggaaagcgaagccaatgcactaaacaagcaggggcgtgtgtcaccttgctgttccaatggccagtgtcacaccgagcaaatgaaggcagaattcgacgagttgcagaaccctccgcaattactgaaagatttggttgcggctccggatgaacgcattcgttttgagtttttggacaacacgatgccacttaacaacacctttgcgtttgcatctgtccatagtgagaaggcaccagcggagcaaatggctggcccgaatggataccgttaa

SEQ ID NO: 67919 - DNA, 2543 bp, Heterodera glycines
  Genomic contig location: Contig_ID=SeqID_8397; Location=238..2780; Strand=+
  SCN-specific regions: Sequence locations=1-438,460-466,489-578,603 -1458,1480-2309,2338-2473,2496-2543
atgaattacggtcccccaccgcgaaagcgcgctcgccttggcttcaccattgacgaactgcttgagcttcaagatcaacagcagagcggaagcggaccttctcacccctcagcatcaccaacagcacttggaaacggactcgacgcatacgtgatgaaattggatgaggaagtcgaacatgctccacgtttcacaatgacaaaggtgaagtcaaagtttatgatcaaggatttaccagccgacccggaggctctgttgtcacaaatctttcagaaatgccttgatgaagcggtggatgagagcaagcagcatggacacacaccggatcgactcggttgcatgatcagcagtgagctgttgaatcctgacatttggacacccatccgtgaaattaccgacaacacaacggacgtgatcttgaatcgactactgagtactgcccaaagcaaaaagaagaatggagtgtcgccacaaaaaataaccaaaggctgtcatcataagcatgtttgcgcttccgcaggggcgcatcacagagtaaatgatcgctacgacaaacttttaaattccgctttacatttttcagattgattattatgacagcggtcaattcggcgatgccaactgcaaatattgtggtgctgttcttttggaaagcgaagccaatgcaataaacaagcaggggcgtgtgtcaccttgctgttccaatggccagtgtcacaccgagcaaatgaaggcagaattcgacgagttgcagaaccctccgcaattactgaaagatttggttgcggctccggatgaacgcattcgttttgagtttttggacaacacgatgccacttaacaacacctttgcgtttgcatctgtccatagtgagaaggcaccagcggagcaaatggctggccgaatggataccgttaaatacaacggtagaattcgttttgttttattttttaaatctattttaaggcgaattttcgttcatgctcagcgaccttatctctccgcaggggcgtcgtccaacgtttgctcaagtgtatacactgatgccggaggatgctttgaagttgcgtacggaaaatattacacaagccttgtcaaaaaacattcggaatgagattcttgcaaaactggagcttctgatgcgagaaaaccctctcggacaaacatttgtcactgcaggggctaaaattgaagaagcagctaaacaaaatgatggaatactgccacattttcaagtggctgtagcttttttacttttgtatttttggctattaagattgtccttctgacaaatcgtgatctgaaagtagacgcgcttcgtacccgtactgattgtaccattatcgaacgtgctgatgctccaactgctcagcaagtcgcagttatatgggttcaagaggatggtctagcgccagaagtaaatggtaatgtgttgatcaaacatttatgcttttatgtttaatttttgaggtttttggatttgtgacaaggcaggaaaaatgcgggaattgaagagtggaatgccgcagctcgacccttgctgttttcctttgttacacccgaggggcacatttgggtggcgttggtttatgaagaagacaggagcgcaggggcgcccggtaattattttttctcattaaaaaaatctaaaaaacagactgtgcctatgtcttcgcattctaatatgcaaacaggcgaagggggacaacaaaatattgatgattcggtgactgaatttgacaatgatgatatatgtgacaatgagcaaaggcgagaatttgagtctgacgtaaatatttttgctttatttttgcttcataattccctatttaagcctattttttcgacaactgattctgtcattgaacttgcttatgaaacatttccaagaaaacgtcaacttggcattaagaaagttgggccgcaggaaaacatttctgaacgtcaattttaccgataccgtttggcaattcgggaaaacagcaggggcgccttccattggctttggttttcacgccgtctcgcggaatatttcctcattgctgtgctcaatcggattgaacgcaatgaaatggaccatgttaaggcgattcagcaaaaaaagaactatcgccaaacacttgctcgcgattacatcaaggctattgagcaaggactccagcagcaggggcgtaatgcaaaattaggctccgtctttatgatgcctcatacttttgctggatcaagacagtactatcagcaaaaatacgcagatttaatgacagttgttcgtcatttgggaaacccaacctggtatgtacattataagcaaattattttttaaatatttatataaaaggttcgtaacgtttacgggtaatcccagctggcccgagttaaaagaagctctgcaagggcgccaacaatatacccatcgtgcggatattgtgtgtcgtattttcatggacaaggcttctgaatttgtccgtgatttgatcgaaaagaatgtgcttggaaaagtggctgggtggtgttatagtgttgaacaccaaaagcggggttaa

SEQ ID NO: 67920 - DNA, 477 bp, Heterodera glycines
  misc_feature (441)..(441): n is a, c, g, or t
  Genomic contig location: Contig_ID=SeqID_39332; Location=1..477; Strand=-
  SCN-specific regions: Sequence locations=1-20,89-107,155-172,379-477
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactganaatcaggatcaagtaagcatttgcctttttgctcta

SEQ ID NO: 67921 - DNA, 274 bp, Heterodera glycines
  Genomic contig location: Contig_ID=SeqID_39333; Location=61..334; Strand=+
  SCN-specific regions: Sequence locations=1-93,115-220
ggcccacctctgaccaatataaaacgggcacataaaggccgattttccgagtcaagccaaattgaagaaaatgatgaacaaattggacgttccaccaaacaattaaatatgactaatgaggacggagaacggcagccaattaggcgcagcaaattggctggcattggcattcttcacacggcacgcgcaaatcgattggaatgttgggcatcgatcaatcaatttaattaaataaaatattagattaatagaatgattcattaatatattttaa

SEQ ID NO: 67922 - DNA, 284 bp, Heterodera glycines
  Genomic contig location: Contig_ID=SeqID_39334; Location=42..325; Strand=+
  SCN-specific regions: Sequence locations=1-284
ctgaacgatgacattgcgcagctgttcccgaacacttttttggtcaacgaaagcgacaaacaacagacagtgatcgcggaggaacggttgaacagcttgaaggagtggttgagcaacgactgtcgcgtctccaggcaacaggtagggcgggtgcataacatcgcgtttttttcaaaaaaaaaagattgggtaacaggacgggacccgtattgtcatttgtccggaaaattttaattttagggccaggctccaattgacgaaacaaatttttaaatttgttaaca

SEQ ID NO: 67923 - DNA, 557 bp, Heterodera glycines
  Genomic contig location: Contig_ID=SeqID_39337; Location=498..1054; Strand=+
  SCN-specific regions: Sequence locations=1-169,191-557
aatatcagctggatctgatggacagttacatcgacgccctaatgctttacgacgagggcaggtaaaatggggacaaaggacaaccaaaaaagaaacgaaaattatttcgaaatttacttggaaaaggataaacgggcggactgcgaggtgtcttttgcttttgcatttcagccaagtggagcagctgaagaagcgccaagtgcacgacccgcggcttcagtacgaatgccaactgttgcggaaccgcgccatgcacccggacaaaaaagggatggaactgagtgcggaagaccgtcagagactgctcgaaaccctttcggcaccaaagcaacggatggacgaagcgcagtgagtgaccgaatggaaattgggcggagaagggcaccattcgacccgaccaaaataaattgatgaattaagggtcgtactggacgaaatccgtgaggagtttccgcgggagctgaacgaaaacacacggatggccgcatttcgtacaaccaaagctaagacggacacgctcggccaagtcgatgaccgtctccagcccattgtgccgg

SEQ ID NO: 67924 - DNA, 198 bp, Heterodera glycines
  Genomic contig location: Contig_ID=SeqID_39340; Location=788..985; Strand=+
  SCN-specific regions: Sequence locations=1-198
atggcatcacgattgaacagacttttattggtagtttatattcaaatatttctcattgagaattacattcataaatgcagaatttatttgtctattaattttactcagtttgtagcctgtggccagtccaaattgggtcgtgccggaggatggcaattccttcagctggcaatgaatgacgaccaacggtgcacgaat

SEQ ID NO: 67925 - DNA, 387 bp, Heterodera glycines
  Genomic contig location: Contig_ID=SeqID_39340; Location=116..502; Strand=+
  SCN-specific regions: Sequence locations=1-168,190-196,233-248,300-387
ggcgcctctcggcaccgccggacccccttcttccccaaaagttttttggaataaacgcgccgcaaaaaattgatgtgaaaagtaaatctgaattcaaataatattcgatcatagtccaaaatgattaattctttgaaataagtgaagaaaatttgtttgaaaattttcattaatttaatttagctttaacttttggatttattaaataaaaaacaaaataaaatttaattttgtgccattttctcttgaaataaattaaaatttgaattttttaaaatttttttgaatttttaaaatttcctggttggtcccggttcccggtcccgaacaaaaatcgaggtcccggtcccggcttctctcaggtcccggcaagtcccggtcccggtt

SEQ ID NO: 67926 - DNA, 195 bp, Heterodera glycines
  Genomic contig location: Contig_ID=SeqID_39341; Location=41..235; Strand=+
  SCN-specific regions: Sequence locations=1-195
atgaacgtcgtacgcactctccccctgatcgtcctggccaccgccctgaccgcctgcgccggcaagcccgcacgcagcgatgcaccggcggccagcaccgtggttccggccaatgccgctgccgaagcccccgctgcagttgccgatggcggaacgatcgaccctgccgtggccgttccggcggcgcaggcgccg

SEQ ID NO: 67927 - DNA, 1032 bp, Heterodera glycines
  Genomic contig location: Contig_ID=SeqID_8398; Location=876..1907; Strand=+
  SCN-specific regions: Sequence locations=1-300,322-460,482-548,571 -1032
atgacttatttcgagtatttaggttagttcttttaaacagagaatttgggtccaaatgtgtaaaaccatgtaaaattttgtaagtagttaggaggtcaaaaatttttcttcgtttttcaagagtagctaatttaaaaaattggagccgttggtcatagggaatatatggaagacaacattttctgaaagcaattcgagtaaaatatttttgacatttttcaattttaataatatgtgattttagttgcggattccacgattcaggggaatattctagaagtggacgaatataactaacataaatatttttccaaactgaaattttctttgatttaataacacggaaaagtaaacgcatacggtagtaggcgttacgggtaattttgcttatatgttcggaaaaagtaaatttattgtcaataagaatccctaagtcacgaatagtttcaacttcacaaattgcattatcattaattttatattgttccctggggttattctttccgaagtaaatgataaaagttttattaatagaaattttaatataccatttcttagaccaatcagagagaatatttaaagcatggtgcatagcaattctatcattttttgttttatgtacggaatataatttgacatcatccgcatataattttatagaaatttgtttaggaattaattcaggtaaatcattaatatatatcagaaacaaaagaggcccaagaacagaaccctggggaacgccagagctcattttatactcagaagagagagtattatcaacccgaaccctaaaggtacggtttgaaagaaagtcagatatccagtttaagattttacccctaataccgattctatgaaccttatataaaagtaaattatgggggataacatcaaatgctttcctaaaatctatatagacacaatcgatattcttattattataaataccatcataccaatttttaagggttgaaattaggtgtgttgtggttgatctgccctttataaatccaaattgatggtcggaga

SEQ ID NO: 67928 - DNA, 1690 bp, Heterodera glycines
  misc_feature (85)..(85): n is a, c, g, or t
  misc_feature (110)..(111): n is a, c, g, or t
  misc_feature (115)..(115): n is a, c, g, or t
  misc_feature (141)..(142): n is a, c, g, or t
  misc_feature (152)..(152): n is a, c, g, or t
  misc_feature (199)..(199): n is a, c, g, or t
  misc_feature (227)..(227): n is a, c, g, or t
  Genomic contig location: Contig_ID=SeqID_8398; Location=637..2326; Strand=-
  SCN-specific regions: Sequence locations=1-8,31-32,54-396,419-881,904- 970,992-1130,1152-1480,1502-1564,1588-1613,1635-1690
aatttttgcaaaaattttttctgaaaactttactgtaaataattattctctgatttttgatacttctttttcttctccaacaatnaacgaagtgaaatttaatatattcnntgtnggtaaagttcttaaaacttacctacnnagaaatacancatcaccggacggtattacctttagactgtaaaaaaattgttctctntcgtttactccttttgttactgaaattntcagactctcccttgatacaggaaagcttcccactatatggaaacaatcgattattatccccttgcataaacaaggggaaaaaagtaaccctatgaactataggcctattgccttaacttgttctttatgcaaaattatggaaaaatttattgtttgggctatttccgattttcttttaaagaacaatttattctccgaccatcaatttggatttataaagggcagatcaaccacaacacacctaatttcaacccttaaaaattggtatgatggtatttataataataagaatatcgattgtgtctatatagattttaggaaagcatttgatgttatcccccataatttacttttatataaggttcatagaatcggtattaggggtaaaatcttaaactggatatctgactttctttcaaaccgtacctttagggttcgggttgataatactctctcttctgagtataaaatgagctctggcgttccccagggttctgttcttgggcctcttttgtttctgatatatattaatgatttacctgaattaattcctaaacaaatttctataaaattatatgcggatgatgtcaaattatattccgtacataaaacaaaaaatgatagaattgctatgcaccatgctttaaatattctctctgattggtctaagaaatggtatattaaaatttctattaataaaacttttatcatttacttcggaaagaataaccccagggaacaatataaaattaatgataatgcaatttgtgaagttgaaactattcgtgacttagggattcttattgacaataaatttactttttccgaacatataagcaaaattacccgtaacgcctactaccgtatgcgtttacttttccgtgttattaaatcaaagaaaatttcagtttggaaaaatatttatgttagttatattcgtccacttctagaatattcccctgaatcgtggaatccgcaactaaaatcacatattattaaaattgaaaaatgtcaaaaatattttactcgaattgctttcagaaaatgttgtcttccatatattccctatgaccaacggctccaattttttaaattagctactcttgaaaaacgaagaaaaatttttgacctcctaactacttacaaaattttacatggttttacacatttggacccaaattctctgtttaaaagaactaacctaaatactcgaaataagtcatttttccggttaaatgttaaattacaatctaaaaaatcttccaaatcttttgttaacagatcagtcaaggcctggaatgcccttgataaaacgttaatgtctagctccttaaacacctttaaaaaattattagaattgactcttgattctgaaagcaccaatgtataaagaattattaacttttgaggcattttattgactttgacctcgattttattttcatataaatttttcgttatt

SEQ ID NO: 67929 - DNA, 1253 bp, Heterodera glycines
  Genomic contig location: Contig_ID=SeqID_8399; Location=906..2158; Strand=-
  SCN-specific regions: Sequence locations=1-503,526-970,1004-1253
catttcaatcactgggactcaacccaccagcatttcaatcactgggactcaacccaccagcatttcaatcactgggactcaacccaacagcatttcaatcactgggactcaacccaccagcattgcaatcactgggactcaacccaccagcatttcaatcactgggactcaattctcctgcatttcaatcactgggactcaacccaccaacatttcaatcactgggactcaacccaccagcatttcaatcactgggactcaacccaccagcatttcaatcactgggactcaacccaccaacatttcaatcacttggactcaacccaccagcatttcaatcactgggactcaacccaccagcatttcaatcactgggactcaacccaccagcatttcaatcactgggactcaacccaccagcatttcaatcactgggactcaacccaccagcatttcaatcacttggactcaacccaacaacatttcaatcactgggactcaacccaccagcattccaatcactgggacaacccaccaacatttcaatcactgggactcaagccaccagcatttcaatcacttgggctcaacccaacagcatttcaatcactgggactcaacccaccagcatttcaatcacttgggctcaaccccccaacatttcaatcaatgggactcaaccgtacgggggccttcggccccactcaccaaatttttgcgtcaaaggtactcactcggccgcttcgcggcctcgtaactggggccttcggctccattccagtcaccaaaattcaatctcaccaattcttcgaaacccaataaccggaaatgaatgataaaaccgacagcggctcgaccgcttagcggcctcgcactcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacacacaacaaagaaagaaaaagaaacattttaagacttttttacacaaaatgacaaaagaaaaaaatgtaaaacaaaaacatttcatttttcaaagcatttatacaacataacacaatgttaatattataggattttcttagtgaacaaactaaggggtgtcctctttcttttgttaaatatttatacaataaa

SEQ ID NO: 67930 - DNA, 830 bp, Heterodera glycines
  Genomic contig location: Contig_ID=SeqID_8399; Location=1477..2306; Strand=-
  SCN-specific regions: Sequence locations=1-651,674-830
  Gene Ontology: Cellular component=cell wall (sensu Fungi)
caatcactggggactcaacccaccaacatttcaatcactgtctacacaacccaccagcatttcaatcactggggactcaacccaccataattccaatcactggcactcaacccaccaacatttcaatcactgggactctacccaccagcatttcaatcactgggactcaacccaccagcatttcaatcactgggactcaacccaccagcatttcaatcactgggactcaacccaacagcatttcaatcactgggactcaacccaccagcattgcaatcactgggactcaacccaccagcatttcaatcactgggactcaattctcctgcatttcaatcactgggactcaacccaccaacatttcaatcactgggactcaacccaccagcatttcaatcactgggactcaacccaccagcatttcaatcactgggactcaacccaccaacatttcaatcacttggactcaacccaccagcatttcaatcactgggactcaacccaccagcatttcaatcactgggactcaacccaccagcatttcaatcactgggactcaacccaccagcatttcaatcactgggactcaacccaccagcatttcaatcacttggactcaacccaacaacatttcaatcactgggactcaacccaccagcattccaatcactgggacaacccaccaacatttcaatcactgggactcaagccaccagcatttcaatcacttgggctcaacccaacagcatttcaatcactgggactcaacccaccagcatttcaatcacttgggctcaaccccccaacatttcaatcaatgggactcaacc

SEQ ID NO: 67931 - DNA, 95 bp, Heterodera glycines
  Genomic contig location: Contig_ID=SeqID_39342; Location=529..623; Strand=+
  SCN-specific regions: Sequence locations=1-38,60-95
cgcaaaaacttcaggtgaaaagactgaaattggtcggatttgtgcaaaacatccatgtttcgaatcccgaacccgaattcggacaaatttcttga

SEQ ID NO: 67932 - DNA, 572 bp, Heterodera glycines
  Genomic contig location: Contig_ID=SeqID_39343; Location=316..887; Strand=-
  SCN-specific regions: Sequence locations=1-212,236-245,267-572
atgagccgtaataggtcatcaaggagcactttcagcagcagaggcggagggtcggatgaggaagtgcataatcacttggacaggaaccgaagcataaaacaggaattaactgtcgtgaaaaataatcagaaaatgcaaaacgaggctcacaaaggatcattagagtaaagatttaatatcaataaattgatataaaaaacgataaatttagggtaaatgtaaggatctagagtttatactagagcccagtaataactggaaaacggaatatttaaaatacactcaaaagcctaaaatgcaatgcagcatagcacggattgctgttgtcgtgggttcgattcccagccgctttcttggcttagtagaaataacgattaattaattattcggcatttctcgagctacttggaatccgtagcttcaaatttaaatcaagattttataacacataatttttcaggatgcttcgagaaagttatgaccgtatgtgcaattccaaaggaacaagagcagccaaacagacgcccatgattgatttttatgattattataaagacatgaaggcacgtgtg

SEQ ID NO: 67933 - DNA, 1021 bp, Heterodera glycines
  Genomic contig location: Contig_ID=SeqID_39346; Location=40..1060; Strand=-
  SCN-specific regions: Sequence locations=1-561,583-598,624-1021
atggatgcgcgagtgagtcaacagtgagcttcactgccgtgcatatttatgcgcatattttggccactttttgtgcatgtttttgaaagccctggtcattaattaattttataattgttattcgaattcagtggcttaatgagagggtaaatcttggctgcgtgttgccaagccaagaagaagccaccgtttatgtacaagcccaacaagtttttgactttatcgacaaaaacgcatcaaaattcgagcttctatccccggaacaatattctgattttcgcttgagtaaattgatacctaattcacttccttaaaaaaacctattttaggaattattagtgctgtgtcaatggcaaaaaacatcgccctgctagactcaataaatcgtattaaaaataatttacatataaatgaaaatcgattaattttttagaaaaaattcatggaaaaagcatcaatgcgcttgaaaacgcaataattgaactgcgacactccgtcatacaattgaacgtcggtggcatcatgccagattacgaacggactaacaatccacgcaggtgctaaaagtaaaatatttaaatgaactgcaaaatcaatcaaatatttaaatatatttttgcattcattaagcaaaagtagaatgaatgatcatgtatagttttacattttttaaagatagtatctggcgaagcaaacacatttccgttttcaaaaattttaggtgcattttgaacgaaattaccacagcgaacgaggatgttcgcgaagcacttttcgagatgatcttgatgatcgaattagatgccttaaaattggtctgaaagtttttccattatatactactaactgaacacccaacaaacaggtttccattggcacgttatgtgccaatgtttcgcattcaggtgacaaaaaagagactttagatgagctgtccgagcttggcactttgggcatcaacataactacttcaatgcggttatacagcgaaaaaaaattagtaattaacatggaaaataaa

SEQ ID NO: 67934 - DNA, 385 bp, Heterodera glycines
  Genomic contig location: Contig_ID=SeqID_39347; Location=189..573; Strand=+
  SCN-specific regions: Sequence locations=1-142,170-385
  Gene Ontology: Mol. function=gamma-glutamyl transferase activity; Cellular component=integral to plasma membrane; Biological process =spermatogenesis
atgcccaatggcttcggttttgccccgtcaccggcaaatttcattgagccgggcaaaaggccaatgagctcaatgagtccgatggtcatattcgaccaggaaaatggaaaggtaaaagcaaaaacaagcaactgctaaatggattaattaattaagtaattaattaatttgtcagttaaaatttgttatcggcgcttcgggcggctcaaaaatcatttcggccatggcgaagcccgtgatccgcgtgctgtgcttcaacgagacaataaaagaagcgatcgacgcgccgacgcttcacaaccaattcacaccagacataacgcaatttgaggagacagtgccaaaggcagagaaaaaggggaaacgaaaaaattaaaaacaaaaa

SEQ ID NO: 67935 - DNA, 508 bp, Heterodera glycines
  Genomic contig location: Contig_ID=SeqID_39349; Location=300..807; Strand=+
  SCN-specific regions: Sequence locations=1-114,136-214,236-397,462-508
atgtcggctattatatgtattaaagcacacgaaattgaaaaagctgattttcctattcatttggtaagttcgaaaaaatgttacgttagattttaaagttataaaaacttcttaaaaaatgtacaatgtgtgaaattttttaaattttcgacaaatttctattaaggtatttttatgtcattctgtcaactacggaatgaacaggaaaaacggctttttaatttggttaattttaatttcattggcattttctgcgccagttttgacaaataaaaaaataagtgccgacgtactcgcattacccaaacattcgagatcggtcgagattctattgattttcaaaaatatccgctttttttatcgggtttttgtttttttctagactatattttaagacaataaatttaaaagaaataattttaataaggaaaaaatttcttaaattgtaaaaaaaaatatttgtaatttgcagataaggtttggcttccaaaatcagaatctttattag

SEQ ID NO: 67936 - DNA, 1188 bp, Heterodera glycines
  Genomic contig location: Contig_ID=SeqID_8400; Location=28..1215; Strand=+
  SCN-specific regions: Sequence locations=1-40,95-105,142-180,203 -264,288-336,359-375,397-453,476-516,539-674,703-749,783-944,966-1188
aattattacactcgcaaggctcgccggcgacacaacgaggagcaacagcaacaacagcaacaggtatcgttcaacaacggcaacaacaacaacagttgcatcgcaactggtgctgctgctgttgctgttgctggtggtggtctcctcagcgcaacaaatgccaacggcggccacaacatcggcggcggcgccggcaacaatttgagcgcctttttggtgccaactccgtccgctgctgctgctgctgcgattgctgcaggcatccaacagcaacaacaactacaacagaagcataataaacaggccaataatttgttggccgacattcaggttctaatgatggtggtggtggtgaatgggtttttttgttggcacatttaaaaaaattttttttttccaatcagtcacgaaatagggaaaacttaaattgtcagcaatttgttgccaaaaagaggggttgggtggtaaaaaatttggcgctatgtatgttaaaaagtgaacaattttgaattttatcaaaaagtaaaaacaaaagcaccatttttggcttttgcaaaattttttaaatttttgttctagttcgggttagggcttagaaattggtgaaaatagatgtcgtattcgtgattagcgacctctaaaaccttggataacaaattttcaaaaattgtgcaaaccaaaaggggggtccccccttttgtttttactttttgataaaattcaaaattgttcacttttaacatagcgccaaaattttatgaaaaaaaaaaatttttttttttgacttaccgatttttcccgggggggggtaataaaatttcatcatacagtttttttttgtgcatcatcaacaaaatttactctctgtcacccctttgtaaggacatttccatggttccctcgtgttcgtcgaccgctgtcgctgcttcgattgtcgctgcaacacaacaacagcaacaccccatgggtgttggaggagtacaacagcaacaacagttcatgcacgacgtgcagcagcagcaacacggcacaaacatggaggcagcagcagcaacgcaacacctccacaaccacggcaacagccaccacaacagacggacaattgcctacccgaaaaacagtgccaccgccaaacacaaaagtgccgcggtacgcgcaaaggcccaacaaatcctggcggcacaagcg

SEQ ID NO: 67937 - DNA, 4218 bp, Heterodera glycines
  Genomic contig location: Contig_ID=SeqID_8401; Location=197..4414; Strand=+
  SCN-specific regions: Sequence locations=1-173,195-195,223-323,353 -494,519-622,651-770,795-933,955-981,1043-1199,1237-1502,1524 -1589,1631-1997,2033-2246,2287-2491,2514-2597,2620-3057,3109 -3115,3137-3256,3286-3514,...
  SCN-specific regions: Sequence locations=...3537-3552,3575-3857,3887 -4218
  Gene Ontology: Mol. function=non-membrane spanning protein tyrosine kinase activity; Cellular component=nucleus; Biological process =neurogenesis
caagcccaggcggcccagcaacagttgggactggtggacgatgaccaggaatgtgatgacgaaaacaacgactacatcatacggaatggcgaagtgttcaactaccggtaccgcattgagtccagcattggcaaaggctcgtttggccaagtgaccaaagcgtacgacatggtggaggaggagatggtggccatcaaaatcatcaagaacaagaaggcattctatgaccaggtgggggaaggggggagggggaatgggaaaaatgtcaacaattatctgaatgtgtgtccatgctttgtccgtgtcatttcggcacggaaccgaaaaaaaaattttttttttttgaaaatatggacttttttaaacttatcaaaaacaagaaaaaacaacaacaacaacaactgaatgttgtcggtgtgtgatttgtccgtatcattttgacatggcgcacgaaattgaaaagaaaattttttttttttttttgaattttggagttttttgaaacagtaagaaaatatttaaaaaaatttagtagaaaaaagctcaatgtaaagaacctagaaaacaatttaaaaaaaattcagaccgggaaaacgtgggggcaactggggttactcccccgaaaaattttaaaaaattcaaatttttttgcgatttttcaattcgaagatttttgaaaaaattaaaaaaataggggcaagcaaaaaaaaaacctaaattttatttgaaagggctcctcactaaactcagcttaaatttaatcctccatcaaaaaaaaaataaataaaaaaattgctaatttccatttccttacggtttcgtttttgtccaggcccaaattgaaatccgtctgctggaactgatgaacagccacaactccgagggtcgctattatgtggtgcagttgcgcaaccattttgtgtggcgccgccatctttgccttgtgttcgaactgctctcatacaatttgtgagaaatttcaaaaaaaatattttcaattttttttattatattttaatttaaaaaaaattaatttaattaagcatattcacagtttttcaattgtttccaggtatgatttgttgcgcaacacaaatttccacggagtgtcgttgaatttgacgcgcaaatttgggcaacaattggccgccactttgctgttcctctcccaacccgacctgaacattatccactggtggaattaaaattatttaaaaattatttaaattatattttcagcgatttaaaaccggaaaatgtgctgctctgcaatccaaaacgttcaacaattaaagtaattattgctcatcaatgcataattaagcaccaattacttaatttattcatttttttacaaatttctgatattacagtattctctctctctctcttcaaggattactatatttatatactgtattttcttatagataatcgactttggctcctcgtgtcagtacgacagtcgcatttaccattacatacagtcgcgtttctaccgttcccctgaagtgttgctgggcatttcctacgacacacaaattgacatgtggtcgttgggtccgtgaatgaattcaaaaaagaaaaactaattttatttaaaatatttgaaaattattaaaaatatatacatgattagtcgttacataaaaacgggcgctttttctacaaaaaaatattgctaaaatggtcgttgattgtgagagttttggatgcttttttcaaaagaattcgaaagcttgatccaaaataaacttttggttttttcttttctagaaaaacaaaaaaaaatgtgctttttcttgttaagcgcatcggttttcataaaatattccaaatttcaaattgttttacaattttaactgcctgaatttatggactttggtgtgagaaatagtggacaaattttgttgagttttgtctacttaaaaaactcataaaacatagataagattttgatagctcattttaaaatgaaaagttaggcctttcgaatgatatattaaattcaataaaattaattatataaaaacgaaaaaaactaatgcaacgacctgttaaaatgttttccccattttcaggctgcattttggtggaaatgcacaccggcgaaccgctgttcccaggccattccgagtttgatcaaatgatgaaaattgttgaggtgctcggcatgccgtcaagccaaatactgaattccgcctcaaaagccaacaaattctttgaattggatgaaagtaaaatccttaaaattaaatatcaataaaaaaaatagtttttttaaatgtatacatggctcagttggtagtaacgtgtgcttgcacgttcttagttccttggttcaattccttaatggtgccggatgattaaatttcaaaacttgtctgatttcggtgacgacaaatggaattcctcgttactgacggcactttttaattttatttcactttttttttctatgccattcatcccttctcgtgaaaattctggaaatcttaatggattttcttaacaaatcacaataaatcaatcccttcacgatgacaacagacaccaaaatgacgcaaaatccgtcattttttgtcgaaaaatttcacttaaattttataaaattaaattggagaaaacatcttggaactgataagcaaaaaagtttcctgcctcctgctgttggtactttccacgaaaagttttttctggatgcgggcctgggttttccggtcattattctgttcccgcaatcgctctattttttggagtgccaatttgaacgatttatctgggcgggcactccaatcattggcttcttttagggccgattgattcaaataaacaccgttaacttttttttgaaatcagatggccaatggcgctgcaagaaggcgcgtgacacaaagtcctacatggcgcctggttcacttcggttgtccgacgtgttgggcgtgtacacgggaggaccgttcgggcggcgacagggcgagcaaggccacaccgtggaggactacatgaaatttaaggtgggaggattccttcccctcgtatcgtttccaccctccgaaaaaaaaaattataatttctaaatttgtaaaaatcttaaaatttttataagaaattgcaagaaaatgttttttaaagcgatttgctcaaaatttttatgatggatagatactatgtttttgaaaatttctccaaaaattgctaaagatatcttatagaaaaatttctatgatttttaaaatttctaacaataagtttgaaaaaataattatttacatattataattagggatgggattcttaggtttttacttattttttctgcggctttaactcgacgagaaatgcacgaaaaacacattttttgttcggaaaactttcgttttcacgcccctatccgaccctagaaatacactcctaagaatcgacccaaaaattttcaaaaaaatacacccctgagaatcgacccttaaatcctgaaaatttctaaatgtacttcatttctaactgtaatcagtaaataaaattgtttgacttaattttaactaatttacatagagaaaacagtaattttgataaattcacccctacatttgaaatttttttgcccctattttcgcccctatttcttgaattttttgcctctatttaggtccctattttggactttttcgcccctaaaaatcccatccctaattataataaagctcattttttgatagggagcatgattttaaaaaagtctcctacctgggtttaatgaatatgccgtaattttaagtcccttctatgagtaattaacagcaatttaagtaattaaaaacttgaggaaaacaaacatttacactgtattttttctctttatatttttatttatacatttttaaatgccgcatttttgcacaggatctgatccagcgcatgttggagttggacccggccaagcggttgcatccgtactacgcggtgcggcacccattcctgcgcaagacgaaccctggcgatgatcaacaacaccagcagctacaacaaaatgttgttggaacagcgagcggcggagttgcggcgcaacaacaacaacagccgaaccgctcgcactcgtcggtggccatttccgccgcgtgccaacaaccccagcaacaacagcacccatcttcctcatcagcatttcacaatcatcatgcacaacagcagcagcaccagactatgccaccaactttt

SEQ ID NO: 67938 - DNA, 285 bp, Heterodera glycines
  Genomic contig location: Contig_ID=SeqID_8401; Location=4062..4346; Strand=-
  SCN-specific regions: Sequence locations=1-262
atgggtgctgttgttgctggggttgttggcacgcggcggaaatggccaccgacgagtgcgagcggttcggctgttgttgttgttgcgccgcaactccgccgctcgctgttccaacaacattttgttgtagctgctggtgttgttgatcatcgccagggttcgtcttgcgcaggaatgggtgccgcaccgcgtagtacggatgcaaccgcttggccgggtccaactccaacatgcgctggatcagatcctgtgcaaaaatgcggcatttaaaaatgtataaataaa

SEQ ID NO: 67939 - DNA, 1112 bp, Heterodera glycines
  Genomic contig location: Contig_ID=SeqID_39355; Location=109..1220; Strand=+
  SCN-specific regions: Sequence locations=1-9,39-547,576-649,679 -1008,1030-1112
  Gene Ontology: Mol. function=ATPase activity; Cellular component =proteasome regulatory particle, base subcomplex (sensu Eukarya); Biological process=proteolysis and peptidolysis
ggcacacgtgtggctttggacatgaccacgctgaccataatgcgccaacttccgcgcgaggtggacccgttggtgtacaaaatgagccacgaagaccctggcaatgtgagctatgccgaaattggaggtctctccgagcaaatcagagaactgagagaggtaagacaatttgagagcgaaaatcgaattgaaatttgtgggaggaatctgttggaccacaccttaaggttgttgaactgccgctgatcaatccggagttgttcaaacgcgtcggcataacaccgcccaagggctgtcttttgtacggaccgccgggcaccggaaaaacacttttggccaggcacagcgaatttaattagcgaattggcaaaatccgtttcctcagggcggtcgcttcgcagctcaactgtaactttctcaaggtcgtctcgtcggcgattgtggacaaatacattggagagtcggcacgaatgatccgcgaaatgttcaattacgcccgtgacaaccagccgtgcatcgtttttatggacgaaattgacgccatcggttaaatttgttatatattaaatttttttgatttgtcttattaaaaggcggacgtcgtttttcggaggggacttcggccgaccgcgaaatccaacgcactttgatggagttgctgaatcagatggacgggttcgactcgcttggcaaagtcaaaatcatcatggccaccaatcgacccgacacggtcccacgattttcttttccatgaaacttgcaactcttcacataatatgttcagcttgacccggcactgctccgtccgggccgattagacagaaaaatcgaaattggactgcccaatggacagagtcgtcttgaggttttttctgtgtcctaacggtactgagcttttcccttacccaggtgctgaagatccatgccaccaaagtgctgaaaaaagaagaaatcgattacgaagcggtggtcaaattgtccgagggattctcaggggcagacctgcgcaatgtgtgcacggaagctggactgaatgcgatccgaaaggagagggacggcgtggtacaggaggacttcatgaaggcagtccgtaaagttgcggacgccaaaaa

SEQ ID NO: 67940 - DNA, 66 bp, Heterodera glycines
  Genomic contig location: Contig_ID=SeqID_39358; Location=579..644; Strand=+
  SCN-specific regions: Sequence locations=1-66
atggctcttcaagacgcttatgccaatgcaatggatgctttttgtggcaccacggggccattttgg

SEQ ID NO: 67941 - DNA, 478 bp, Heterodera glycines
  Genomic contig location: Contig_ID=SeqID_39360; Location=178..655; Strand=+
  SCN-specific regions: Sequence locations=1-202,225-227,249-478
ctattggtggtttagggttcgaagtcagcaggaattggacaatcttcgcgatcagttgggtcgtccgatcggtgttttggactctctcgtcttaccacaggtaaatcagaaataacaaataaacgaaggggaaatgaacacaatctgacatatttggtctgctagagcaatacccgggtgcttggggaaggtttccccagccaaaaaacattttgaattaaaaacgatttcaaattttattgaaattgtaatataaaaaagtttttttttcgtttgagatatgggtaaatgtgttgctttcccgggagagcaatactgggtttaaaaattgtttatttcagccaatgcatgaactttttgtggacgcatttttgactgaaatacgcaaaaacccgagagttacggacgtcgatttggatgaattggaaccgtgcttcagctgttcacaaacaattgcgcaagtaaaattggtgaaacg

SEQ ID NO: 67942 - DNA, 1737 bp, Heterodera glycines; identical to SEQ ID NO: 8402
  Genomic contig location: Contig_ID=SeqID_8402; Location=1..1737; Strand=+
  SCN-specific regions: Sequence locations=1-5,30-66,103-139,162 -249,279-415,437-561,583-629,654-1737
  Gene Ontology: Mol. function=regulator of G-protein signaling activity; Biological process=G-protein coupled receptor protein signaling pathway

SEQ ID NO: 67943 - DNA, 3356 bp, Heterodera glycines
  Genomic contig location: Contig_ID=SeqID_8403; Location=242..3597; Strand=+
  SCN-specific regions: Sequence locations=1-81,104-144,167-572,594 -1159,1190-1300,1326-1805,1877-1894,1916-1956,1983-2209,2243 -2257,2279-2581,2603-2681,2703-3027,3051-3356
  Gene Ontology: Mol. function=regulator of G-protein signaling activity; Biological process=G-protein coupled receptor protein signaling pathway
gtggactttcgcaaattgtcccgctccggtcggcccaaatacagcgcgtccacctcattgttggcacaagcggctgctgcaagcagtagcagcagcagtaccaccacctgcagtaatgggcccgctgctgctgcacaacctacaccaacaaaaacaacagcaaaaactgtgccgacaaggacggcagatgaatgttcatcgacggcatgcacttcgtccgccagttgtgccggcggcggtgactcggccggcacctcgtctggcggtgctgaaacggcgacggcgcccaatcggacaacgtcaaatgccgcttcgagcagttccgtgcgggaagtgaagtaccaccagaggcccggcttccggcgccagacacggctccaggactcaattaagaccgaggtgggcgctgaggaggcggcgctgagttgggccatttgggaaatggtcgagactcattctcgagcgctgtcttgggtgttttttttaatttgttgaaaaaaagacgaaaaattttaaaattctaaaaaactttcatagatcactgatctgcacaatcggttggccaaaaatgtgctcaggacatccaaagtggtcgagaattacctccaatactatgatcaccggtcagtcagatattgtgattgtgtgtgcattgatcagacacaaaattagtgattaatggaacccacagtaatgcttaaagatagatacagtatagcaaacggagaaactcattatagaagagatcatcagcaggataatgttatcagtgatcgaaaatgtctaaatctttttctaaagagtgatttttttttatataagtgatcaaaagattattgattaatggatggaaccacagtagtgcgcagagagagagatagagatacagtaggaatcggtcagagtcattagaaattatcaaaaatgttaaaatctttttcggttcagctatttttttaaattatcgataaaaaatataatgaggtttaatagagtaattaatgattgattaactgtaattaacgaaaaaaacaatgatcagagggaggctgatattaatcatgattattagtcataatgaaggagtcattagggagcagttcgtccctctcctccaccatccgataaaaacttaaaaatcgaaatttcttatagtttgtttttccagtaaaaatatttttaaatcttcaaaagcctctttttaaagcaatttttagtttcgaaaattttaaggaaatctatttttaaaagattttttctaaaaaaaaaactaagaaattttgaaaatgaacgaaaaaaattccaatttttaaaaatttttcgtcaggggaaacttaaagaatatctccattagatgatcattcactaatttagtgtgtgattagcacaaattttccaggatactttttgacgctttcctcgtccaattgggcagtgccaccgacccgttccatggccaaccaaatccgtggatttcggacaccgtcgacttttgggaccacgacaaaatgtacgcggatgtgtccgcgcggcgcctcaaactgtgggaggaatcgttggaggagctgctgaccgatccgctgggccgtgaaacgttgcagaaattcctggacaaagtcggtgttttggcctcaaagcaaaaaaaaaattttcggaaaccccacaaaaattcacgaaaatcaaaagaaaaatttttggaaaacagcgaaatttagccaagccccatagacctgtggaatcgaatgattgcattttttacgcattctctggcactttttggcgccgaaattattatgcattccggcaattatttgtaatttattttttaatttaagaaatgcggaaaatttttatttattaaaaagtttaaaaaaatgtaggggtttcgctcgagtttcacaagaaatctccagaaaatgggttcaaccttatcgagtcgtatcattggattcttgcaattttatatatatttttaatttttaccaggaatactcgggtgaaaatttgcgcttttggatggaggtaaaaacccatttaatcaaaaatgcatatgctaattaattcattaatatttaattacccaaaaggcaaattctcgccaatttttctaggtgcaacggttacgcaaatgcagctgtcgttgtaagtttttgtctaaaaattaataagattcgccgcagggtcgtctcatgaattccgccaagggggcaaaattaaaaaaatatatatatttttaattttaccaattttgggtttgataaattaaaaaaaattatatgccgtattaaaaatgacttggtacggaaatggccccaacccgatttaggcatttggcattttggcgaaacttgcgccaaattggtattattcgatcggaaccgctcagttgggcgccggcacgtttgggcgccagcatgtttttagctataactttttttttatcaaccgaatccaacattgttgatatcattggaaagctcgctctaagtgtccttctattagcctgcaaaattttaaaaaatttagtttaggttcaaaaaagttatggccagaagaattcaaaaaaccaaattttccaacttttttggccataaattggttcaaaattaacaaatttttttggaattttgcaggctattagagcatctgaagagctctcgaatgataccaagattattggattaggatttcaaagaaaaaagttatagtggaaaaacatgtgctggcgcccaacgcctgcgcgcccaactgagttttagaccgcattcgatagctctaaatgtgcaatattaaaatattagcctgcaaaagttcaaaaaagttcgtcaattttctgaaaatttatggccattagaggtcggtcaaaagtcttggggttttcaaacatttgtggtaatatgtagcttttttgaaatttaatgaaatttttttttgaaattttatagcacctaatagagaatatttagggctatcgaatgatatcaagaaaataaaaataatatggttgcttatgagcaaaattagatcaaaaaaaaatttttttttattttgatggttctcccatcgaaaatttgaattttacgcaaaatttacgccccaaaatttgcacagttgtgcccgtgttggtcaccaaaatttacaacgaattcatcgatgccaatgccacctcacccgtgaacattgactgcaaagtgatggagattacggaggagaatctgcgcaacaacccaaatcgatggtcatttgacgacgcggccgatcacattttttgcctgatgaaaaatgattcgtatcagcgctttttgcgatcagaaatgtaccgggaaatggtaagtgtttgttaggtgatctgatct

SEQ ID NO: 67944 - DNA, 56 bp, Heterodera glycines; identical to SEQ ID NO: 67782
  Genomic contig location: Contig_ID=SeqID_39363; Location=370..425; Strand=-
  SCN-specific regions: Sequence locations=1-56

SEQ ID NO: 67945 - DNA, 436 bp, Heterodera glycines
  Genomic contig location: Contig_ID=SeqID_39365; Location=204..639; Strand=-
  SCN-specific regions: Sequence locations=1-436
aaaatggtgtaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaatggtgtaagtaaaatcgtaattacgctcaaaaagctcctcaaacaattttagcgcttccaattccttctacaatcgcctttatacatcccattatgaacgctaaaattatcagagtgccgaaaatcgc

SEQ ID NO: 67946 - DNA, 372 bp, Heterodera glycines
  Genomic contig location: Contig_ID=SeqID_39365; Location=792..1163; Strand=-
  SCN-specific regions: Sequence locations=1-372
tatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgaacgctaaaattatcagagtgccgaaaatcgcatgtgatctaagcctagaaa

SEQ ID NO: 67947 - DNA, 131 bp, Heterodera glycines
  Genomic contig location: Contig_ID=SeqID_39366; Location=457..587; Strand=+
  SCN-specific regions: Sequence locations=1-41,66-80
atggataacagagacgaacggggccattcgtattgctacgtgagaggtgaaattcttggaccgtatcaagacggactactgcgaaagcatttggcaagaatgtcttcattaatcaagaacgaaagtcagag

SEQ ID NO: 67948 - DNA, 134 bp, Heterodera glycines
  Genomic contig location: Contig_ID=SeqID_39368; Location=721..854; Strand=-
  SCN-specific regions: Sequence locations=1-134
gcagatttaaagctatccattgcctgccggttctcggcacagcaaagcactaatacggtgtttgactcacttcaaaaaataattccatacccaaaagttttttacaaccacatattaccaatctaatttcttgc

SEQ ID NO: 67949 - DNA, 256 bp, Heterodera glycines
  Genomic contig location: Contig_ID=SeqID_39371; Location=182..437; Strand=-
  SCN-specific regions: Sequence locations=1-155,177-256
ttttcagctctcttactggggcgacgggacgttcaaattgtcgcatcgcttcactgcttgaattccgatggaaacgaaccttgcaaacattggaagaccttataaatatataatactcttaaatacaccagataacatatttcttgctatttagcttcttccttctattttatttttcgtgtcattatgtattgaagcgctttgacttattgcttcaatggatgtaaaactcttaaataaagctgttgacagcccc

SEQ ID NO: 67950 - DNA, 4194 bp, Heterodera glycines
  Genomic contig location: Contig_ID=SeqID_8404; Location=166..4359; Strand=-
  SCN-specific regions: Sequence locations=1-255,294-333,358-493,515 -718,768-1121,1143-1168,1190-1239,1261-1761,1783-1942,2001-2059,2081 -2113,2143-2260,2292-2718,2742-2811,2833-2833,2855-3342,3375 -3574,3602-3718,3751-3846,3868-4070,4093-4194
  Gene Ontology: Mol. function=transaminase activity
tgcaaaatgtccgtccgtccccctttagacgtgacggtttcccctgtgatccggaaagtgtgtgcatctccggcggtgcgtccgagtccattcgcaacgtgctcaagctgttcgtccggcccaacatcggcacgggtggccaaaaggccggcattctggtgcccattccgcagtacccactttactcgggtaagcctacattgttcgacaaatttacatgggtttcatcgccgattttttaaatgggaatcccggatttttatgaaaaaatttattttatttactttttttttgctttaattttttggcactatatgcaaagtgacagattttgaaaattttttcaaaagggggggacccttttgttttgcaaaattttttttgtgatagtcataaaaatttattctctggggtttttggggtccccgatcacgaatccttcaattattttgatcaattccgatttcctaatctaaatttgaacaaaaaaatcataattttaaaaattcaaaatttcgatttttattcgagttcgggttagggattagaaattagtcaaaatacatgtcagattcgtgattagcgacctaagtcctcctccccgtacgttttctctccgaaaatttaaaaattttcaaaaaaagtttactaaaaatttctaacaacaagaaaatttcacgaaaaaatcctttaaaagtttttttgcgatttttaatggaaataaaaaaacatttttaattcattagaaaaatttgaattaattttttcataagaaagcaccggacctcgatttcttccgctttgatccccgatttttgctggcttttgttccgctttattgccagcatttgaatggatggatcctgacaaaaatacggtctcaaattatttggcccgggccaaaattttctgttcgctcgtccgaagcgattctgcttaaatttgtttatgcaaatctttaaacatgcaacaaatgttcagcatcgattgaggagtacaacctgggccaggtgggctattacctggacgaagaaaacaattgggcgctggacatggacgaattggaacgggcattgaaggaggttggttagttggaaaaacaattcaatttttttttgtccattttttaaattttgggctaacggctgaaaattaaacagactgaggatttttgtatgtgttttcccacataaaaattttaacacgttttttggcccaaaaagtttgcaaaaaaataaatttggtttatttattcttattcgtccaagcttggtatttgtccgacggtagtttaaattattcgttgtcctcctaaattggcactaattcgcctcgcccgtacgtaaatttcaacattttcaaaacacaacaaatccgatttgccatcattttgcacgcattttcccccttgtatacacagagtgagcacgatgtgaaggcgattgtggtgatcaatccgggcaacccaaccgggcaggtgctgagccgagccaacattgaaagcatcatccaatttgcgcacaaacaccgactgtacatcttcgctgacgaagtgagctgatcacatgagaccaggcccgtacccagaaaaaaaattttggggaggccactcgaagaactttttttcttttcttttttttgttgctttccgggccaaaaatttttttgtgttatttttcaaaatttcaagcgtagcggcgaaaaagcaggagtttgtagcgattttgcgccaaaaatgacaaatttttgcccgttttgtggtcaaattttcaaaaaataaatggtccaatggaggccggccggaaaaagtttttgctaaagaaaatgtacaatttccaaaattttgtccattttttcttgaaaatttttttctcatccaaattttatgtatatcaaaagtcccatcggcggacggtttttcgaaatttcaatcaaatcattcaaaaaaaatattagaaattgtttataaggaaattttaaaaagaaaaaatttttaaaaagaaagtcttggaaaggaaatttagcaattttgaagcaagagatttttggtttcattttcacaatttatttatacaaaaattgttttctgtttgtataaatattaaattgctccataatttaaataaaaaattaaatatttttccataacccttaaggtgtaccaagaaaatgtgtacgcggagggtgccgaatttcacagcttccgcaaagtgatgttcgaaatgggtgcgccatttgacaagtgagtggtggtattatgaaattttatttgaattttattaaattttaaacgatttttcagactcgagttggccagcttctactcctgttccaagggttacatgggcgagtgcggactgcgcggtggttacgtccagtttgacaacattgacccgacggtgtacgtccatttcaaggcaatcacttttttatttgaaaaaaaattgaggcgctatttttgaaaaattgagacaaaaaaatcgaacttttaatttttctgccaaaaattttttgaaaaaaaaaatttcgtcgggaaacgaatgggtaaggggggcgaactgtcctttttttaaaaatccgtatggaaaattaaggttactccacatttgtgccgatgtccaaaatcgggttcaaacttacattttttcaatccctgatagcctaaacagctttgaagaacgattgaaagtgattgtatgagataatttgatcgtcagcaaatttatgaaaaaataattaattttcaaacagcagaattattgttcctaataaaccaaaacaacaaaaaaattttgcaatttttttttgtgtaatattctaagatttttttgcaaaaatttaaggttgaaaatttaaaaaaaaaattcggaggggaaacgaccgaaaccttctcaaaatttgcaaattttcggaccgaaattttttgccattttctttttgcagaaaatgatctccgccaaactgtgctccaccgtcctgggacaggtggccatggactgtgtggttgaccatccgaagccgggcgacccgtcctacgaccagtggcttaaggtaattactttcaatgcacttttccaacagactgcatttgacacaggacgaattcatttgtcagccattttaatttgcaaaaattccttcccattcgccctataaaattgtaaagtttttaaaaaaaatatatcagaaaatgcgttaattattaattttccattttcacccaaaccgaaccaaaaactcggagcatgtcgttccccccccccccccctccccgaaaaattaaaaaaattttcgattttcataaaaaaaaatacaggaatttcttagtaagaaagtttcaagaaaaaaattttttttattttttgaaattttatgaactaataagtttttcaaaaaaaatcgctgaaatttctttcaaaaaatttttttcttgaaatttttttattaagaaattcctaagaattttttaatgaaattaaaaaaaaccaaaattttcggctctttgccctgaccataaaactgatcagaaaaaagtgctcgagaggaaaaaaccagcaaaaaaaaaattctttttaatctattttcccttttttaattctcatgggttcggatccgcccggcagataatggatttaaaaaactttatggttttagagtgattttgacactggcagagttgtttgtttgttttttttggataatattattttcctaaaatagcaaagtaataataataataattggatttgtcctctcattttcaggaaaaaacggctgtgctcgactcgttgcacaagcgtgcacagctggtcaccaaggcgtacaaccaagtggagggtgtgcactgtcaacaggtgcagggcgccatgtatgcatttccacgctttttgctgcccgacaaagcaattgcggaggcaaaggtgcggtggttgtggtgaaaatggtggtggagatgcgaacggcacggcacggcacaatactccccctcccatatcaaatcccctggatcgcccgaaaaaaaaattgtccaaaaaattctatgattgacagatttttttttaaattttttcgtgggggtggtggtggaagcaagcaaacaattcaatggagtgtgtgaatcagaaagacttttttcaggccagcggagtgcagcccgactttttctacgtgaagcagctgcttgaggaaactggg

SEQ ID NO: 67951 - DNA, 442 bp, Heterodera glycines
  Genomic contig location: Contig_ID=SeqID_8404; Location=5300..5741; Strand=+
  SCN-specific regions: Sequence locations=1-442
aaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaccaattttagcgcatccaatcaattccttctacaatcgcctttatacatcccattatgagcgctaaattatcagagtgccgaaaatcgc

SEQ ID NO: 67952 - DNA, 1086 bp, Heterodera glycines
  Genomic contig location: Contig_ID=SeqID_8405; Location=875..1960; Strand=-
  SCN-specific regions: Sequence locations=1-496,518-519,541-796,819 -843,868-947,970-1086
atggacattaaatatggactaaaaaagcccgaaatatggactaaaaaggacaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgtagaaatgctatttttaagcccctttcttcatagcatatgcgcagaaaaaatatgttaatccatataatttacaaccctatttataaatttttgaatagattcttgttggagacctgacatttcactatgtttcccagaccatccacgtctttcccaaagagtaagcggccttttgcgtcctttctattggacttttcatttgaataaataaatggcaattaactaattaattaaatcccttaggctttttgctttcctggcatattttttaagaaattttttggagagttcgtgaaacctaaacccaaatccttcgaaatgaaaaagcgaacaccgtggcattcattgaatttttccatttttttcagtattgaacaggaccaaattgtgccaagcttctgtggtcggctcgaaccggacaatgtcgtccagcgacaaactgcagcagcaaaaggtgctcaccgtggacacgatcaaccccaacgttatcaccatggtcaatga

SEQ ID NO: 67953 - DNA, 48 bp, Heterodera glycines
  Genomic contig location: Contig_ID=SeqID_39373; Location=200..247; Strand=-
  SCN-specific regions: Sequence locations=1-48
atgattcatatcggtcaaatgacgaagacgacgagcggacggaaaacg

SEQ ID NO: 67954 - DNA, 656 bp, Heterodera glycines
  misc_feature (655)..(655): n is a, c, g, or t
  Genomic contig location: Contig_ID=SeqID_39375; Location=116..771; Strand=+
  SCN-specific regions: Sequence locations=1-656
ttacatcgatcactccgtcatcgcttttcttcgttcaaatcaccaaattttcgacaaaagaggcaccaatttacatttgtggcttccttattcaaacaccacgaatggccaaccaatttgggatgtttttgcccgtgaaatttggccaattttttcggcaaacattcaccacttacgctttccccatggtgatcatttggaccatttgcttcgtcgcacttcgccgacaattctcaccgatctcgaccaattgaattcaatctattccggtgctttgttgcccgctgcgtttggtgatggttttgatgggccaatttcaacaatttctgctggccaagcattgtccaaatggttgcactctccgagaaaagatggccaacccaagcgattgcgttgcgataattacaacgcacaatggaacactgattggatcaacaatttcaaggaggtgtggccataattcgacaaatgattgatttttgttttcaaattgtttagcattttctccgtgccaatgccatttcttcggtcagttaccaaattcatttttctgttcatgtgccatcaatggaaatggtgccatttgaattggtgaacgaatgcacaaaggaaaagctgacattggccaaagcaaatgaaaatgaattggacaaana

SEQ ID NO: 67955 - DNA, 842 bp, Heterodera glycines
  Genomic contig location: Contig_ID=SeqID_39376; Location=74..915; Strand=-
  SCN-specific regions: Sequence locations=1-341,363-474,496-556,578 -669,692-759,781-794,816-842
atggccaccgaaacagcaactttcgctgcgctgaaagcttttgccaattggttatgtccatcatcgccacttccgtacaacagcgatctgttgccattgaaaaaacttaagtttttatgcacgaagaaagttgctcttgcgtttattgcacaacttaaaaaagtaagcaattaatggatttaccataccttaaatagggggcgggggtgacgaccggagccccgacttttgcgcctctgtccaaaatcggagtcaaagttgattttatttaaagcactgatagcctaaacagcattaaaattatgaaaagatcactactgtcttttgattattaggaacattaattatgttgtttaaaaatttaatgattttttcaaaaattcattgacgatcaaatgatcggatacaatcactttcaatcgcttatttaaagctgtttaggcttccattgattttaaaaaacttaatttggacaaaggcacaaagaatttgtcctttttttgaagaaaaaaaaacttggccactctggcttgtacataatgtttattaattatgcttttgaaccttttgccaatgattcatcactttgtcaaataattaattagttaaataatgttaatcgaaatttaaaggacaatcggcgaatgtattcattgaacaccattcttaaagaattgacataattagcaaattctttttgtttattcccaaaaatcgcttttaaaaaaaatacaaaaattgttttccagcacaaattcatcctcaaaacattcattcatttgtgtgaattgtttttggcaaaacaaccttttcttcttctgttgctgctcacttacaattag

SEQ ID NO: 67956 - DNA, 397 bp, Heterodera glycines
  misc_feature (22)..(22): n is a, c, g, or t
  Genomic contig location: Contig_ID=SeqID_39377; Location=136..532; Strand=+
  SCN-specific regions: Sequence locations=1-397
atgaaccgacggtaataaattngaaaagtcacacaaattcatcattatttagctaacaataaactgttttccataatttcagttggatttgcaacgacgtttggatggacattttcccctgttttgaccatgcccaacttggcctcaaattggcacttctttcgtcacgtttcaatgcgttggtggacaaacatttcgatggcaaaagcgaattgacaatttggagaccaatcgcaattcgtcgcaaggacaaaggacctgaaccgaaactgtctgtacaaatggatagaaaatttgacaaatttgtggaatttccattgcccgaccgtccgttgcccagcaaaatccgttttaaatggcttcggattgagtaattcggaatcagagatttatggca

SEQ ID NO: 67957 - DNA, 463 bp, Heterodera glycines
  Genomic contig location: Contig_ID=SeqID_39381; Location=232..694; Strand=-
  SCN-specific regions: Sequence locations=1-463
atgacgactcaacaacgaatatttgggaatcagctgctttttctttgcatttttcttattggagttgtttttttcctcttttctgctgctgttgcaaatggtgctcatttagttgactcaagtgagttgctctctttttaaagtgatttaatcgaaatttcaatttaaatccgtttgttggaatgggtcacaagacaaattggcatatttttggccaaagaaaatgccaaaaaatagtcaataaaaggcgcccatttccgattaaaaaatcataattaggcgttgatcaaattggtcgtgtacagcacaatcataacggcgacataaacatacgcagagggattgaacgcttcaacgacaatcggatggcacaaaatggtaaagaaaaatggcgaaaatacgaataatgttcaaaattgggccaaattctttcggggagagcaatgaagaattaaataataaa

SEQ ID NO: 67958 - DNA, 1499 bp, Heterodera glycines
  misc_feature (1452)..(1452): n is a, c, g, or t
  misc_feature (1460)..(1460): n is a, c, g, or t
  Genomic contig location: Contig_ID=SeqID_8406; Location=1..1499; Strand=-
  SCN-specific regions: Sequence locations=1-162,184-447,479-574,596 -935,961-1123,1157-1260,1283-1289,1323-1499
  Gene Ontology: Mol. function=structural constituent of cytoskeleton; Cellular component=membrane; Biological process=protein targeting
aggctcgtcacaacatcagtccgcttcatgtagccgccaaatggggtcgtgttaagctggtcgaactgttgttggaccgtggcgcgatcattgactgtcggacgcgcgacctgctcacaccgctgcactgcgcggcgcgtagcggtaaatgttaccaagataaatgtgtaataaatgtttttaccaggaattgatagtaatgttattatgactcagagatataacaccaccgaaattcgatttccaacatttttgggtcggaattcgatgtccgaattttttgaagaatctgaatttcgatttttcgtgtcggaattttcaaattcgaaatcattggagcctgtgtgtttcggtttccaacactttaggcatctaaattacatccctggtataatccgggccctaaccagagggaaatagggatccctctgccactttcttcccccgaaataatttttaaaaaaattcaaaaaattaaggaaactttgagaatttgtgtaaaccaatcaaaaaaatttcgctctataaatttttcaccatcgccgcatttcgacaccgtattttttctgatatattttcttaaaattttgacccaatggtcctcaaaatagagctatttttgcctgaatttgtgattccgattacaacaacattcaggccatgacacggttgtggagctgttgctggaacgtggtgcgccaatttctgccaaaacaaaaaatggacttgccccgctgcacatggccgcgcagggtgaccacgtggactgtgcaaggtgggcacaaaaattaaaataattatttggcactttaacaatttactggaatccgatgcttacagtttaattgagccgattttttaaatcttttttgttttcaaaagtcatgaaatatttttaagaggattacggaaacaaattgaaatcacacaaatacttaaaaaatatttaaattatttttagtccaaacaaaatcgagcattcaaattttcgactttttgttcgaattcgagcccgggattcagtatttgtctaggatgcctgattcttgataatcgacccataaaagtcctcggaaatatatgttttgactttcgaaataatttttttttttcgtaggtccactaaaatttgttttttaataattttataataaatgcgatatagaacttattttttgttgctatgtatgtaatttatctactaataagcatggcttgtgtgttttaatcgcaccaaattttcaaaaaaataataatttccctgactgctacaaatgcaccaatcgcactataatttcttaaataaaatttataaaaattttcaaacaaatcccttaatgagccgaactttttggtacaaacacaaaatacataaattgtgaaaattggttatttgttttttttactaagaatgttgaattccgaaattccggagctttttttttgcccaanaattccgnattttttgttgaaaatagaactctttccccatgcattta

SEQ ID NO: 67959 - DNA, 4167 bp, Heterodera glycines
  Genomic contig location: Contig_ID=SeqID_8407; Location=140..4306; Strand=-
  SCN-specific regions: Sequence locations=1-142,167-456,481-507,529 -614,638-1046,1069-1275,1308-1579,1601-1651,1694-1809,1831-1841,1898 -2166,2188-2387,2426-2596,2618-2878,2900-2955,2997-3034,3057 -3261,3283-3357,3405-3427,...
  SCN-specific regions: Sequence locations=...3472-3499,3551-3555,3577 -3651,3675-3702,3738-3753,3775-3815,3838-3875,3916-3965,4021-4167
  Gene Ontology: Cellular component=synaptic junction; Biological process=protein targeting
ttgttgtatgtagctagagctctaggctacatatgtagtgcacaaaacggacgccaaagaaagcccaagaaatcgaatcacctgctgctcattgtcagagcagcagatggggaaggaatttcagtttgcggatatagcggaggcacggcggcggcggcggtggacggatgaaagtgaattccccaaaaaagtcctttcactcgcccattatttcccccccctagggggtcaaaaatggtgacaaaagaaaggcatggcgaaaacaaaacaaaaaaatgcatatattcccgcgcggtggcgatgccccggggcgatatgactttcaccgctgcgcggcggcagcgtcgcttttttttttgttgttgtttgctgtggtgggtgaaatccgcgtttggtttggtgcgccggattttgacgccgccgccaaataatccatctacacacactaatgtgatgggtttggggttggatttgttggggttggagcagagcagccagcagctaaatgacgacgttggcggcggcggacgggcgcagaggcacttttactttcccgttttggttgggtgtaccttcacccgtaaaaaactttttttttccctgaaattcgtgagaaattaatgaggcatttattgaaggcagaaaatgagcgagaaattttgcatataataaggatagaaaattgtaaaaaaaaagactaaaaaaagttggagaagcggagggtgaaaaaagttaaaatttttctgttgaaaactaaagctctcggacaatccatcagtggacaataatccgtcagcataatttgtatttgcaaatgccatatttttatgtaaaaaaaatttataacatttcttactttttttcgcaaaattttgttaatagtttaaaaaaaatttgctgacgggattgtccactaactaattgattgtccagtgatggattgttcggacacccaaaatataggatggctattcctgaaaaatcagcgcttaatttcggcattacattttcttaactgttcacgaagtgttttcaaaaacggaagcagattttttaaaaatttagtcaaatgaattagttttatcatgtttaaaacaatgttttatcctcaattttcattgatttaaattgatcaaatatgtttatttttcgtttttcaggaattattttttgttttaaaaaatggaaacaaaattttttttgatgattttgtatgaaagtgatgtgtgtcgaaaaatgatgaggcgattggggcgaatatatccggaacaatatggtggcgggggagaagaaaatttctcaaccaataaatttgtttccgaaaattaatccacaaattttgattggattttggcatcactttttgattggaatgacccaaataaatttattgtttcaattcttttttattttatgcaaaaaaagaaaaaagtccacaaaagggagtaatccacttactctgcggacgtgtcatagattaaatcgtcctcgagtaatatggattaaaaattaaacaaaaaaagaaatcacaacaaaattaaatataagaatgaggtcaatgattaataaaaaccaaatcactatataaaatatataatatcttgaattaaagagataattcacttttccggtcattttatacgttaaggagtttaattttagttttaaattgatttaaagaatttattttaatgatttctttatccagctgattccacaattttgtagccctccccgcaaagggaataaattttttgcctaatttatattttgtgttaaacctataaaaggggacattaaagcgttcagaaggtttgaaaataatgggactttcatggccgaataaaatttaatttaaatacctttttaaataaaataaataaatttataaaattatccctatccatttttgttaaatttggagcgcgaacgctaatccataaaatttttatatgcccaaactcagtaagatttctttgtgccactgattatgttccttaatcaatgcattcaattagtatctacaatatttttttttctgccttttgcaatgccattgatcaaattcgattcttcttttttatgagtgccagcccatctgttcaaatagacacttcctttgattcaaccgagaaatgttggttaaggttgtcacaattttggtcgaacatggggccaatgtgaatgcacagtcggtgaacggcttcaccccgttgtacatggcggcccaggagaaccatgaggtggtggtgcgctacctgctcgcccacggagccaaccaggcattggccacagaggtgggcaatattttgaagaaaataatagcattttataatttaattaaatgggaatgttactgtttgtcggcatttagcaccacaaatccagagaaaaattttcaatggaaaatttagacaacttttaagcggaataaaatttaaaatgattttgccaacaaatattgttttcagtaactcatcattagggagcgattcgttttttaggtacaaaaaaaaaacacgaaatagacacctaaaaaggcagaaaaatcgctaaataggcaaataaaaattaaaccctttttatttatcaaaacagataaagcttaatcaaaaaatttaacatgattatatttcaattttaaatgaaattgttgaagattttaaagttttttttttcgaataaggacacattttaaaccaaaaatttttatcaagaaaaaacaaatattttcgggaatcaaatttttgagaaaatttttcaatacttagaagcattttttattgtttttttttgttaaggatttttccggaaatcctgaaaataggcgcccaaaatggcgaattaattttttgggtgtatgtgccacccttttcaactgctgctgctgctgctgctggacacgggccaaatccaccaccgtaatctctctctaattaccctttttttcaccataggatggcttcacaccgttggccgttgcgctgcagcagggccatgaccgtattgtggcgctgttgctggagaacgacaacaccagcaaggtgaagctgcccgcgctgcacattgcggccaaaaaggacgatgtgcggtccgccacgctgctgctggaaagcgagcagaacccgaacgtgacgtcgaagagcggcttcaccccgctgcacattgcggtatttaggagacaaaataatggaattaattttttttaatggatttaaagtgattaaaatgatgcaattagagagacaaacattatgaagcaaaatatgtatttttgctttataaagtttctttacataactattttttgatttttttttttaccaaaatcacacaaattaatggaattaatttagcaattaattttaaaaatgaatttaaatttattaaattaatataaatttgagagggaatatttatgcgaatgatttaaatttatataaataaattgatttttatacattttttattcacatatgaataagcccaaaatgacacaaaataatggaaataatttagcaattaattttaaaaaatgaatttaaaattagtgagggaatttatgaagaaaaattttttgtttacataaatatctctgattttttacacaatttttaaattatcatatagaaaaagccgaaaatcacacaaaatatggaattaatttaaaaaatagttgattaaaatattgtaactatttaaggaattttatgaagaaaaatttttgtttcaaatttacataaatatctctgattttttcttacatttttaaattacatctagaaaaagcccaaaatcacacaaaataatggaactaatttagcaattaattttaataaaaacggatttaatgcattaaagagcgaattttatggaaaaaattttgtatatatatataaatactcggtttcttttatacaattttttttttattaaacatgagaagcaaaaaaatgacattcttctataattatatgataattatatttttcataaaacaaattatactttttaaaaaatcaacttatttatcatcttctaaaaacatttaatccctatttttttacaatttaaatgattaattacaaaaaaatattgaaggcgcattatgggaacgagaacattggccagctgctgatcgaaaagggtgccaatgtgaactttcag

SEQ ID NO: 67960 - DNA, 1116 bp, Heterodera glycines
  Genomic contig location: Contig_ID=SeqID_8408; Location=84..1199; Strand=+
  SCN-specific regions: Sequence locations=1-71,126-136,168-185,207 -236,351-406,446-570,816-903,928-1005,1041-1116
atggtgaagcaggaacagaagcaactggtgatgaacagaccggacattggtgaagggggacgaaacaattgaaaattatttaatttaaaaaagctaaaataaaaaaaaatatttttcaatttttagttaagcagtattattgtattgtaaaaaattttccaaaaataaccatcttttttagtttacataatagaaaaattccttaatttaccttaaaatattgctttttacccatgattttataatttaattaccattaatagaaaaattaaatttgaaaataaaattgttaaaattaaaaaatatcaaatcatttatttaaaatttaaaatcattaaaaaaaatttttagccttttgcgaagggtcaatcagtgcattttttgtaagcggtaagtcattatcatgaattaattatttaaattaactttaattatttaaattaaagcaaatgtcagcgtaagaggggcgaatgcatcggcaacaattctcgaaagcagtgaacaacaatgtgccaaatattgtgcagacaacagggacaatcggggcagaacattattgtgtaagttctgaatattattttttaattaatttctatgggtaattttttaattttcttttttaattattttttttttgattaaaataatttatcatagttcatagattaaaaaatttaattggctaaagcaaaattttaaatcagcactattttattattgaacaaaataataaaagtttaatttaattttaattttgttttttaatttaatagaaaaaagaaatataaattatttaaatttttaaaatttttttaggtggttccgcactttacgaaagtgacacgcgtcagtgcaaattgtaccgtaaatccaggcaaatttttagcaaaataattttgtcacaatttttaaataatttaaatttaagtgcacctgatggcgaattgaaacgctttgcagagaatggacggcgatattatgaaaaattttgtttgcccggtaagcaaaaataataattaataattttttgaaataattttgttctaagatgacgtgccaatggattgcgcattcacacattttgcccgtgtggatgaccacattttgaaggggtaa

SEQ ID NO: 67961 - DNA, 489 bp, Heterodera glycines
  Genomic contig location: Contig_ID=SeqID_8408; Location=1253..1741; Strand=-
  SCN-specific regions: Sequence locations=1-489
atgtcggaaatcggaattccgaccccaaaaaggtcgaaatcggaattccgactcccaaaaaggtcggtaatcgcaattccgaccccaaaaatgtcggaaatcggaattccgaagtccaaaattttttcggaaatagcaattacgaccccaaaaatgtcggaaatcggaattccgaccccaaaaatgtcggaaatcggaattccgaccccaaaaaggtcggaaatcgcaattccgaccccaaaaatgtcggaaatcggaattccgactcccaaaaaggtcggaaatcggaattccgaagtccaaaattttttcggaaatagcaattacgaccccaaaaatgtcggaaatcggaattccgactcccaaaaaggtcggaaatcggaattccgaagtccaaaattttttcggaaatcgcaattacgaccccaaaaatgtcggaaatcgcaattccgaccccaaaaatatcggaaatcggaattccgaccctaa

SEQ ID NO: 67962 - DNA, 771 bp, Heterodera glycines
  Genomic contig location: Contig_ID=SeqID_39385; Location=100..870; Strand=-
  SCN-specific regions: Sequence locations=1-771
atgatttgtcaccagttgtggtgtccaagatacggtaggtaatcaactggtgctaagtcgttataaaaaaaaaccaccaaaatgaaaagtttcaacaaaaaattacccataaatttgctcaaaagcaagcaaaatttaattcttgaaatcattcgatagtcctaacaattttctatatcttgaaaaattttgttatggttcaaaaaagttatggcagaaaatgttcgggcaaccagtttatgaattcttctagccataacttttttgtaccttaaggaattttacagactaatatcgttgtatctccggttttcgcttggtctcggaaaatttcggtcttgaataacctaatggagatttttgatttaaaaaagaatatgtatgttcgaaataagtactgttactacaatccaaggacgtacttgaagctaagggacatttatttcgcataacctcaaataaccagacccattagcagatagctatggccatccgattacatccgaagcggttggcgagataaagcaaattgtcattaaaatgattttgtttgcgaaagtggcaatttataggcaggaattgaaggtgaaagtgatcctgtataggcaggaattggaggcgaaagatgccaataatattaatgcaattggaatccaaaatgaagacataattggcacgtccaacattttgcgtcaccgatttaaagaaattcagtatttatcaaaagtttacaacgggaacgaggtgcatttgtactggatgttcttatga

SEQ ID NO: 67963 - DNA, 655 bp, Heterodera glycines
  Genomic contig location: Contig_ID=SeqID_39386; Location=1..655; Strand=-
  SCN-specific regions: Sequence locations=1-192,216-622,644-655
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttccagtgtccgtttggggaactcaaacaattatggggagcaaaaatccaacgcagaattaaaagacagggtatagggaaactattcccgaaagattcggtctccccctaaaactgggggcatcggttcggggggaatgccccccaaacaaaaaaaa

SEQ ID NO: 67964 - DNA, 328 bp, Heterodera glycines
  Genomic contig location: Contig_ID=SeqID_39387; Location=56..383; Strand=+
  SCN-specific regions: Sequence locations=1-110,132-235,257-328
agccaaactcgcccagaaagaaatcccagaaaaattagggtcgtcgcttcttatcccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggagttcatgtgagtgttgagcagaaaaagagatagacgttttttcaaaattttcagagccaaactcgcccagaaagaaaatccagaaaaattagggtcgtcgctactattccgaaaatgtggttggaattcat

SEQ ID NO: 67965 - DNA, 742 bp, Heterodera glycines
  Genomic contig location: Contig_ID=SeqID_39388; Location=279..1020; Strand=+
  SCN-specific regions: Sequence locations=1-742
ccattgcgcaactcaccagtaatgagcagcagccatcgcgagaccggcagaagtccaagaagtgtgctgatgcgccagtacgaaatgctgctgcaaaactcgaacgacaacagcggattccgtgcctggttcgacaacaacggcgctagtttaaaagagtacaattttgaaaattttttcaacttttttttggtcaaaatttttttttgtttaaaaagtcctgaaaccaaatacccgggggttttaaaggtcgctgattacaaatatgacaattatttgggcctattaagcaaatttggcgctagttataaagtgatagattttgtattttatcaaaaaccataggggggagacttttgttttgttaatttttttttggataaaaatcgtgaatatacattttattccccatatttgtgatgttttgacttattattcatcaatatgtgtgaatgatttaataataatttgttgcatctaagtagaatggaaagcgtttgattctaacatgcattctccagcgcctcacaatccctattcgcatacagatactgtgggcttaacgatgacaaaagtaaaatctgatcacgtattccggatcagcgtcacaaagatacccttagagacattttttcgagtgattctgtggtaaaaaattttttcaaatcaataatcctgtgctcccccttaagtcccaaatccaaaaattacttttatttttataacttttttcaaaaaagca

SEQ ID NO: 67966 - DNA, 640 bp, Heterodera glycines
  Genomic contig location: Contig_ID=SeqID_39390; Location=966..1605; Strand=+
  SCN-specific regions: Sequence locations=1-640
atgttgatggatgcctgggggatcctcccaggcggggatcgattggccgttccactgaaatggctcccgactgatccgactgcccctttgactggctctccattgccttttaagcgcccctcgggatgggaggagtttatcggagtaataaatgtgcgtgggaaaataaaatgccatttccggtccaggccttacaataccgaaacccaacgggcacctgaggatcctcctttataagctattccttacttttgcatgcttcttaaggctatgattggaggaatgtgcgcaaacttcacattttcgggcgatgaacacttgattaagagggaaattgaaaaaatttctgaatttgtgaaagatatcacgggcaatgcaactcaatggataagagcggaactcgtaagtagcaattaaaattattatgcaattatagctgggattaaaaatgacaaaatagcttaattttttttacgatttcatatattgaattgatgcgtcaattacaggaaaactcctggccactggaaataattcggcatgtcaagatcgggataaagaatccagtcatcgacccatattcgtacaattataccgcaaatctgatcgatgacattgttttcgcacgtgggcctttcgg

SEQ ID NO: 67967 - DNA, 2430 bp, Heterodera glycines
  Genomic contig location: Contig_ID=SeqID_8409; Location=880..3309; Strand=+
  SCN-specific regions: Sequence locations=1-231,253-505,527-610,645 -1065,1101-1145,1167-1183,1205-1221,1243-1288,1327-1472,1495 -1587,1624-1706,1728-1747,1769-1920,1972-2062,2084-2192,2220-2430
  Gene Ontology: Mol. function=microtubule binding; Cellular component =spectrosome; Biological process=body morphogenesis (sensu Nematoda)
atgatccagcatgatcactacgagaaggaaaccattcgcaaacgtttggaccgtcttcatgagctgtgggaccgactgttcgccatgctggagaacaagggcatcaaactgcagcagacgctgaaactgctccaatttgtgcgcaaatgtgacgagatgctctactggatcaaggataaggtgaggggggaattgatcaatccaaggcttgatcaagaactgatcagattatggttgattgggttaaaaaattgattatacagaactcatgacatttccacagtgattaggttaagacttgattagaaatgactgatcagttttggcttgaccgttcaccgggggcttgatgaattgcgctaattctgatcagacacaatgaccaattaatttaatttcacaaaaaaaacatatcgataagtacactttttgatagaatatttgccaaatattaagactaatttatttgctaagttcagattcaattcgtttccacggacgacctgggcgccgacctcgaacatgtggaggtgatgcagcgcaaatttgacgagtttctaaaggagttgaaaagtcatgaggtatacgattgcctgcgcctttttaaggcatttttttatttttgtaaatttttaaaaatatttcagtcccgggtcttggacataaaccacgaggcaaatgcactcattgacgaaggccatccggaacaacagcaaatccatggcaaacgggacgaagtgaacgaggcatggcacaagctgggcacactgacatcaacaaggtgggggaagagagtgcacgacgtccccccgcccttcgaataagaaaattttaaaaaaatttcaaaactaaaaatagaaaatgaagaaaaatatgccaaaaatgcaaaagatcaaataaatttgatttttttgaatatgcgaaaataatttcaaaaggattacgaattgtatttttagctggacgtctttttatttccatatttttgtaatattttagtttttgtccatttttccgtacttgaaatccatattcggcattttcacaaaaaattcgaaaaatagacccttcaaaatggaaatttttcaattttttggaaataggcccctaaataggggactcaattatggaattcgaattaatcgtgtattaaaatgacttttttcattcatacaaattaccagggcttccttttttatgtaagaaaaatcgcgaaatatgtaaataaaatattataaaaatgctaaaatatgtatgaaatatgtacaaaaaccaagaaatatgtatgaaaatatgtaaataaaatttttttaatgtttattttttggaaaaatttctcgtaaaggggtcaaataggctcaaaatgccataacaatgacctaaataggcttagaaatcaccttttcatatcttaaaaattaatttttggtatctcacatttggaaaaaactgattttttggggtacattatcaaatttttttttaaaatttttacaaaaacttctataaattctcaaaaccccaattaaatatgtacaaaaaaatgaaaatatgtacgaaaaattgcgaaatatgtatgaaaagtccaaaatatatataaaaatatgtaaatatgtaataaatgccggtccctagtatcagccagcaaaaaattaatagagatattcctcaaattttcataataccaagcaatttaacatttatatggaactgttgttttagtttttaaagcggcaaaacttaattaaaaattccaaaaattaaaatgcatcgcttaaatttggcttaccagtcgaaaaaagccatgcgtaagtgccaacaatgatgtaggttttattgattctgacaaattgcattgagatgtaaattacggcggaaattgaatcgaacaaacttatgataagcacttggagaaacgactaaatattatttataagttaaattaaatttttttttgtaatagaattaaatgttattacaatggaaagccattttattagcaaattttcaagtaaaacttttttttgttcttcggtccctaaaatttttccaattgtattgttcaaaaataacatttattgagttttttaccaaaaattaattatttattcatttcgatcaggaggtggttggaatcacccgtttctacccccccccccccccccgctgattacgggcctgatgactttggcatttttcaaaaatatttatttaaggggagaagcgctgttcggtgcccagcaaattcagcgcttttaccgcgatatcgacgaaacattggcatggatgggcgagaaagagcttacgctggccaccgacgactttgggcgcgatctgaacaatgtgcaggcactgcagcgaaagcacgagggcaccgagcgcgacttggccgcattggagtcgaaggtggcacggcacggggaaatttga

SEQ ID NO: 67968 - DNA, 1571 bp, Heterodera glycines
  Genomic contig location: Contig_ID=SeqID_8410; Location=127..1697; Strand=+
  SCN-specific regions: Sequence locations=1-136,158-332,354-414,436 -470,492-1220,1242-1349,1371-1571
  Gene Ontology: Mol. function=microtubule binding; Cellular component =spectrosome; Biological process=body morphogenesis (sensu Nematoda)
gggcgaagcgttgttcggtgcccagcaaattcaacgcttttaccgcgatattgacgaaacgttggcatggatgggcgagaaagagcttacgttggccaccgacgactttgggcgcgatctgaataatgtgcaagcactgcagcgcaagcacgagggcaccgagcgcgacttggccgcattggagtcgaaggtggcacggcacggggaaatttgatcagtgacgatcagaacattgttaacttgaggacgtctgatcagtgcgatgagaaaatgattagtgcattattcagttagggatggtctgatccatacatggacaaggagggggggttagaaatttctaccaaaaaaaatatcccccacccccccccccctcagaggccaaaattttaacgaaatgcaattcaaaatcataaaaattttgggtttttggcacaaaattttgattatttttttcaatttcgtaaaaatttcccatctttaccagtgctttttaggttttggccgaaaattttacgaaattgcctcggacccccgtacgatttacgaaattgaccccccccccccttgtccacgtatgcgtatgttctgataggcacaatgatcagaaacatgatcaatgatgagctgttcagaataagtctctctgtattatataggaacggggaaggcaataaaatcacaaaagatggcactaaatgttttaggaaagggcaaagtaatttaatataattttcctacttttacccaagatggacaaactcggcacggagacgaaccacttgtgccaactgtacccggaaaagtcggaggacattgccgcgaaggtggacgaggcacgtggccggtgggaggcgctaaagctgagcgcagagcagcgcaagcggggccttgaccggtcgtacaacaggcaccgcttcatggccgactaccgcgagttggtcgagtggaccaagggcattcaggtgatcgggcacagtccgtgccaaatttgatttttactctggtattgtggtttttgaataaaaatggtataatgtaaattatctgttgagctgaatatttggcatacacaatgcatttttgtgatttggtttctggcaaagaaatcttttcacagatttacttaatctttaaatttttccggctgcgcttatcttttctgccattcaaatccttccattttcgaagaaattttgaaaaaatacccaggaaattttctgagatgaagaaaaataaacgtgttgagatgaattatggtgatgaatataaaaaatgtgagtattataaatgagttttttagttttcgaattagtttttttcaaaatttagagctgaaatttaaaatcatgttttaccttataaaatcaaacactttggttttaagaggatttataagcgttttccttatttattgtaattaatcattgttggtctaaatatatgaaatgttcatcttaaatttttccccatttggctatcgcacacctaagatttgtcgcatcggtaattttatcggtactttcctgttttgaggccacacccaaaaatttaaaaaaatcaacaaaagg

SEQ ID NO: 67969 - DNA, 325 bp, Heterodera glycines
  Genomic contig location: Contig_ID=SeqID_39393; Location=318..642; Strand=-
  SCN-specific regions: Sequence locations=1-325
atgtgtggaagaggtacaacagtgattagaagaggttcaacagtgattagaagaggtacaacagcgattagaagagtgattaaaagaggtacaacagcgattagaagagtgattaaaagaggtacaacagcgattagaagagtgattaaaagaggtacaacagcgattagaagagtgattaaaagaggtacaacagtaaatagaagaggtacaacagcgattagaagagtgattaaaagaggtacaacagtaaatagaagaggtacaacagtgattaaaaaaggtacaacaatgattagaagaggtacaacagtgatcagaagag

SEQ ID NO: 67970 - DNA, 1112 bp, Heterodera glycines
  Genomic contig location: Contig_ID=SeqID_39396; Location=252..1363; Strand=-
  SCN-specific regions: Sequence locations=1-38,60-76,102-102,125 -880,902-1112
  Gene Ontology: Mol. function=transcriptional repressor activity; Biological process=negative regulation of transcription
atggacacgcttttgaacgagttgagactgcagcaccgaatggagcaacaacagaaggacagccaaactcagcaaattgagcagcagcagcaacaaatgatcgtccaacaacagcagcagcaactaatagctgctgtacaggttagtaaccacgaacaaatgaatgtacatttcattctctcgtcgttcccctttcaaattttcaattatttagccgttttccttttttagccgtctcagtttattttcactgtttgttttaggcacaacttgccacaacgcaccaaaatgttgccgcgcaacagtcgcagccattccaacaacaacaccaagtagataaaacacgtttgcgttgtttgtttttagttcaatttaacgctttaggcgttggttgctgcgcttgccaacaatcagcttgatctgatgatcaatgagatacaaacgcagtattcccgacaactcagtgcccaacaacttctcgctcaactgtctcgaatgaactttctcggcattcctccacaggacatctccacgctgcaaaacattgcgtccgggtccgcattaagcgaaatagtccgccagatgagtccggtgactgcggctgccgctgcacttcacagtccgctgtcctccgctggtgttcaaaatcccccgccaggcccttcccccgtacaacaccaaatgtcgacgactgtcagcaattgcagcggtcccattggtgtgcagaattttctcaacaatttggagtcgtttaacaatggcccaagcgcttgttctgctaccactaggattagtacgccaaccaccattagtgccaatttgtccgctgttgcggtggaagttggccatacgacgagcaatctcggggtcttttggctcttatttggttttaaactgcttagtccgttaagaataacacgacaaccagccccaccagcagtggtcatcgtcgcccggttggtcagcctgcttcgctttccctgcggcaagtcagtcagaacttcgcctgcccgtcctcttccggagtcacttccaccactgttccaactccgtcctcatcttccaacggcatttcttcgtctcaactcacgcgagaatcaaccgttgcggaa

SEQ ID NO: 67971 - DNA, 615 bp, Heterodera glycines
  Genomic contig location: Contig_ID=SeqID_39398; Location=34..648; Strand=-
  SCN-specific regions: Sequence locations=1-73,95-106,135-309,331 -340,384-615
atgtgccatgaggcaaaaaataatgtcgaaacatcaaaggaggagccgcaatatgaacttaaacaggtaaactaagaataatgaaagaaagaaaagaactgaaaagtttttataaaaagaaaaaataatttaatggacggacttttctaagcctttcttttaatttgggcccatttcagcgacttttaagatctaaagcctacccaatatggcttttttagtgcaagagtccatattctactaataatcataagtgtttttatagcctttaataactaatgattagtcatccaaaactacgagagacggtaaaaaccccaattccttggacttttaagacatttttttaaatataatattttaattattttaaataaaaaaatcagattgagtttaacgcgggtcaaattggcggcacttcggtgtccagccgtctctaccaaatccatcgtcataccgtgaaaaaagccgggctttctgtgcccgacgacaatttgccggccggagcaggcgacacgggcattgccgaagtgttggagaagcatggtgaggaaaactgagtcgaaattgatctcatttgctttccagcctccttttgataccaggggaaataaa

SEQ ID NO: 67972 - DNA, 1387 bp, Heterodera glycines
  Genomic contig location: Contig_ID=SeqID_8411; Location=3936..5322; Strand=-
  SCN-specific regions: Sequence locations=1-549,571-741,764-796,818 -968,995-1032,1057-1387
atggagaaaattaagaacaatattggcgactctttcgtttggatttcggtggacgaaacaacagacaaaatgggaagagcggtggccaatttgctgattggaaaattggatggacaaaaatggcacaccccacatttgatttccgtcaaatgcttggagaaagttgatagcgcggcaattgctcggttcgtcaacgaaggactcggtggaagtatgtgaaagattaagcttttttaggattacgcatttaggtggtcaactcgttcgacccaactgatgcatcatgcataagagaaagtcagtcgtgcttcactttgtcaacatggcaagacctcgcgtacattcacaccaactttggcaatttatgccctgccattgcaaaattggagtcacatggactgtcgataaacgaatcgatggaaatttttgcggacgttcacaaccaattggacaaagcagccggcgagaaagcagaaataatcagccaaaaaatctctttcattgtctcaaaaaatccctcatttgatcaaattgccaaattttgccaaatcctttccggaaaaagtgttgattgcgatgttccgcccactttaattccgttctacaaattcgcgcccctgacttcttgcgatgttgaacggactttctctatttacaaaacttttttattcggtaatctgatgcgtttttttgcctcaaaatttggaaagtacctcatttgcaactgcaatcagtgaataaaaattatttttgctcaatttttggctaaaaattatgtcactacttcggactatttgtcactatttcttcactattttggcatttttactcactattttagttaactatttcgagatttttcgtcactaaaagttgcggccctattcatcactaatttttcactcagacccccattcttaccagtgcttgtttttcccggttcctggttgccctaccgggacctgagattttcaaaacccgggaccgggacctctgaggaccgggaattcccggtcccgatgcactctagtgtaaattaatttaaaaaattttattcctcataattttacaggttgtttttgcaatttcaaatcaaaaatttctcaaggttttcggcagtgaagctcacagttgacccactcgcgcacccattcagatttggatttaattttaggcaatcaatttttttccgaagggatattcaaatcggaaaatatttgacgaaaaatggcaaaatatgcaaaaaatctgaaaatatgcacaaaaaatggcaaaatatgcaaaaaattctaaaaatatgcacaaaaaatggcaaaataagcaaaaaatctgaaaatatgcacaaaaaatggcaaaatatgcagaaaaacccaaatatgcaaataaa

SEQ ID NO: 67973 - DNA, 342 bp, Heterodera glycines
  Genomic contig location: Contig_ID=SeqID_8411; Location=1682..2023; Strand=-
  SCN-specific regions: Sequence locations=1-342
atgcctttgtttgttttcccccctttgtcgtcgtcgtccatcaacggcaccgctaattcccccgtttcctccgccttggccgaccaattccatcgccaattcgtttcgggccaacaaattgcgtcgatcaccgccatcccagcaaatgcatgtctgttcgtttcgatcattgacactgttgctgacgatggaggacaaatggcgagggcggacgaaaacggcacaaaaacaacggcaaaaggggaaaagcatcgcattgaaggcactttgttccgccaacactttgccatcagtggaggcaaaaaccatttggtgaatacgaatggtggcacggggcattga

SEQ ID NO: 67974 - DNA, 1094 bp, Heterodera glycines
  Genomic contig location: Contig_ID=SeqID_8411; Location=2570..3663; Strand=-
  SCN-specific regions: Sequence locations=1-106,128-523,546-724,746 -798,820-891,916-917,940-1094
atgctgcaacaaaacagaggccactgccgactcgtcaaaagactcctcttcggccgacggccttttgtccgattggcacttacgcttttctgccttctcctgctgaccgttttggcacttttggtggaatttccgtcgaaatgggccctcatttttaatggccatgggtcggacgggtgatttttttaaatttggggttcggatttagtgtgtctcaagccaattgattttattcaaatttgtcaattccatttcaaaactggacgcttttcaacggaatggccaaaaagagaattacaaaatgggaaacgaaaagcatttcctcaacttttatgaccaacagaaattgccaccgaatttttcctaagtttatcgctctttcgatcaatattttctaattttgtggattttcttagcaagttttcgtcctatgccaactccgatggccttggcgatgatggcaatggtttggcggtgccgcctaaatgttgccaatgtgccgatggttggcgcgggcattttgtgccggcggagacggaggcacgcgttttccaatcggtgcgcagggagcacatcgaattgctggccaaactgaacgaagcgcaggcgaaaatggacgcaatcgaagcgaaaatgggcgagaaaggtgcgatttttttttttggcttttttgtgcctctttaaaatccaattaaaaactcaaaagtttccctaacgtatttaacaaaatcacaaccaattgtaaaatttttattttccataattcgtccatcttgcaaatcgcaccacaaatttaaatttctaaaataatgatttttctagcggcgctttttggcattgccaattcgaggccaatgagctgcaaatttaaacattttcacaaattttcacattttttaattaaaaaaaatatttcatttcttccccttttcttccttcaaaatgtgcccttttcagaggccgaacttgccaaattggagctgcgagtggaggagttgaagttgttgcagagagagtacagcgacagtcgcgctgtacgcgttcaattgccacactctccgccaaagagaggcgaacactttcgagaggactga

SEQ ID NO: 67975 - DNA, 473 bp, Heterodera glycines
  Genomic contig location: Contig_ID=SeqID_8412; Location=258..730; Strand=-
  SCN-specific regions: Sequence locations=1-473
attccttgcacgcaattcgcgcatctcaaacaacacaacgaaacggtaaaacacaaagcaaaattggaacggaacaatggaggacaacagcagcaatttttgacaacaccaaacaatgttccaaaccaatttaaccttgatttgtgtgaagcctttgtctcagcaaagattcctttcaaaaattggagaatgaaaaattcaaaatttttttggaaaaatattgtaaacgggaaatgccccatcgttacaaacttcaaaaaaattacttgcggctgacttttgacaaggtcattcaaaaaacaaaaacagtaattaattttagaaaatatattggcgactctttctttggatttcggtggacgaaacgacagacaaaatgggaagaacggtggccaattgctgattggaaaattggatggacaaaaatcgcacaacccacatttgatttccgtcaaatgcttggagaaagttga

SEQ ID NO: 67976 - DNA, 862 bp, Heterodera glycines
  Genomic contig location: Contig_ID=SeqID_39406; Location=51..912; Strand=-
  SCN-specific regions: Sequence locations=1-38,261-311,372-862
  Gene Ontology: Mol. function=G-protein coupled receptor activity; Cellular component=plasma membrane; Biological process=G-protein coupled receptor protein signaling pathway
atgaatacttttaataatcaacaaaacgcgtcagcagacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaatgaggatgaaaatgatattgatttcataatcaacaatctgggaggagaaggtgatgaagatgaagatgatgttgaaaacggggatgatattaatgatgatgatgatgatgagcgagatgaactgctaccacttcgtctttgcttcttcgatgccgaaacatcccaggagcgcccactacagctcaacaaccaagtcgcccataaacatgtacctttgctaatagttgctgaattcatttgtgaaccttgcattcgagctggaatcaacatcaacgatgggcaaggtcagcgcgcacccggttgcgtttgcctatgtggaagagtgagaggtcaacagatgcgtcaatggatgtcaccaccttttgtaaatgctcctggggataatactcctcagccggaaggagctcctgtattcaacaaccgtcgtttattttttcattcttttgataacgaagcttctgaccccgtagaccaatttctcgactttcttatccatcatggatcaagaaaagcacacaccatttgtatcgctcataaacgaggaaaatacgactttcatctggtactcgaagcactacatcgtcggagttacccaccaaaac

SEQ ID NO: 67977 - DNA, 441 bp, Heterodera glycines
  Genomic contig location: Contig_ID=SeqID_39409; Location=185..625; Strand=+
  SCN-specific regions: Sequence locations=1-24,52-54,178-229,259 -259,343-348,381-441
atgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttccccccggaaccggaagacggtcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaacca

SEQ ID NO: 67978 - DNA, 117 bp, Heterodera glycines
  Genomic contig location: Contig_ID=SeqID_39409; Location=1003..1119; Strand=-
  SCN-specific regions: Sequence locations=1-71,107-117
atggtgatgacgggtaccgaggataagagttcgactccggagaaggggcttgagaaatggccactacgtctaaggatggcagcaggcgcgcaaattacccactctcaacgcgaggag

SEQ ID NO: 67979 - DNA, 540 bp, Heterodera glycines
  Genomic contig location: Contig_ID=SeqID_8413; Location=1768..2307; Strand=+
  SCN-specific regions: Sequence locations=1-123,160-428,450-540
atgcgatttccaagtacaatcttggaaaaaagtacagttaaacttttccaagcacaaaagccgaaatccaagtatgtacttggcattcaagtacgaatccgagccctgaactattataatgcgaaaaatactaatattttaataataaatttaataaatcagatttaagcaattgtttaattcatattcattcattatggattcatataatcactgattatttttaatcattttttggcaatttattaattaaagaattggccatccagaaacaaaaagtcacaaaatgaacgtttattcggcccaaacttattacaacaacgcatcgccagcagaagtgaaaaaggcaatccactggaattggattttgttcatcgccttttgctcggcatacaaaatgacaatttgtgggcaatcgaagcgaggcgaattcaaaattttgtaatttttgtgaaagcgccatattatccagttgcaaaaaagttattgccagatatgcacaaaaaagcgactttggaaaacttttacggacaagtttaa

SEQ ID NO: 67980 - DNA, 181 bp, Heterodera glycines
  Genomic contig location: Contig_ID=SeqID_8413; Location=2411..2591; Strand=+
  SCN-specific regions: Sequence locations=1-181
atgggtcaaaatatgaagctaattttaaagcagaagtcaatcgaatcaatggaaaattggcagcagaacagaactcattatacggagataattgacgaaagctcagagcaacagaacaataattatggacaggggcgatcaaaacgccaattggcaaattgtaaaatatgcggacgacaat

SEQ ID NO: 67981 - DNA, 864 bp, Heterodera glycines
  Genomic contig location: Contig_ID=SeqID_8414; Location=266..1129; Strand=+
  SCN-specific regions: Sequence locations=1-36,58-225,248-250,316 -531,559-594,645-742,764-864
atgggtcaaaatatgaagctaattttaaagcagaagtcaatcgaatcaagggaaaatgggcagcagaacagaacccattatacggagataatggacgaaagctcagagcaacagaacaataattatggacaagggcgatcaaaacgccaattggcaaattgtaaaatatgcggacgacaatgtcagtacattttctacggtgtcaaaagctgtgaaagtgagcagatttgtttcaaaaatgagaaaatgcaataaaatttttaattgatttttttattattatattaatttaccagattaaatattaattaaattggaattgtcggatattgaaattaatttttgccaaaatcaattaaaatatttattttcataggtatggtaaaatgccgcggctgtcgcttggacaaatgccttgtggccggcatggacccgactcttatcaatgtgccaccctcggacaagttcaagcagttcttgaccgaattagagaagcgcaaattgagcgcaatgctgactcattcggaaaagaattaaaaaacaaaattatttgacaattgttttaagtttttgttttgaaaaactaagtttaacttaaaaacaaaaaaataatttttctatattttttgatagataattttttacccattctttattcagttatttatatttatttggctttatcaattatttattcttatttactagtattttattgcttaaacggcacttattgatcgcattttttggcaatgcttctccatagccttttctttttatgtttacgttcttttactcataaacaattcatgacaaaaaaacttcggccaatttttgttgaaatatttggcgaagaatgggcaa

SEQ ID NO: 67982 - DNA, 930 bp, Heterodera glycines
  Genomic contig location: Contig_ID=SeqID_8414; Location=2030..2959; Strand=-
  SCN-specific regions: Sequence locations=1-128,170-215,239-265,304 -426,448-526,548-709,756-787,847-930
atgcatattgaaaaaattttccccgaaattcttatgattttaattttattcataagtttttcggactcggcaccacccaaaaataaatctgctgaaactgtcgacgcgtcaagttcagatgattattgaataaaaaattaatttaattaaattctttaattataattttcaaaacaatttcacaatttgttactgaaaactccgcgcacaatataaattatgttgtgtaatttgcttacgaatacacactgccaaaaaaacattttttgtaaaatttcatttatctattatttttatcataaaaaatagattaacttaaggaaaatatacggtaactgattatacggtcgacatcggaaaacaattaagcagatttcaaacggagaagttaattaaacaagcaaaacaatggataaaaaatgtgcaaaatgggcttaaagaagactttgatcaaaggtaatgtcggttgaaacagcgattgattttttgttaaaatttattattacatttgtccaagaatttcaacttttgggatattttgagccattttgaaattcttatttagggaaatttttttttgttgaaatccaaattaaattctgcttcattcctatttaggcttttcatccaagttgtccaattacgttttttccgtcgccatttcctcgaacatattttgagcaagcgtacaacgctcaaacagtaaatcattatttattataattttaatgtatatattttataaatcaaaattacacgataatcttgtccaattttaaaatagtgcttaaaattaattttaatacaaaaaatattttgcttttttatatttcattttatatttttgttgaacttttagacctttacatagatgttgggatcgaggaatgacaaaataaatttgactcttaaactaataatttaaataaa

SEQ ID NO: 67983 - DNA, 638 bp, Heterodera glycines
  Genomic contig location: Contig_ID=SeqID_39414; Location=650..1287; Strand=-
  SCN-specific regions: Sequence locations=1-328,350-481,508-597,620-638
tttttcagtgtccgtttgggggtactcaaacaattatgcttttgcgaaaatccaacgcagaattaaagtacaggctatagggtagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatcgggaagctattcccgaaggattcggtctccccataaatctgggcgcatcggttcagggggactgccccgaaaaccccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaa

SEQ ID NO: 67984 - DNA, 381 bp, Heterodera glycines
  Genomic contig location: Contig_ID=SeqID_39418; Location=1..381; Strand=-
  SCN-specific regions: Sequence locations=1-20,89-107,155-172,379-381
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctgga

SEQ ID NO: 67985 - DNA, 647 bp, Heterodera glycines
  Genomic contig location: Contig_ID=SeqID_1110; Location=167..813; Strand=+
  SCN-specific regions: Sequence locations=1-3,176-300,338-561,583-647
atgaatgcatcagtctggaaaataggtctttttgaaaaattaaaagatggcaaaatggcggagtgccgcgaatgcaaagcaaatggaagagccaaatatgaatttggcctgccagacttcagcaccaaatcgctcaaaaatcatcttttttcaacaatccatgcaaattcggaattgatatttttgaacaaggccatcccaatgttggactacaaatactgatttaattttgttggatgataaaaagttcataaaattttccataaaattttggtttagaacaaagaaaagaaattacgcaattttttttatatttataaatgcatttttaaaatttgaaaaaagcccggtcccgtacgggcgcccggtcaaaattttggaccgggcccgggacgcccggtaaaacgggctttttttgaacgggcggcccgccccggtcaattttcgaagcccggtcccggtcccggtactttcaaaattccggtctctagtaaataacattggatagagagagaaataacgcattaataagagggtgctgaaattcagtaccggtcatacaaaagcatttttgatgaagaagaatagagaaaaaaagcaaattcaacagagagtgttataggaaaagatttaaggacatcgagaga

SEQ ID NO: 67986 - DNA, 94 bp, Heterodera glycines
  Genomic contig location: Contig_ID=SeqID_1110; Location=342..435; Strand=-
  SCN-specific regions: Sequence locations=1-94
attttatggaaaattttatgaactttttatcatccaacaaaattaaatcagtatttgtagtccaacattgggatggccttgttcaaaaatatca

SEQ ID NO: 67987 - DNA, 713 bp, Heterodera glycines
  Genomic contig location: Contig_ID=SeqID_1111; Location=1281..1993; Strand=-
  SCN-specific regions: Sequence locations=1-317,339-713
atgatgagacccgtacaaaacaaagcaattgtaatagaccggaaaaagatccgtcgtccaccaaaaaatcaatgcaatctaaaaattgctcgagctttaacaaaaggtgaaattatcaaaaagcttaatgttttctttagaaaaacattttttttctattttttcaggtaataataagaaaaaacaattggacgaaggcccttacgttgacgcagcaatttattctcccgaaatgctcgaaaaattagaaaaacaggctggcaaaaaagtttatgtgaccaaaaaatacgatttggcagcacacgccagaacggtagaagaagcaaaacaaaatttgattttatacgacaaaaaaattgaccaattgagaaaaatggaggccaaatttgccgctttaacttatcaaaacaattctgaagaacaaacggaacagcagaggcatcacattttaaaattaattaaactaattccatgatggttgactcgaaaacctaaaaatttaatttgagaaaatttcggaatcgggatttttgagaaaaacctaaacctgatggacatgattgcaccctataaaaaaattattaaaggattacggaccagaaaggggatttcgacaaggtttcgcatgggagtgaacaggcggtgcaaaatttgaggacaaaatttcctgacagagatttatggaccatttataagaaaaaagaaaaaataaa

SEQ ID NO: 67988 - DNA, 1852 bp, Heterodera glycines
  Genomic contig location: Contig_ID=SeqID_1112; Location=152..2003; Strand=-
  SCN-specific regions: Sequence locations=1-27,49-91,116-129,152 -179,205-299,330-371,466-643,665-777,835-1054,1076-1596,1625 -1650,1680-1852
atgagaaactctcgaaaatttaggctaattgtgaaaaaggaaaagtcaagagaactaattgattataaaattgagaatcaaggtaacaaacaaaatgataagaaaaataaatttttaatttcacagctcggataagtgatgaagacttgggcaaactcaaaaagcttgcaaatatcaggtaaatttaaaaaaaattttaattttgattaagccgtttatcaagacaaatccaaaaatacccaaattgttcataaaaaaaattgactttatttagacaagggaagcctcaaaatctttgcttaattaatttttttaattttttttataatctttcattcattttgggccaactaaaatgcgataggaattcgtttttaaaaaatacatttttattatcaatttccaaaatttttaaataaaatgataaaagataaaataaaaatacctattaaaaattttaattttgaagaataagaggcgacgaagcgcatcattcattttatgacgaagaaatttatagagaaattggcgctggtaaaaaaactaaaaaaataacattttgattttgcgaatttaatttagaaataagcgatgatgaaattcatgaaatattgtctgattatgaccgaaattcaaggtcaatttttgaaattcataaaacaattttattaaattatacccacatttagattaagcattccaagaaacgaagaacgaatcattgaacaaaattttaagccttcaccaaactcaaaagaattggaaaatttgcaagacaaaagaaaaagaggtttaatggaattttttattttttttataaaagtaaatttttttcgccaaatcttttttccgtaagccaaatatttttaagctttttgattatttttacttggaatatttcaattctacacctaaaaaccagaggccgggacgggttcgttggtattgagataggcttttttctcaaactcaacaaattctcaatgaaatatttaaaaaaaaattctcaaaaatacctctcattttaacattgcttggcaaaagcgagcccgttccgatctctactaaaaacacatctaaaacaaataaaaccaattttcattaagcgcgtggcaaaaatttatcggagccatcaggacaaaatcgtatgaaacaaatattcaattctgctgatcaccacgacccattagagccgagctcgtcaaattatgaccaagatgatttttcatttgactttggacgagcctggcaaagtccttcccctaacaaccctcgtgtatttaaatcagaagcaagaacggcaccatcttcgccaattacgcacttcatgccaagcacttcaaacagttcaccaatttcaccaagaaggtcctcctggcaaggtccgccagtgtataatgatgggcgagggtccaattccgctgctagctcggcgccgtcatcaccaacaatgccaaaatcgtcggcaacaagtccaagcagttctccgaatacaaagatgcgaaaaacaaagaaaagtgaattagtgggctttttaaaatgaactttaaaaactaattgggaaaagggctacagtgattaattacaaaaattggtacctattaaaatacattttaatatattttcatacctcggccaaggattcttgacttttattaattaattacaaattaaataaacctttctaggcctttcattcaataaattgtttggacgcaagtcctccggcgacagcgaaaagcagttgactgaagaagattatgggggatggcgaagatacaaagaatgcgagttgggcatacaaaatgccatcacaacgatcagaagccgattggaccaatgggatgccgag

SEQ ID NO: 67989 - DNA, 355 bp, Heterodera glycines
  Genomic contig location: Contig_ID=SeqID_1112; Location=2133..2487; Strand=-
  SCN-specific regions: Sequence locations=1-18,50-167,255-290,312 -312,337-355
atgatcgcaaatgtaaaattttttcctttaattatttttgtgtatcaaacgctgatcaatttaatcgctgaaagtggcgaaattaactcatgcagaacatcaaatgtgtcgtcgccgtcgaaaagcccccgaaggacattggcacaattatttcgagaagaaaatggtaaaaatataaaaaaattcgaaaaataaataaaaaacaatgaaaaatttataaaaaagtttagaaataaatgataaaatatttttaagaatcaagtcagagagaaaatgaggacaagaagatgaaaggcaaaatgtgcaaaagtgattcatcaactcaaagttaaaaatataaatacagaataataaa

SEQ ID NO: 67990 - DNA, 4663 bp, Heterodera glycines
  misc_feature (4642)..(4642): n is a, c, g, or t
  Genomic contig location: Contig_ID=SeqID_1113; Location=11..4673; Strand=-
  SCN-specific regions: Sequence locations=1-80,108-203,227-409,445 -662,700-847,952-1380,1402-1794,1820-2170,2192-2239,2310-2345,2368 -2497,2591-2661,2773-2890,2912-2973,2996-3498,3521-3546,3570 -3620,3642-3679,3727-3960,...
  SCN-specific regions: Sequence locations=...4150-4297,4319-4417,4439 -4539,4580-4663
atggacccaactctggtggaagctgaacaaagtgaggaactaagccaattcatccaatcgctttacaaagccgtgaatttcttcaacagcagctgaaggagaaagaagaaaaaaattgtcacatggaaacggtaatttcttacacaaatacagtaacttcttcaatttttaaatcattttaggaaagcggcgcaaatgtaaatgatgaagatgaaaatgaaaatggccaatttgaaaagataaaacaaggtcagttcatagacagtggctaaattatttggcatttcggtcaattttttattaaaaaaagtaacggaatatgtttttgaaatgattagggttggcactttagcattatcactattttttaatcgaatagtaaatttaatataacaattatttaacctacttttaagaaaaaacatgaatttaacttcctttcacgcagaaattatttgttaaattagaaaaaatttggaaatttacttttattctaggagtttaaggctgatggattctctggtacatccattaatcatctggtaaaaactaaaaacccattgttttcagaaattggatcagtgattcagctgttgcgtacaatgccacacttcgaaatgttagagccaactgatcaagtaaaattccaattatgctttaacatttaataatttaattaaatttaaaatttattttttaccttttaggtgattcttttgagttttgttacaattcctttgattgcaatgaatgcccgttttaatccattaaaaacgaactcagaaattatcacaaataacaacaaatttaacccattattccatgcggccactgttaaaacgtaaacaatttttataattttccttatttttataatttttttatgtatgattttgttaaatttaaaaataattctctctaaatcattttttcatattttatttttaaattcagattacaactttcggaggaagaattttttttggtctgcgcattgacatcgtcaaattcaggcaacaattaaataattgaaaacgaattacaaaataaaaattagttttttttgacaaattttgggttatttttacaataaatcgtgacaatgttctaattgttcagcagttactgctggtctctctgctgctggtcgtcgcactttgcaacatttgtccgaacattactccaatctgttgatgcaccatttgtgcaccaactgcggcaacatggcgggggcatttcgtcatgccgaattagtccatctgaccgaatcggtgtttttaaatgcggaacagcttaccgaatattatcggcaagaaattacaaattgttttctgggcaaaatttgaaccagtcaaacaaactttagaatatattgaccgaatatttattaaacatttttaagccgtatatttgtatattcttattagtaataaaaattaatgtttcctttaattggtttattttaaatttccttcgagaaaaaaagaatttttttttaactttttggtgccttttttcatgcctttttcagtatttttgaaaattttgcaagttttcttatcatatttccggaccacagtatacctggtttttgaaattttaacactatcatttttgtctaacattggtttcagattccatccggcggtagacaaagaaagatcctttcttggatttttacaatctatgacattttttcaaatgcgtccaattgctttgcaaaagcttcgaaaaatatttcttttacggttctttttatattaatggttaaggttcgagtctcctctacgtcacataaatattttaattataaaataatgattttcaaaatggtatttttaagttttggtccaaggcatagattcttggtatggataaccttaaaaatcttcaaacaataaaattaaattaatcatacaatttttgattacaaaaacatttgttgattaaacagatggtttccaataataaacaatttttgctataaattgttttcgacacaaaaatattttatcaggacataaaaaatcgtaaaaacggttagtgaggtccataaattgacgatgatgaatcaagtccgtcgactaatttaataaagcaaacaattagccatttgcacaattttctgccgtttactatttgtcttttacaatgatggttagaaagagcattttcttcattaaataaattttagggaaatgaaaaaaatattttatcctttaaatttaattgcataaccaatttaataataaaaattattgatttagcaatattatgattttatttataataataatttgtataattaacttttgcccagtaacaggattttgggtttgtttcttaatttttcaaattaattctattttatttaaagttaatccctgattattggacaacaatttatcggaatgggcacattgagcctggaagatccaatgagcaatttattacctttccaaattccaaacatatgtacattggatattggtaggagaaatattttgaaataaattctaaataaaatatattttaaatttttatttatttattttttaaattatctctgaatttttatttaataaaaattccaaaaatcaaaaaaaaattactatatcaggaaaattcgagaacatgctaatgaaaattcctcaatcaaacaaattttttgaaaaaaaaaaaattataataaatccaaagcatattatttatgataataatattcataattcaaaaaatgaaaatatggaaattaattgaataataaattaacctttttttcattttaggataagctccgagaaaaattatcatgaagcgtatggcagtgtgtattcggatggggttgatgagcgtggcacacaatactgtggcacatttgcggatgcttatcaaaataaaagtgtaaaaatttgtggcagtttccgggttttatccaacaaacggaatgccacgttaaatccgtaatgatagaaaatatgtttacaattattaggaattatatttctaggcaaatatctaacattctatttttatgcccttgatacgctcagaaaaagacaaaaacgaagtttttacctgtcgcattttttttttgcacatttcgctattttgggtgcctatttatgggattttcggaaaattccttaaaaaaagaagtaaaaccccaagaatcgaccctaaaaattcagaaaaacaccctaaaaactgaaaactttttaaaaaattgatgacagaaagtttcatttaaaattgtccttattctaatattttttgataattaaaataacttcgtttacaaatcaaatataacaaaattgcttttttagctattcaaataacgtcttttactttaatttgaaaatattccaatattcttaatactttttattttgtgaaattcattaatttttacttttggttttaaattttttatagataatgccaaaatcctttttgtctgttttgttgtgaaaaagagtatattaaattttcgctaagaatcatggacaagaaaaatatattcgataatattgctatgtcaagtattttaataaattttttgctttgtaaattatgtttttacattagctgcctattcataatataaaatttattgcaaatatttgtattttttccaattttgaaaaaaacccttaagttttatcaaaagcccatgttaatatttaaaagatatcataaattattataataaatctttttttagatttgagtttgtgccgatatctgacacaataaaaaacccagaaaaagccgttgaatatttggattggcaaattgcgcgatatcggacaaattcgagtgaaaaatgggttatcgggtgctcaaatgttcttaagagaatggcatattttccacataacggaggtcaattaaaaaaggtaaaccctatttattaaaaatgctttatttatattgcttttatccaatataaactacaaaaaaaattattttaatctcactaaattaaatttctttaaacaaatcaaaaaaaaaaaatttaataataaaaaatatatttttgattaaatatactttatattttttatgttaacaagattcctatattttataatattttcaatattatgccatttataattttatatttttaattattatttttttctaaaggttgatttcaaagaaaatgtgcgcactattttggagaacaatgtgcaagtgttgcaacgttcagccgcatttgatccacgggatttgtatgagcaagtgccaactgttgcacagattgcggcatcaacacgacggacaactgccaaaaaattgacaacaaaaacgatgccaaaaacgacgaggattacgatgaaaactgtgagtgcgcgcataatttggaatttttttccacgaattaggcattctcgagcaattaatgagatttattaaattatttttgaagacttctacaacaaccgaaactccagcagaacatgagcaagattatgataatttggctggagcaggaattgaatgggatgcaaatgtggaagcaaagccacgtaaaaatatgaaaattaaaaaataaataaatattttttaagcttccgactcttcacaaaaattagaaggtggcgccgttcttagcgtcgctgacaacgaattnaatattgcaaaacaaaaataa

SEQ ID NO: 67991 - DNA, 1339 bp, Heterodera glycines
  Genomic contig location: Contig_ID=SeqID_1113; Location=5546..6884; Strand=+
  SCN-specific regions: Sequence locations=1-237,273-362,385-548,570 -724,761-764,787-818,853-914,939-1213,1235-1300,1336-1339
atgtcgtagtgagtaaggttgttgatcggtctgcagcaacccctttgctttggtgaatgctttttcaatttgtatttaaatattttggcatttttgataaatatctttccgttccttactaatcatatggtcaggtcattcgaaaactttaaatgtttagaagttatttctaaactattgactgccattagacaatgacaattattaaagagttgtaatcgaaaattgcaaaaagtcaaaatttttgaaatttttcttaataattttttttacagctcagaaaatctttttgatttttgtaaggcgaatagagcatgtgaagtttcgaatgataccaagaatgttagatttgagcgagaaagaaaaaagttagaacccaaaaactcgggctggcgcaaaaacgattgcgcgaaaatctggtccaaatttttgcatggttttaggtcagctttgaaatcttagggagaattttgtgggccggcatcgctgacatgaacaatttttcggatttttaatgaattttgttaagaaaaaggcttttgctggagaaaaaaaaaatttaaaaaatagcatccgtcaagctttgctttggcaattatgatcgcatcatgccttttcattctgttttgattggactgctcagaaattgtgttgaagtgatttgagaaagattgcaaaggcgttttttggaaatgataaaacttttttcatcttggcttttttgtttatttttgtataattagtttaaaataatatttttgccggtttttcactattaaaaacattagcgtcggtaagagcaatgaaagtgacgcaacaaaaaattttaaaaaaagtattttaatataaaaaggatccggaaagaataatagtctaacttaaataatcaatcttataaattaatatttaaccagaattattattttttattcaaaaataccatatttttgataattctaaaaacagctaagaaaaattgtaaaactaaaactatttagtgaaactccgtttttggttgtgccattgaaaactaattgtttgactttgatttgcttcacttgtacattctgtttcaaaattacagacccagggaaattttgtgtttcatctggcttggaatagggaaatttttttacaaacttttagaggtctggacggagtatggagtatatgtctaagatgcttccccgaagatcaaaaaaactatatgccatatttgaatttcaaattttataatattatccacttttgaagctcggcgccaatatttgggttttgaaatagcatcttattttataactttgaccaaatttaatattttgggattttaaatgaaaaa

SEQ ID NO: 67992 - DNA, 982 bp, Heterodera glycines
  Genomic contig location: Contig_ID=SeqID_8417; Location=82..1063; Strand=-
  SCN-specific regions: Sequence locations=1-53,75-453,477-555,639 -709,731-733,758-982
tgtccatttgacggatggcggcggaggattcaaagaagtgcaaattcaaactttggcacaatgccatgccaacaatggatcaaaagaaaccgcaaataagccttacggaattgaatttcgtatgcctcgggaaggcggaaattgtgacgatgggtgaaaaaactccaaaataattaatgcaaataattatattttcaattaatagcctcctcgtctgttacccggcacttcttcaacgaggcaataatcatttggagaaaagcagaaattttaaagttacaagaaaatttatagttgaagctaaaatggtaaattttgggtagctaattaataaattacctaattaattctccccaggacaattcgcttggaaaagaatgtgtgcaaaatatggcaaagaatggccgcgaaaatggcacaataatttggcgtggaattaaactgcgcacaatgccaaagcaaaataaccaaaacaatggaagaattattattttggaaacatcaatttccttaaataaacagttaatgttactaagtattttaagcaaaagtaccaaatttttttgtattttaattttacattttataaaattaaatttgtattaaaataattttttaaatattttaagatataatttgagtgcaggacaacacaaattttctgtactttttgctttgaatcaaactgctgacaatgagccattcactcgcttttcatcggtggaaaatggtgaaaaattattatatattttaaattggcattctcggctttcccaaaatgccattctcagacttcggtggccgtgccatgcaaaatgatttccttcgttcaaatggtccgtcttttttgtcggattatgccgacctttggcttcttggacttgacatgctgccgatggcacaccaaacagaagagcaaacagaacagctgaagatggagctgttcatcagccgcagctccaaatgcctcattgaagcatgg

SEQ ID NO: 67993 - DNA, 294 bp, Heterodera glycines
  Genomic contig location: Contig_ID=SeqID_8418; Location=1521..1814; Strand=+
  SCN-specific regions: Sequence locations=1-294
atgccactcagacggaaaatcaatgctgcggtgaaaaagtaaattcaataataccgtatcactaggtttggtacggtcattcaagaaacgatttaagtgccaatatatgtcaaaatgttcaaattcaagatggcctacacgatgaaactgaatgagtcgtgtgcaattcttggcaaaaagttcgattgttcatttgcgtggcttttggagcggtacaaactgtcggacaaatacgcaatcaaagcgaacactgaggtaaaatacacaattaaattttaataattcatcaaaata

SEQ ID NO: 67994 - DNA, 327 bp, Heterodera glycines
  Genomic contig location: Contig_ID=SeqID_39422; Location=456..782; Strand=+
  SCN-specific regions: Sequence locations=1-327
atggagaaaaagctggagtggaacgggattcccgccttttccccgttaaaatcccgtcaaatttccctgttgccagaccggtgtaattactttttatgtgttttatacattttttcacaagcaattcaaaaaacaaattttcaaaagtttatttatttttttctaaggcattcttgcatttgctttaaaaataagctttctcatcatgagttttttttatgctattaaattttcagttatctttatttgaatctttttttgtttaccaattcaaaaatgtcgcacaatccgaaagaagcaaataaagaaatggaaaaagcgatgtaa

SEQ ID NO: 67995 - DNA, 968 bp, Heterodera glycines
  Genomic contig location: Contig_ID=SeqID_39423; Location=6..973; Strand=+
  SCN-specific regions: Sequence locations=1-463,656-848,870-929,962-968
tgattagaagagatacaacagtgattagaagtagtacaacagtgattagaagaggttcaacagtgattagaagtagtacaacagtgattagaagaggtacaacagtgattagaagagatacaacaatgattagaagaggtacagcagtgattagaagaggttcaacagtgattagaagtagtacaacagtgattagaagaggttcaacagtgattagaagtagtacaacagtgattagaagaggtacaacagtgattagaagagatacaacagtgattagaagtagtacaaatttgattagaaggggtacaacagtgatgagaagaggtacaacagtgattagaagaggtacagcagttattagagaggcacaacagtaaatagaagaggtacaacagtaattagaagaggtacaacagtgattagaagtagtacaaatttgattagaaggggtacaacagtgattaattagtaaattcattaaattaaaatgaaaatattttttaacaaatttaattaaaaaaaatacatgaaattctatcaattaaaaaaataattaatttaaacttataaaatgtattcatcaaaaaaaaaattaatttaaatataattttttatttattaactcaacaaaatattttaaattaattaaaatcattgaaaataacgtaaaaatgcacagaaaaattatgttacaccgtccggactcgaactttgccccccccccaaaaatgatgcctcagaatccccaatcacacagggattctgaggtcttaacgatgtcaaaagtaaaatctgatcacatattcatgatcagcgtcataaaatagccctaataacatgtttctggaagatttttggtgaaaaaatttttccactcaaaaatcctggtcacccccctttggtcccgaaccccaaaatcacttttattttggtatcattttttaaaaatgtgataaaaatatgaa

SEQ ID NO: 67996 - DNA, 157 bp, Heterodera glycines
  Genomic contig location: Contig_ID=SeqID_39428; Location=1008..1164; Strand=+
  SCN-specific regions: Sequence locations=1-157
aatgcttcgcactatttctttgttcaaagtgtaaaatgtgccgtggctctttcgaatttggcactttccgttggcccatcggacaattcgtcgtccaattggcccccctctctgccgcccccaaatattgtcggaatccgacgcattcgaatggaag

SEQ ID NO: 67997 - DNA, 49 bp, Heterodera glycines; identical to SEQ ID NO: 51181
  Genomic contig location: Contig_ID=SeqID_39429; Location=748..796; Strand=-
  SCN-specific regions: Sequence locations=1-49

SEQ ID NO: 67998 - DNA, 49 bp, Heterodera glycines
  Genomic contig location: Contig_ID=SeqID_39430; Location=1025..1073; Strand=-
  SCN-specific regions: Sequence locations=1-49
ggaagctactcccgaaggattcggtctccccataaatctcggcgcatcg

SEQ ID NO: 67999 - DNA, 2384 bp, Heterodera glycines
  Genomic contig location: Contig_ID=SeqID_8419; Location=525..2908; Strand=-
  SCN-specific regions: Sequence locations=1-43,101-602,636-878,900 -1306,1328-1568,1590-2244,2276-2333,2368-2384
  Gene Ontology: Cellular component=integral to plasma membrane; Biological process=cytoskeleton organization and biogenesis
atgtgcccggaagagcgggaccttgtcattgagaaaggtgctcaaaaatttataaaaaattttctgtttttttgaaaattttataaatttgaaaaaattacgcgtgattaaccgcgatcatttgaaataattaaaaaccctcaaagtatgtagcgacttttacctcagaatttgtttcttttttgcaaaaattctaagaattaattaaattttttacgtaaaatttcttttatatatttcatcattttttgtgtttttcaggactaaaaacgtgcaacagcgcgttggacgagctgtccaagaaggtcatcgaagtgtttggcaaactgtgcacggacaaacaccaaatggagttgaaccaatcgccgcacacatgcgcacgcattttggccgccacttacaaactgttggcagcagctgaaaatgacggtgggttggtcttcaacgacggggggggggagacagaaaaatggtttttttaaaaatgaaaatgagtgatttcttggaaaacaaaagcattttatgacggcacaagcttgaattcccttgatttttttaaaaatatgaccccaatgtcaaaaagttttgtcattttgagccaaaaattatacatttttaaaaaatttggcccaccccaaaagtatgtcatttgagccaaaatctttttttcctccgtcggcatttgtctttgaactactccttatttaatttactatatgccctattcataaacagataagtgtgagcttgcgcagcaacaaaaaatggcggacgaacgaatgcccggccacgagagcattcgcgaagcgggccaacccgtctccgccggcgactccaccgcgctttacttggccgagctgtgccatgccattggcagtgccaaagaaattcacatttccaagtgcattttttgttttactctacagcgtactcatataaacatttcgccaaatcaatcatttttaattgaaaattttgaaaaagagttttttgttagaaaaaaaacaaagcaaatcgcttaattcccccaaaaattttcaggcacatttttgtgccccgtgaattcctctaccaaaacttggaacggcatctgaagacgtcgctggtccggcatttacgtttcgcaacagcgacgacaacgtccgggacggcaccgaacgtaggaggcggcgccgggccggcgatggcacagaatgacagcaacacaaccaccgccaattgtcctatgtcaccgcatcctcggcgcccgtccgaaatgctggcatttctctgtgcccaaatgcacgcgctgcaggacttggacacattttgtgggttatttttatttcacactttttcaaataatttgccggaaaacaaaggcgtttgccgggtttttgtggggtccgtgccgcattttgactcatggtggaaaaaattggcacccctacacattttgtagtggcctatgacattgtgtgtctgttccgcgacgcgatgctccaacaatcgcagcgggaggacgcccatgggcaggagacattggccgaagtgtactcaaaatggtgagacgagaggtcctccctataaatggattttgattcaattagtatcgagaactgacgtattttcgtctcgtcgtaagccatgagaatttgggggccaaatttttcgactttttaaaatcaaccctcagtaaaaaactcccagtcccggactctacttacaatcacaacccacaagggtggtttttcagtttctttcattgaattttttctttgtgtctcgtcataatgtggtctcgagaagcggtacttgttggatttcctctgccattgcagcattacaatgccatgcgacgctgcactcttccacattatgccaaaaaaatcacgtgccattttataggtatttggaggtgctgttgcgcaaggcgagcaccggacagttgctgtactcggaccatttgcaagcatttgtgaccagtgaacagccgcagcaacagcagacgagtgccgccaccggcgccggtgcattgttcgccgaaagttacacggacccgcgggaattgcgcgcgcttgcccaactgatcggcccttacggcatcaaggcgatggaggagcggctggtgtggcaaattgcaagccaaatcacggagctgttcaagctggtcagggagaacagggagacactgcacgcggcacgcgtcaactttgacaagccggcaaaactgcgagaagtgcgttctcaatgctctttttttggctttctctttctctcactttctctctctctccttttgctctcatcagtttttcagcgatttgactgatcgccgcagttatacaacacccaaaaatttaaaaaagttttaaaattaaatttaaacttttttgtgcaataaa

SEQ ID NO: 68000 - DNA, 76 bp, Heterodera glycines
  Genomic contig location: Contig_ID=SeqID_8421; Location=32..107; Strand=-
  SCN-specific regions: Sequence locations=1-76
atgactggaaagggatttggtcggctttatatgtactcggataaacttgaagaacggaggatgggaatttgggatg

SEQ ID NO: 68001 - DNA, 309 bp, Heterodera glycines
  Genomic contig location: Contig_ID=SeqID_8421; Location=198..506; Strand=+
  SCN-specific regions: Sequence locations=1-25,61-309
atgtctgacaatccgaaggaagcggagaaagaaatggaaaaagcaatgtaacaattaaattttgaatttccatgttaatcattttgctgtttcagcttcatcgctgccgactgttggttggaagtgttcggtttgcttccacgctttcaacttggactgggaattgcgatgattagccaccgttttgaccgccgcgtggatgaacatttcaaaacgcgcaaatggacattgggacgaattgtaattcaacgcaaaattggagagaacggcgcaaaggaaatggaaattgtcaattccaatggaaaatga

SEQ ID NO: 68002 - DNA, 482 bp, Heterodera glycines
  Genomic contig location: Contig_ID=SeqID_39436; Location=540..1021; Strand=+
  SCN-specific regions: Sequence locations=1-482
atgcaacgagcaatcaaatattttattgactattacgccataaacgacattactcaactgtatgctctgttaaaatcggaaatcgactcacacccgtccaattatttcccaaatcctctgctatcagtctcctgtgtccatattgtgaacaccgagttcgaaaaccaaccggtgatagtggaaggaacgcttgatttgatagacgagctgctcttttcgacatgctaccccaagacgaggcagggagtcggctggtaagtgagggattaatgtcaattatttaatattttttgttcaggagcgaacctctgtatgtggaactgacagatctaatggtttgtccgggcgatttgccaatatgtctgtcacacttcggacaacggaaggaacgacgacccagcttgatggtcgacgaactggattggcacgacagcgacgacgacgccgcagacgaagcctggtgaaagtgttatgtgaattca

SEQ ID NO: 68003 - DNA, 911 bp, Heterodera glycines
  Genomic contig location: Contig_ID=SeqID_39438; Location=53..963; Strand=+
  SCN-specific regions: Sequence locations=1-66,88-607,629-760,786-867
tctcccctttttggatagaaaaagcatcagagtgcttaaactaacatgtaaataaaatttggtgcgtttcagagcattttctgaaaaaatatttatgaaataaaaaaatcgatttttttcaagtgtccgtttgggggtactcaaacaattatggggagcaaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcatttctgaaaaaaatatttatgaattaattatgcaaaaataaataaaaatt

SEQ ID NO: 68004 - DNA, 378 bp, Heterodera glycines
  Genomic contig location: Contig_ID=SeqID_8422; Location=435..812; Strand=+
  SCN-specific regions: Sequence locations=1-38,202-276,298-378
atgggacgaacgaacgaaatgaatgggcaaaaaacggcgaagaaaaaagaaaaaaaagaaaagggaaatgagacgtcaaaaagggcacagaaaaaggcaaatggacggcaggaagaaaaacgacaaaaggctcagaaggaggaaaaggaaggagaagaggaggaggaacaacgagaaaacatggaagaggagaggggggagacaagtcaaatggacgtcaacgaatgcacaaccgcaacatttgaggcaagtggaaaaaaacgaaaaatcgaagatttaacagtctttgattttgaaatcatatgacaattctgtggcagattcggaaatagtacctccgattttcctgctgaagtaaagttggctagaatgagacca

SEQ ID NO: 68005 - DNA, 928 bp, Heterodera glycines
  Genomic contig location: Contig_ID=SeqID_8423; Location=359..1286; Strand=-
  SCN-specific regions: Sequence locations=1-49,71-928
atgcgtttcatcgctttggacgcatacgaaaaatctgggttgctcgtcgtcctcctggctttgcttttgtcgagtttgaggatgcacgagacgctgaagatgctgtgcgtgcactcgacggaacgtatgtgatttcctaaatagcagtcgctcaattgtgtttaggaggatttgtggcgtcaaggcccgcgtagagctttctcatgggagcggaagagggggcggacgcggttttcgaggcggagggggacgttatgacggtaaaggccgtaatcttccgaaaacttcaaatttgtttctctcagaccgttatggtcgtgatcgttatgaccgtgatcgcgaccgtcgttatcgttcaaggtattaatgaaattaattcgttgaagcttttttcgaaacttgaacattgcgcggatgagtggtcgaagtttataaacttcaatttgtcaaatttagcttttcttcatcaaccatcccatcttgttgcccttctcctcaattctccctcaaactccatcttccaatctcaaccctcacataatgccatccaccccatctcttctcattgtcagtcttggcaccctcttccttcgcaacaagaggaacaaaaaaattcatccatccacccaaacattttatggtttttccttaaacttggatggaaaaatgccgaaatagtttaaaacccttccaaaatcactcttcttccattcctccaagaaaattttctaccaattcaatcttttcaggtcgcgttctcgcactcctcgccgttcccgaagccgctctcctccgcttcgcgagcgcagccgatctccgagctacagccgtcgttctcgctctcgttaaagtaaattggcaaaactagtcacagtatagccctttattgtttcagggaaagaaatgctcgatgatgctatcagaatga

SEQ ID NO: 68006 - DNA, 1630 bp, Heterodera glycines
  Genomic contig location: Contig_ID=SeqID_8423; Location=1148..2777; Strand=+
  SCN-specific regions: Sequence locations=1-69,91-373,401-579,726 -803,906-987,1014-1198,1220-1630
  Gene Ontology: Mol. function=helicase activity; Cellular component =nucleus; Biological process=chromatin modeling
taggaaatcacatacgttccgtcgagtgcacgcacagcatcttcagcgtctcgtgcatcctcaaactcgacaaaagcaaagccaggaggacgacgagcaacccagatttttcgtatgcgtccaaagcgatgaaacgcatcgtccaactataaaattaaaattcaattataaaaacaatatctagcttgtgcgtccaatacgactcaatcggaattacagcctatttttgttttagtttgatatatacagtttcagtcaataaataaactttactagcggattggacgcctaaaagacattggatgcgtaattggaatgagtaaaaacctcttcagaagttgcatcctcaggtaaaccaccaacataaatcttaactgttttttgaaaaattattgtagaaaaacctaaaaccttcgcatcgagatattcatttcttcgagaagacattattcatcaacaaataaaataatacgtagtaaaaatggcaacttgtgcctttctgttatatgtaaaagctatgaaaagatggaaaccgcgaaaataggtttttacgagtcttcctttatctcctctcttacttctctctttcttctccattctctttccctcctctctctctctccctcacttcatttctccctcactccctttctcttaatctcatctctctctctctccctctccccctctctcttaacctcttatctctctctcttcctttctcttttcgcattccactttcagtctctcaatcattttctctcttactcttcatcttttcctttctcaatccattctcttagtctctctttctctctcctctctcccccccccctctcactcattctctctctttatctctctctctctctcttaatctcatctctctcttccctttttctctcctcactgcacctcttaacaacgcccaaaaaaactcggttttcgtgcgtcaaattaattactttctttaattaatctactaggtattttaatttaattttaaatttttagtatacgaaagatggagacacaaaattcgtccaagagctttgatgattctgacgtaaaaatggaggaagttaaagaacagttggatgaaaaggtttgcttggattgaggattgtttcagcaataaataatttagacgaagcctgagttcgacaaattcctaaatgagatcgaaaatgaagtccaaaagcaagtttttcaagaaaaggtaatttgttaatttctttttgctatttcaaattagagaaattaaaggcggcaccgacagcaaaacgtgaaggggccttggtaaagtcggctgcgttaggggaccaccgccacagaatgaccgaaaaagaggaagacgagcaactgctgcaacagagcgttcgaagcgacgacagtccgttcatcttcgagaattccccacctttcatcaaaaacggggaaatgcgcgactaccaagtccgtggactgaattggttgattcaattggaacacaaccgaatcaacggcattttggcggacgaaatggggtaaaatgcttttgcttcctctaattttatgacctttccaatgcgttaagtcttggcaaaacccttcagacgatcgccgttcttggatttttgaagttttacag

SEQ ID NO: 68007 - DNA, 685 bp, Heterodera glycines
  Genomic contig location: Contig_ID=SeqID_39442; Location=285..969; Strand=+
  SCN-specific regions: Sequence locations=1-298,320-685
atgtctaaaagagagaatcaccccgaaaaggaaagggaagaaaaccgcgccaaatttctccgctcgctcatcgatgatgcccatttaattttggcacatggaaacccaaaaatcatcgaccatcgcgtgagtaacagcagcatgcctttttatcagttcttaatttttatagatttcacattctgaccgttgcgagtccttttggataagggccggttttctccctctgtacgagagtttgcccgtttgggaaatggaaaaagtgccgtccattcgaaaagtgaagttcaccggcgatgacaggtccaaataattaactttatttccatcaaatattattttttaataatgtccaacaaaacagacgccgtcttggcgaactttcctttacaatgcgcgacaaacatggcgatgcaagtgcggacgaaaagcccaatgaaaagggtaactttatccgaattgcggggcgtatttctcccttaccattttttcagctattcgattgggatgacccgggcagactcgaggcaccagcgtttcccccgttttttgacgttgcggatgcattgataatgtcgcccatggtttataatattctcacctactcagagccattgtgacaatgctcagccttcgaataagggtcgggtaagtccaattcattcgcactattcatttttgtgta

SEQ ID NO: 68008 - DNA, 392 bp, Heterodera glycines
  Genomic contig location: Contig_ID=SeqID_39444; Location=152..543; Strand=-
  SCN-specific regions: Sequence locations=1-392
atgctttatcaaattgagttgccatttgcctcagtaattatggactcatcaatcagcagaaatgacgacgtttttgcgtacaaacggttctccaaatttttcttcaaaattgagtcgtttgtgtctccgttcaccattttctacgcggactttgccaaatatgaaaagggcgaacacgttcagttggaagtgtttcgccagggcaaagtgcccgagatgatggacagcaaggaattcacggtggaacaggtcggaagcaagctctaattgagactacttataaaaaatcccaattaaggctttaatttgtacaaaattatttttaattgtcgtccgttccttgcaataatttcaaatttcaggtttcctataccagcaaagatgggacaccg

SEQ ID NO: 68009 - DNA, 828 bp, Heterodera glycines
  Genomic contig location: Contig_ID=SeqID_39446; Location=45..872; Strand=-
  SCN-specific regions: Sequence locations=1-191,215-828
taattaaatccattcctcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaattttttctctgcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgatttttt

SEQ ID NO: 68010 - DNA, 304 bp, Heterodera glycines; identical to SEQ ID NO: 53844
  Genomic contig location: Contig_ID=SeqID_39448; Location=467..770; Strand=-
  SCN-specific regions: Sequence locations=1-304

SEQ ID NO: 68011 - DNA, 220 bp, Heterodera glycines
  Genomic contig location: Contig_ID=SeqID_39448; Location=847..1066; Strand=-
  SCN-specific regions: Sequence locations=1-220
caaaaaaagagatagccattttctgggatagagtataaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 68012 - DNA, 133 bp, Heterodera glycines
  Genomic contig location: Contig_ID=SeqID_39449; Location=773..905; Strand=-
  SCN-specific regions: Sequence locations=1-81,105-133
aatcatatatcatcattttgacaaaaattgcctaaggacaaaacgccaaaaaaccccactaatttaaaaattttgccgagattttcccttgtaaaaactgaagagccgatctcgagttaaaaagcattttgac

SEQ ID NO: 68013 - DNA, 784 bp, Heterodera glycines
  Genomic contig location: Contig_ID=SeqID_8424; Location=66..849; Strand=-
  SCN-specific regions: Sequence locations=1-129,190-228,253-303,332 -352,385-402,426-599,632-648,672-695,723-784
atgaaaaaaattggagagaagataaaaaagggcggtgaccatacaattaagtatagcgaagaacagaaattacaattggaaattgaggaagatgacgacaatttggtaaaagatgacgattctatgggcgatgacgacgacaacatagatgataatgacggcaatatggatgataacgatgaagatgatttaggcatagatatggatgcaataattagagaattggagatggaagagggaaaggatggagaagacgaaggtttagggctagattatgacgaaggtgactttgagcattctggagatgatgatgtagaggaggaggatgcaccaaaagcaaaggcattcgttgtttttattttaaattttaaacaaatttattaagaaagcgagagcacctccaaaaaccaaaatcaataaaacaacttcaaaggtgaaatatgaaaagcctaaatttttattcattaatttccagatagcggccaagaaaggcaaaaagaaggttttggaaagtgaagacgatgacgaaattgacctagagggttctgatgatgatcctgtagagaaggaagatgaacctaaaccaaaggcattcgttgtttttattttaaattttaaacaaatttattaagaaatcgagagctcctccaaaaaccaaaaccaataaaacaacttcaaaggtgaactatgaaaatcctaaatttttattaattttttccagatagcggctaagaaaggcaaaaagatggtttcggaaagtgaagatgactttcgagaggattga

SEQ ID NO: 68014 - DNA, 727 bp, Heterodera glycines
  Genomic contig location: Contig_ID=SeqID_8424; Location=990..1716; Strand=-
  SCN-specific regions: Sequence locations=1-115,137-195,217-650,672-727
atgctggaaccaccaattgtgtttattgatggcaatgttgacgcaacgaaaagaattgaatttggcagctatttcaagctggatatatcgccgaaattggatgaaaattcggaaattgtttatcgagtgaatgtttattgcgctgacaataaccattttgagttcaaaacgtacaccaagtccttagcaaatgtagtgataaattccaattacaaagtttttacaccaattgggagcgaaaagatgaagcccgacataaaaggacaactatgcaaaaaatacaaaatcaacgtatggcctatatacgagaaatgggtagactacccaaaagaaatgtcaaaagaaaaatcaaaatgggaaaatttagtatcaaaaaaatggggaaatttggtaatgatttttaatttgctttatgaaataactgaaaaacaaaatttagctccggcaaaccgagttcgtagtagacaatggagttgcaattaaaaaagacacaacatataaacaagtcaaatttccaagttacttcaatttaaccattgacccactgttggaccatgaggcagacccaatttattatgtaaaagtaaaatgcagtcgcgaagattcgtctacattcaagacttttacgcacggaaacacgcaaattgtattgaatgagaaaacctgtacaaaatttgacatatcagtgagcaaactggacaaagaagttgaatttttggaggtataa

SEQ ID NO: 68015 - DNA, 1178 bp, Heterodera glycines
  Genomic contig location: Contig_ID=SeqID_8426; Location=177..1354; Strand=-
  SCN-specific regions: Sequence locations=1-250,374-837,860-1178
  Gene Ontology: Mol. function=asparagine synthase (glutamine -hydrolyzing) activity; Biological process=asparagine biosynthesis
gagaccattcgtcgggtccgtctcctctccaccgccgattgccttcgagcggacaaatcgacaatggcaaactcgttggaagttcgtgtgccattcctggacaagcagttcctggcactggcaatgggaattgcaccacaacacaaatgcccgaaaattgagccgggcaaaacggtgcggcccatggaaaaatggattttgcgcaaggcatttgaggacaaagttggcaaaatgcgatttttgaatttcctataaattaaattaaatatttaattttatttttgaatatttgttaaaaatatcgaaaaattaattggataattaagtttattaactatttataaaatgtttcaatttttttattattatttaaggaagacccttttctgcccgatgagatcctttggcgtcagaaggagcaattttcggacggagttggctatggatggattgatgaactgatcggccattgttcggcacagatcagtgacgaagaggtaaaggaggactgattttttgaaccgtcccattttattgctaaattattttggtgttttttaaattagattatttctgaatgaaataaaactttagacataggtaataattagggattcctttttttaggcaaatgcctaaaatttttgcgcacttgatacgctcagataagcacgaaaaaagagttttctgcttaaactatttactaatttcatttacaattggaatataaccaaaattaagttgtttgtttgttttttttacgtgtttttccacctaaaaagggctaataaaaaaaatttctgccattttagtgcctatttgagcatttttaatgcctattttgtgatttggttaatctttgaaaagattacagttattaatctttgaaaagattacagttaaaatgatatattttttatagatggcaaatgcgtcgtccattttcccgcacaacactccaacaacgaaagaggcatttttcatgcgcaaaatcttccaccagcacttcccgagcaaatccgcggcacagacagtgctcaaatgggtgccaaaatggcaaaacaatgaagacccatcgggaagggcaaatgcaatgcacgaacagacaaaaacggaggaacaattggacaacacggaagagggggagaagaagaagaaggggcagaagaacatgaacg

SEQ ID NO: 68016 - DNA, 752 bp, Heterodera glycines
  Genomic contig location: Contig_ID=SeqID_39452; Location=15..766; Strand=+
  SCN-specific regions: Sequence locations=1-97,120-577,599-752
atgcccttttgggtatggtatttagtggaccatcccagtaggggtaaaaacaacatttttactaaaatttttgagagaaagagatgggttaattagcccacaaccaaaatcagtgctttattgttatggtcaatttaatgatagtattcctgtactacaaaaaataggagtgcatgtgcacaaaggacctcctagggacgaattgctgacctctctaaagaaccctctcttattaattctagatgaccttttaacaataattgatgagaaaagcctatctgaattattcattaaaaaagctcatcatcttaatatgggtgtgattttcataacccaaaatttatttgaaaaaaagatgaaggtagcccgaattaattcacaatatattgttttaatgtctgctccgaatgctgcacttcaaatacgtaatttgggcgttcaactgtttcctaaaaatcttacatttttcctaagtgcctataaagatgcaaccgcatcaccgtatggatatttattcttggatttacacccagcttcgagccctttgctgagaatacggacaaaaatatttaaagaagatgaagaaaaagcattgtatattcaaaatgattagtttacctaaaaatgttattcaaaacttggattttttaaagaaattgacaaaaacaaaatcttttaaaaagagacaacaaatatttaaagaggctactagtgagcaaattggattattaattgaaattagttataatata

SEQ ID NO: 68017 - DNA, 570 bp, Heterodera glycines
  Genomic contig location: Contig_ID=SeqID_39452; Location=954..1523; Strand=+
  SCN-specific regions: Sequence locations=1-570
atggagaataaatttattctcgttccctcagacttgtacaaaaatttactaaagccagacgccggggaaattaatgttgataatgctaaaaataaattgtcatcacttttgaagcagcgaaaattggacgctacttcaaaaaatttactttacaaccaggaattgaggcgtttcttgaaactaaggaaggaagttgaagataaaccggtaaaggttgagctttcagatggctcattaatggtgtttaaaccaaaacagcgtgaaagagatagcaaaattcctactcaaattgttaatgacgaaggattggatgaaacaggctctattccaacacttgaagacccttacactactgctgaagagagtgatgctgagtcaacaacatcaacaccaaagacgagaccactgataagaccaatgcgtgtaggaacaactaaatttcgtcaaaagcaaaagtcttttgtagtcaagaaaaaaggaaaaattatgtcaattataaataatgatcctgagaaaattggggttggctctagaggacatatactgagagctgatggacggcatatttaa

SEQ ID NO: 68018 - DNA, 790 bp, Heterodera glycines; identical to SEQ ID NO: 39453
  Genomic contig location: Contig_ID=SeqID_39453; Location=1..790; Strand=+
  SCN-specific regions: Sequence locations=1-490,515-525,549-761,783-790
  Gene Ontology: Mol. function=sodium/potassium-exchanging ATPase activity; Cellular component=sodium/potassium-exchanging ATPase complex; Biological process=neurotransmitter uptake

SEQ ID NO: 68019 - DNA, 787 bp, Heterodera glycines
  misc_feature (66)..(66): n is a, c, g, or t
  Genomic contig location: Contig_ID=SeqID_39454; Location=29..815; Strand=-
  SCN-specific regions: Sequence locations=1-185,207-249,271-450,472 -565,632-787
atgtctgccgttgatgggcacacaaagtgccaaactcctactgtttttgggtcagtttgtccgccncaaagtttgccatatttttctcctctaatttatttgcaaatagaaattggttcttttttttacaattttgatcagtcattgatcagaggaatttagcaccgtccatttctttgtacattacattcccccacccgaaatcatttttaggaattatatgaagaattaattactaagtttttcttgaaattttcttagagaaatttccttttctaataattttttttgaaacatttttgtgcctctcttatcaaatgagtggtggaaaatggcacaacatatttttcaaaaaattgttttttttcagcggcactcagttggactcggccacccgtcggctggaccagatgattgaccaggcccggtaccggcacagtcagcaccggaacaagttcaaggaggccatcgactacttggaccacatctttgaggacttccagcgtgaagcggccgactcggcggcacggccgacaacaaacggcggtggcggcaaaaaggaaaaagcagcagcggcggcgacgacgacgacatcggcacaacagaaacaccaacagcaactgcaacaacatgctcaagcagtgcaggatcactcaccggccggtggtgccgtcgtcattgagccggtccaagcgacgtttcgccagggcagcgtcaagtcggccaaggaggcgtttgagaaggtggctgctgccatcgcgtccgacaagcagaacagccgagtgag

SEQ ID NO: 68020 - DNA, 634 bp, Heterodera glycines
  Genomic contig location: Contig_ID=SeqID_39456; Location=144..777; Strand=-
  SCN-specific regions: Sequence locations=1-358,423-476,499-634
atgccggtgacgagaatgataagagatgccgaggttggaggggataagatgatcagagaagctggccagagggtcggcgagaatgctctcggaatgtggaagatgacgaggtgattaagagggaggggggagagtatgatcaaaagcttctacaacagagaatcttaaccgattcttttatcaaataagatttaagaaaattctaaaaaatttctacaaatttcattaaaaattcaaaaattttcttcggctgtgtgataaaaagctaattttctcaaatgtgctaatcgaacgacatacatttaaacaaacaactcaaatttcaaaatttatgcaaaaagtggtcagtcgctggcggtaaaaatcataaaaaatataataatttttccagtaaaacttttttttaaaataatttatttaaacccctaaaattttggcggtctgttaaaaaaaaggatcgtcgacaaaaagttttgaaaaatgaattaattaagaaaattacatagaagtggacccaacacccaaaaaaaattgttgcaaaattatgaccgaactcttaaggaatcgaacccgcaagacaatcaaaatgatgaaaagttttgggttaaaaaaatacgatttttttgcaaataaa

SEQ ID NO: 68021 - DNA, 259 bp, Heterodera glycines
  Genomic contig location: Contig_ID=SeqID_39457; Location=245..503; Strand=+
  SCN-specific regions: Sequence locations=1-23,51-125,147-173,195-259
atgtccacagcaccgaacgacagcatagaggaggaagaggaggacggctcggacagtgccgccgccaccaccgcaacaccggcgagtgttggctcgtcatcgttgtcgtcgccgacagccggcggcgccgccgccggtgtctcctccaatttgttcgccagcagcagcataaccacggcggcagcggcggtggccaacagtgagagcaatgacggtggtggtgttgcatcatcggaggagcataacaataacaacaacg

SEQ ID NO: 68022 - DNA, 129 bp, Heterodera glycines
  Genomic contig location: Contig_ID=SeqID_39459; Location=70..198; Strand=+
  SCN-specific regions: Sequence locations=1-129
atggcacttttcttcaccggataccctgctgatgttgctggtgctgttagttcatcaggcaacagacgaaatgttaaatacattgattatgggccgcttattcgacaatcccggaaaaaccaaaaccgt

SEQ ID NO: 68023 - DNA, 199 bp, Heterodera glycines
  Genomic contig location: Contig_ID=SeqID_39460; Location=395..593; Strand=+
  SCN-specific regions: Sequence locations=1-199
aacgggcgcgaagctcccgtctgaggccgcgaagcggccttaatagcccaacaaatttataaacgggcgcgaagcgcccgtctgaggtctcgaagctgcgttaatagcccaacaaatttagaaacgggcgcgaagcgcccgtataagcccaacaaaattaaaaaaacgggcgcgaagcgcccgttcgaggccgcgaagc

SEQ ID NO: 68024 - DNA, 232 bp, Heterodera glycines
  Genomic contig location: Contig_ID=SeqID_8427; Location=4542..4773; Strand=+
  SCN-specific regions: Sequence locations=22-232
atgaaaactttatttctattttctctgttatttttctcttcatatgaaaacccaattcgcaaacaacgagctgttcgcaatgaacgggcaatagctgggttagcacaattggcagcatcacttgcggccgtgaaagcatttattgccgcaaatgcagctttaacggcttctacagccgtagctttggcagcacttggaaccgatatctaccttgctattgagctcgtgagat

SEQ ID NO: 68025 - DNA, 451 bp, Heterodera glycines
  Genomic contig location: Contig_ID=SeqID_8427; Location=4031..4481; Strand=+
  SCN-specific regions: Sequence locations=1-291,313-317,339-343,365 -369,391-451
tatcagtacgcatttcatagccttcaaaaacagtcatcgttttgcttttcgttgtcctcttatcgggttctaatcggtctgaaaattgatttcgattttttgtttgcttaaactacaaaacttgccttgttgtggttgaacatgacataattgaagcaaaattaaaaaaaaactttgaaatacattctataatatttataagtgggttggtaaaaaatattcaaataaaatcgtaaaaattctacataaaaacggtgtttttcttttcatttcccgctattttcctctttttgccagccgtccgcctctcttgttattgccagccgtccgcctctcttgttattgccagccgtccgcctctcttgttattgccagccgtccgcctctcttgttattgccagccgcccatttctcttgttattgccgtccgcccatttctcttgttattgcc

SEQ ID NO: 68026 - DNA, 1356 bp, Heterodera glycines
  Genomic contig location: Contig_ID=SeqID_8427; Location=548..1903; Strand=+
  SCN-specific regions: Sequence locations=1-52,74-228,259-295,317 -560,583-907,930-1017,1052-1116,1138-1280,1326-1356
  Gene Ontology: Mol. function=peroxidase activity; Cellular component =integral to plasma membrane; Biological process=anti-apoptosis
agtttgagcgatcggctgcaatttgtggctctggcgaaacgtcgccaatctttaagtgattcttttttccatattaaagctgataatttccatatttcaggcaagtgactttccgtgagcaggtaaaactgctaacctagactgatcgaagtcattttgaattcaattaaaaagttaaactgatcgcattaaaattcaaaattttagtatgaaaatcaatgtgtgcacaaaattaaaataaataaaatatatttaatagcaccttaaaataaccttttaaaaaaatttacttttcaaatatttgatttatttgtcaatcggcttatttgttaaggcaaacatcatcacaagttatttggatggttcacaaatttatggaagcactgaagtggacgctttggacttgcgagacttatttaggtcgtaaatttacattttttcaatgaaaaatgatttttatttaatttattcattttagtgatcatggcttactccgctttgacattgtcagcagtgcgcagaagccatatttgccatttgaaagggtaaaattcttccggcaaagtttccccgaaaaattttgcattttatgcaggactcagcaatggactgtcgtcgaaatttctccgttgaaaacccaatacggtgctttttgtcgggtgattttcgtgccaatgaacaggcgagaaaaaaacattcataatttaataaaacataatatttttggcatgtttttttggattctttgctttataatgttcattagaatccggaaatttcaattttgaatagagtagagcgggaccgggacctgttacggaaaaaacgggacaacttgtacctaagttccggttttgaccgggactagtccaggttttttcctgggtttcccagccagaaattttcgattttgtcccggttttgcccaaaattcccggtcccgctctactctaattttgagggatgaaaaattctttaaaaaaaaaactaaatgcctttagtctattatagttatttttgtcagaatgaattaaataataaaaaatctgaatcctttgaaagcggatccagtggattcccgcacagaaattaaaattttttcacatacgtacttcttcttataatttttgcaaattttcacaaatttgtaaattttgttagctcggtctgacagcgatgcacacgatttggttgcgtgaacacaatcgaattgcgacaaaattattggagcttaatccggactgggatggagaaaggatttatcaggaagtaagtaaaacaattaaaaaaaaacaaattaagatttttaaattttatttattaaaggctcgcaaaattgtgggcgcaatgttacag

SEQ ID NO: 68027 - DNA, 367 bp, Heterodera glycines
  Genomic contig location: Contig_ID=SeqID_39462; Location=374..740; Strand=-
  SCN-specific regions: Sequence locations=1-191,219-367
atgttgctaacaaaaaagacggaaaagcctgaaaaggtgtgggatcagcagtgcaatctcgagaaaagttcggccctgtccattggcatcgatgaccacaactcgcggttggtttgattattttacaatcaaatttttaaacattcttttgagattttttagcaaaaaattcattttgatttttttgtgagaaaaaaatatttaattttaaattaaaagtaaattctgtaagaattgcattcaaaaaattcccaataatgccgttttactttttttttagtcgtgccgaacgtgtgctctatattgtttccgtgttgacccttctttttgtgcttactgaattggtcggcggatatttggcgcacag

SEQ ID NO: 68028 - DNA, 71 bp, Heterodera glycines
  Genomic contig location: Contig_ID=SeqID_39463; Location=55..125; Strand=+
  SCN-specific regions: Sequence locations=1-71
acacttttattttgcttctgtgctattccgatcattgttggagaaatgtgcacacaaagaacgcatcacat

SEQ ID NO: 68029 - DNA, 65 bp, Heterodera glycines; identical to SEQ ID NO: 56492
  Genomic contig location: Contig_ID=SeqID_39464; Location=301..365; Strand=+
  SCN-specific regions: Sequence locations=1-65

SEQ ID NO: 68030 - DNA, 59 bp, Heterodera glycines; identical to SEQ ID NO: 52421
  Genomic contig location: Contig_ID=SeqID_39464; Location=89..147; Strand=+
  SCN-specific regions: Sequence locations=1-59

SEQ ID NO: 68031 - DNA, 59 bp, Heterodera glycines; identical to SEQ ID NO: 52421
  Genomic contig location: Contig_ID=SeqID_39464; Location=479..537; Strand=+
  SCN-specific regions: Sequence locations=1-59

SEQ ID NO: 68032 - DNA, 59 bp, Heterodera glycines; identical to SEQ ID NO: 52421
  Genomic contig location: Contig_ID=SeqID_39464; Location=609..667; Strand=+
  SCN-specific regions: Sequence locations=1-59

SEQ ID NO: 68033 - DNA, 59 bp, Heterodera glycines; identical to SEQ ID NO: 61858
  Genomic contig location: Contig_ID=SeqID_39464; Location=739..797; Strand=+
  SCN-specific regions: Sequence locations=1-59

SEQ ID NO: 68034 - DNA, 59 bp, Heterodera glycines; identical to SEQ ID NO: 52422
  Genomic contig location: Contig_ID=SeqID_39464; Location=869..927; Strand=+
  SCN-specific regions: Sequence locations=1-59

SEQ ID NO: 68035 - DNA, 564 bp, Heterodera glycines
  Genomic contig location: Contig_ID=SeqID_39465; Location=148..711; Strand=+
  SCN-specific regions: Sequence locations=1-17,39-564
atgaacttccgtggtgcaacggaagcatatgccattgttcattcactgccatttgccaaactttcacatcaggttgtcaaacttaacatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctcttt

SEQ ID NO: 68036 - DNA, 154 bp, Heterodera glycines
  Genomic contig location: Contig_ID=SeqID_39467; Location=77..230; Strand=-
  SCN-specific regions: Sequence locations=1-154
tgattgcacgtaattgccgaaaaaattcgagaccaatttccgaatgttgaccgactaattgcaagacgaaagccgtctttgtcaaagcgccttaccgagtcaaaaaatttggaaatgtatctcatatgcaatttcaaccaataaatttgaagaa

SEQ ID NO: 68037 - DNA, 568 bp, Heterodera glycines
  misc_feature (16)..(16): n is a, c, g, or t
  Genomic contig location: Contig_ID=SeqID_39468; Location=57..624; Strand=+
  SCN-specific regions: Sequence locations=1-231,262-568
atgaaagaaatgctancatggtcagtagctgatggtataaacccgctggagaaatttattgattggatattagaatttaaattttctaatactgttgcttttggtcattacgcaggttttgatagtaacatggattttcttaattaagattatttaggaagatatgattcacatttcgtgcttaacgaattaacaagaagagggtataagccgaaaattatgataactgacttaaaaatttatcaaataaaattaaataaactcgtttttcgtgatttctggctacttagccaaaacagactaagtgttttaccaaaaacattaggacttaatacgcctgcaaaactttttttcccacataaatacaataagccagaaaatttcggtaaggaagaggattaatattgaatgcaaaaatttttagggtgcaaattaaaccacttgccatgtattgacgactatggtcctaacaatatgaaagaggatgagtatgaccatttcatgaaatggtatgaacataatagagatactaaatttgagctcggtaaaagaaactaaaaagtattga

SEQ ID NO: 68038 - DNA, 340 bp, Heterodera glycines
  Genomic contig location: Contig_ID=SeqID_39470; Location=801..1140; Strand=+
  SCN-specific regions: Sequence locations=1-223,247-340
atgaaagtacttgcttatatgatttttgcattgaattttgcaattagtttgcaaatgattccttcaacgcgtcgttcaaagccgggctctttattacatagcgaacaatctgcttttgtgaaatacaaacaaagttctattaataaaggtaaaaaaggcttttttcatgaattatattaatttttagtttcttgttaagcagctaatgtgtttaatccaaatttagtaaaatttatcaatttttgtaccttttgacatgttttggcattttgtccatcataattaaaccatttaatctaaattgattcaatatataaatactctctaatcttcctttgaa

SEQ ID NO: 68039 - DNA, 450 bp, Heterodera glycines
  misc_feature (370)..(370): n is a, c, g, or t
  misc_feature (394)..(394): n is a, c, g, or t
  misc_feature (414)..(414): n is a, c, g, or t
  misc_feature (427)..(427): n is a, c, g, or t
  Genomic contig location: Contig_ID=SeqID_39471; Location=260..709; Strand=+
  SCN-specific regions: Sequence locations=1-106,141-450
agacttgatgatccaacgtactcatttcataaatatattgaaataaaaaagaaaaaaattgtcgagaacatcaaacagaagaaagaggtcggtcataaaaatttggaaataaattataaaaaaattaatttttaaatttagacatttgcattgcacaaacgccgcccaataccgttagaaggacgtatcgtaatcgtagtggatgacggtatagcgaccgggctctcggcggaagcggcacttgtacaactgcgagacaaaaaagctgctgttgtgatgttggcatcaccggtctgcccactgagtactgtcggtaagaatcttgtgacaattttgcgctacagtaaattcaaataccgtatttccttanatcgagcccatacgtatctagaanagtctcaagaaaaagagtanatttcttttttanaaggctggcgggatacaaaaaag

SEQ ID NO: 68040 - DNA, 445 bp, Heterodera glycines
  Genomic contig location: Contig_ID=SeqID_39475; Location=67..511; Strand=+
  SCN-specific regions: Sequence locations=1-83,105-107,131-380,402-445
atgagcagttctgagctgaaggaggtcatccgtttcgcgttccttctgcgctaccagcaagtcgtccaaactcagatcagtgttcttcagcagtgagtccatggcagaacaaaacatttgcaattccaatgttttcattgccttaaggtcgtcttcggtggccaacgagggaagcgaaaatgaagcggagaaaatccaaatcaaattgtcgcacaacgacatcatccgagcgttccacgacttgaagaatgtatcgatggcgccattttccgagtcagtggtgacggaagaagtcgtcgatgtggattgatgcgttgacaatgagttctgctgataatgtgatcatatgcgttacaatataatcgcctcctcccaattcgtttaatgtatgtataaagtatgatatgatatgtagtacacaacccattgttcttttgtgttttga

SEQ ID NO: 68041 - DNA, 828 bp, Heterodera glycines
  Genomic contig location: Contig_ID=SeqID_39476; Location=515..1342; Strand=+
  SCN-specific regions: Sequence locations=1-192,215-356,378-828
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgatttttt

SEQ ID NO: 68042 - DNA, 129 bp, Heterodera glycines
  misc_feature (129)..(129): n is a, c, g, or t
  Genomic contig location: Contig_ID=SeqID_39479; Location=71..199; Strand=-
  SCN-specific regions: Sequence locations=1-129
atgaccaattcaaacactgaatacactccgatggcgcaattaaacgacgaccgattcgaacaccgaataattttccaaagcaaaagcagcaaatggcttggactgttcatgaaatgcattttaatgatn

SEQ ID NO: 68043 - DNA, 248 bp, Heterodera glycines
  Genomic contig location: Contig_ID=SeqID_39479; Location=932..1179; Strand=+
  SCN-specific regions: Sequence locations=1-18,40-85,113-154,179-248
atggattctgtgacgattgaaaaatgggcaaagaaaattggcagcaaagaaaatacttcaaaaagtaaacttttaaagactttggttttattatttaatttaaatatttttagggcggaatcattatacaattgctgaaaaaatggaaacattgaaaaaaataatttaaaaaaaaaatcccaccctcactgactgtgaaatgtcaaaaatattggatattccacgaagttctttacaccatatcaaaa

SEQ ID NO: 68044 - DNA, 49 bp, Heterodera glycines; identical to SEQ ID NO: 51181
  Genomic contig location: Contig_ID=SeqID_39480; Location=380..428; Strand=-
  SCN-specific regions: Sequence locations=1-49

SEQ ID NO: 68045 - DNA, 1133 bp, Heterodera glycines
  Genomic contig location: Contig_ID=SeqID_39481; Location=458..1590; Strand=+
  SCN-specific regions: Sequence locations=1-192,215-824,846-977,1004 -1085,1128-1133
taattaaatccattccttcgggggaccgtgccgggtgccgcggggtaagcagtgctggttcgtttcatcacggcaccgaaccttttggctagtcagcaatcgttgcttaacttgccagatcggacgggtgtgcatgattccactgttccaagcaccccaccaaaagcaaaacgatataaccaaaatataaggaaaaatttttaaaaaattttttctccatcttcctttttgatactaaagcatcagagtgctaaaattaacttgtaaataaaatttggtgcgctttagagcactttctgaaaaaatatttatgaaataaaaaaatcgatttattcaagtgtccgtttggggtactcaaacaattatggggagggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaagctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattatgcaaaaaataaagaaataatgaa

SEQ ID NO: 68046 - DNA, 488 bp, Heterodera glycines
  Genomic contig location: Contig_ID=SeqID_8431; Location=390..877; Strand=-
  SCN-specific regions: Sequence locations=1-290,313-488
atggcacgaaattccgagttccgacatttttggggtcggaattccgatttccgacttccgaaaaatttttgggtctcggaattccgatttccgaaatttttgataaaaagtcggaaatttggggtcggaattccgatttccaaaaggcctcggaatgccacccctgatacgtaccttgggattactgttctctctaaaggcgattgacaaccttgaacaattaccgtatatgctctaattatcacccccaccccctaaagatattttggatttcgtctgtatacttctagcactatgggtacgccccaggtgtcgtcataacgccaaatagcgtaattggcagtaattttttgagcgctaattcaaaatttacactggaaaatgcctatttttgtattttttttttttattttgatcagccataactcgcttggaccacttattaaaaccaaaatgctaaaacatttcatttttctattggtaataaa

SEQ ID NO: 68047 - DNA, 945 bp, Heterodera glycines
  Genomic contig location: Contig_ID=SeqID_8431; Location=1383..2327; Strand=-
  SCN-specific regions: Sequence locations=1-158,181-344,366-478,507 -715,738-945
atgaatgacgaacaaattgcgcaactgtttgaggttgatgattggtcatttaagaattggaaaaagataagcggaattactgaaacaccaaccgttggagagaaaggtggcacaaaaatgggcaatttagtgaatattatgtgcctaagggcctttacaaataaattttttattttatttcacccccaaaacggcaaaaaaatttctacaatttctgctttttcgcccctgcgctgaaatttttttgaaataatatggagaagaaaataatctggcccgaagagcaaaaaaataaaaaaaggctgccctccccgaatttttttttcttctggatacgggcctgaaataatgtcattaaattttaatctcttgaatgcgcctttcggcaccgcaggatgcatattaattcaaatttgtgaaaaccaaatacagaccaaatctaacaaatacataccaaatttaaaccagtcaatcaacaaagtttaaaataaatacaaatttattcaatttcctttcaccacattttttgagcagtttctgaagagattagcaacatcattgaacctctctcacttgtcaatttggaagacagatcttctccgatagatacttttgaacagttcgattttggggctgtccatgggaaggcttccgctgctgttaatcaccagattaacctatcaagtataattcctaaaaatgaattcgaaaatgagtataaatatattcaatatttttagtttcaattgcatgattttgaattaagacgtgggattgaatttctcaaaacatattaaattcattttcccacggtgataactagggatgcgatttttaggcacaaaaaatcgcgaaataggcacctaaaaaggcagaaaaaaatcgcaaaataggcactaaataggcacaaaaaagcccgaataggcacaaaaataggcaaataaa

SEQ ID NO: 68048 - DNA, 811 bp, Heterodera glycines
  Genomic contig location: Contig_ID=SeqID_8432; Location=866..1676; Strand=+
  SCN-specific regions: Sequence locations=1-36,107-205,319-448,470-811
atgaaaataaatgaattggttaagtaattctcaatgtaaaataagattatataaattacataacttttagtttttaaagagattaaatttataaatatttttattagaaacaataataaagtcaattctacaattaagtaaaaatgctcaaattaaaaaaaatgctgcaataataaattataatgtagcttaaagaagacatgtgtattaaaataaataaaaaaataaaatgttattaaaaatttattccatagaattagttcaattaattattttatattttaaaataaatctttggttttataaattttttaataacatatcttttttgttgtgaatgagtcgttgaccattggatcaaattgtctacgactcggcccacaacaaaaaggaacttttagtttttttctatgaactgagcactcacgcgctattcataatgctaacgatctgcagataaatttctagcgcagataagttccatattcataatgctaaggattaaaatccgtattcataatgttgctctcttcacaaaaaaatccgtatcttcagctgcagatacccttggtattcataatgctaaggatagggtagcggctgcctagctgcagctaaaattccctatcctcatcgaggtgaggatagttgcgatggaaatgtcaattaaaatcacaaaaaattataaattgaaaaattgtactaaataatacctctaaaaatttgttggtttaaattttatgatgattgaacaaaaattcaaagttcgaaattttcgacctttatagttcggggttaggggttggtttaa

SEQ ID NO: 68049 - DNA, 530 bp, Heterodera glycines
  Genomic contig location: Contig_ID=SeqID_39482; Location=809..1338; Strand=+
  SCN-specific regions: Sequence locations=1-122,144-193,255-276,305 -371,393-530
atgatgcctcagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaaccatgtgctcccccctttggtcccgaaccccaaaatcacttttatttttgtatctttttttaaaaatgtgataaaaatgtaaaataaaatttatattatagagaaaaaaattgtggatttttgtagtattttacttttctcaaatttcttttcagaaggcagttacgaatttttttctgaaaaatctaaaatttccagaatttctggaataacatttttcatattgatgttagaaaacctaaataaatcccataaaattctcctgatttttctctatttttaaagctttgttgtatgaaaattgacttaccctgaggttagttatgaattttcaaatattaggccaaaatcccgagggccaaaaaattgccaaaaa

SEQ ID NO: 68050 - DNA, 778 bp, Heterodera glycines
  Genomic contig location: Contig_ID=SeqID_39484; Location=263..1040; Strand=+
  SCN-specific regions: Sequence locations=1-19,65-152,194-506,728-778
atgagaacactaatggacaattactatcttttattaatattattatttttattaattatttttaatgatgggcaaccatcaaaaaaacgtccaccaaagggtaaaagcataataactgataaccaaaaattggaggccgaaaatataaagagtattttttttatttcatttttcaattttttaaaaattaattgctcagatgacgctcatagatggtcaaatcggagtgaaaacacgaaaataatccgtgccatgtttccaaatgtgccaaatgaagcaaaaaagttggatatggaaggcgactttattcgaattgacggcaaagtttatcccgctaaaggtattttattaatttgtcgagataatgccaatgaatgattgacagacatgaggaggtcgaaaaatgccgaaaattaagaaacttaaaacattttttagaaaatttggtcatggaaagtttgtatcacgattttaaggaaattttcactgaaaacttgagtcatttgaaaatttataacaaaaatattttgaaatttaatagaatttttttttattaatgctttgttattgacttaaaaataatttttgaaattgttttttttaatttagtcatcaatttattttcacattgaatttttgagttttataaaataattaactttataatctggcatattaattaataatccaaattttaattaaaaaatatattatatgtatataaaatgttttagattttttggaatcatttaatgagaatggcaaagacagaactgaa

SEQ ID NO: 68051 - DNA, 753 bp, Heterodera glycines
  Genomic contig location: Contig_ID=SeqID_39485; Location=105..857; Strand=+
  SCN-specific regions: Sequence locations=1-136,175-314,337-339,362-753
atggatgagttgaacttccattatgctgattctgactgctacaggtccgaactggcggagctgtacacttattcggaaatggacgaattttcactgaattacgagtgttttatacgatatatgcgcgagaaaaaggttatatattctttaatttaaatattattattaatttaacgacagaaagaacccatttggcatgacttgccgaccaaggaaaagagcgaaactctgcagaaccttgtcgaatctttcgaaaattctgattctgaacaaagactggaagctgctcggatagttctttatattttacaggcaattatttatttacatgcacaattttaattatcatttccaactagaaaatttgttgttttcgctttttagggtgcatatggcgatttcgctgacgttgaagttaaagattttgaccgctggtctaccgaaggtataaagttactaaagaaccccatatggaagcgaaataaaataacggaaccttcctgttctccttttgcaaagctcacttccattttcagaattcaccactgaaacttacagtgttttcatttgatttgcaatgaaaacaaccctaaatttcaagtttcagcgaccacagaggaggaaaatggtggaaaaggtctcgacgcagcgtccaaatggtttggtgatcacgggacgggcggattcgagcaggactgtttggtccgtggtgcactgaatgcttaccacgtgtacgagcacgggctgttccaa

SEQ ID NO: 68052 - DNA, 518 bp, Heterodera glycines
  Genomic contig location: Contig_ID=SeqID_39487; Location=395..912; Strand=-
  SCN-specific regions: Sequence locations=1-226,249-258,281-518
gtctcaaacatttggaaaagtcatttagagaactcatgaaattcaccaattccgtcaatgaatcggctgcaaagttcgaaaaaggaaacaattcaaaagcaaaaaactctgctgggttgtatgacgacgaaaaaggtaaaattgaatttaaagaaaaggaaaaatgaatgaaataatattttatagacaaattaacggtttttaaaaatatgcgtgaaagcctagaaaagttcgcttaattattaaaatttccaaagattgtcctgaatatcccactggtcggcatttgtctaatgaatgattaatcactattaatttagaattaatcaaaataacaaaagccctggtcaaccaaaactggcaattgggaagaagccgaagcacgagcataattggacgatttgccacgggaaattgtaggacaaatgctcatttatgtataatcaattggaccaaaagtgggcacagacaataacctattttggcgttttgccaatttatttaaaaaatgcaataaa

SEQ ID NO: 68053 - DNA, 360 bp, Heterodera glycines
  Genomic contig location: Contig_ID=SeqID_39488; Location=174..533; Strand=+
  SCN-specific regions: Sequence locations=1-360
atgcggaataaaaaagacgtgaaccgattaattgagccaatccgttcgataaaattcagtgaaaaggtattattaattacaaataattattttgccaaattatacacgtattgtgtaaaataattgtttaagtatgaaaatttcattgtgatcatttgcaccggcacacaattcaatgccgaaacattttgccaatttgtcgggacgcgacttcgctacgaactgctcgaatttgtggagaatccgttgtcaaattgggtggacttttgccatgtgtatccaaaattgatcacttccgcgcaatgtttggccgaaacggggccaaaaaagtgggcagataaaggaattaaaattaattaa

SEQ ID NO: 68054 - DNA, 195 bp, Heterodera glycines
  Genomic contig location: Contig_ID=SeqID_8433; Location=37..231; Strand=-
  SCN-specific regions: Sequence locations=1-47,69-115,142-195
atgttttcattaattttcttttttatttttgctacaatttctcacttaaatggaaatgatgatgaactttgggacataaatttaagctgcaaaccttttattaaggttttcatctccgaatttctcttttatttttaaattcagagtttagcagccaagtactcggatttggttagatgtgctgtggaaaacaat

SEQ ID NO: 68055 - DNA, 669 bp, Heterodera glycines
  Genomic contig location: Contig_ID=SeqID_8434; Location=86..754; Strand=-
  SCN-specific regions: Sequence locations=1-185,212-436,459-551,574 -624,647-669
atgaagagtgatctactgatcaagttactgtacggctttttgatcttaataagttatggtatgtaggatgcttttttcagaattattgactcacaaaaatattgaaaaatgtctaatttaagataaatgtcattgaataagaaagagggaaaaaatgctacaatgctgataaagaaacataattttttgattggttttaaaaatgttttatcatgactgtacaaaaaaaaggaaggcaatcactgattttctaagggtttttgaaagcaattaaggtgttcttaaaaaattactcaaaaaaattaataatttagaacgcctggtatctttttttgaatgcatcctgttgtgactgagcctacatctcagtcacaacacatccatccaattgctttgcatttaaaaatttttcctcttcatgagctttcgaatgatccaagattaacattttggtttgcaaaaatttaaaactttttttttgaaaaaaaacttttttaatgctccctttttacgccaacgatacataaagatttttcgttttttcacctcacattaattttttttaaattatttcctgtgacttttgtgcttccaatcaattttaaacatatcgcagaaacatgtgggcaattgtgcagatcattggtcccacaaaaaaaaaggaataaa

SEQ ID NO: 68056 - DNA, 1680 bp, Heterodera glycines
  misc_feature (1019)..(1019): n is a, c, g, or t
  Genomic contig location: Contig_ID=SeqID_8434; Location=1982..3661; Strand=+
  SCN-specific regions: Sequence locations=1-244,267-280,302-763,786 -1680
  Gene Ontology: Mol. function=glycine transporter activity; Cellular component=plasma membrane; Biological process=alanine transport
caattgggaacatcacaaatctgagaaagcaccacagcaggaagtggaggaccagcagcaagagcccgttgaacagaagcacaaaattgatgacaaaaaagtggagacgcacgggggcattgagcgcaaggaaggactgtcgtgagtggcgccggtttcggtggtgtccaacaatttctcgacacttttctagtttagtggctccgatgcaaacccatgagggtggaggaccctctgatttcaaatttgttcagttatatttaattaagcataaaccaaagggtccctccccttttgggttttctgaaaaaaacgtcccactaaattagaaaagtgccaatttctcttttcatgcgtaatcttcagctacttcgccgttctggtcaacttcctcaaatccatcattggcgccggtgtcctttcacttccgatggcattcaaagatgccggcatttgggtgtgttcagcaattttcgccatcctttctaatgattcgttcatctttagggtgcgttggttctgctcaacgtcgccgccatcctcaattgttactgtatgatgcaactcgtggagaccactcagttccattacaaacggtgcgtttcgccataatgagaaatttttttaccttttgcgtctcccttcagcctcaacgtcacttacctcagctacggcaacttggcgaaagaagcgtgcaagtacagctttccgtggatgcgaaagtttaaacttatggccaagtcagtcccatccattcgaatccgaattcacaatttgttttatggccatctcttttttcaggagacttgtcaatgggtccgttcttttgctcgagtttggcttctgcagcacttactatctgttaatctccacaaacttgagagaggtgttcaacttcttgacggtttcggacacatcaatcaaagtttggcttgtgctcatttacgtccctatggtcttcatggtaacttttgcctcattttgtatttgagactgaaatgacacaaaaattaagactntcatccgttccatgcgcattttgtccttcttcagtttggctgggaatgtgctgatgttcatgagtttgttctacatactctatgtgcgtttattcaatttttggaatgcaaatttggtgtaatttttgcctcatcttcaggcattggcctaccgactgctcagtgaggaggaaaagccagaaattcacgcaatcggcagcttttccgggatgttactcgcttcgagcacaatgattttttcctacgaagctcaaactttggtgtgtcgtccattgtttttactgaccatttcgcttttcgtcaggtccttccgctggagaagaaattgaagaaacctcagcaaatgttgggtttgtctggcattctgtctgtcggcatttccatctccacgcttatttacgccagtttgggctttctcggatactacgcctacggttcttgcgtaaagggcgctatcactcagaatttgggagaaactaggtgagtgagtggcaaagaatggctgacaactgtttgagtacgttcggctgttcatctcctttccttgcctttcagaatgagtgccgtggtcaaattggctctctctgtgtccatttgctcttccttccttctgcaaatgtacgtcatcgtcgatggtacggtattccaattggtagaaatg

SEQ ID NO: 68057 - DNA, 56 bp, Heterodera glycines; identical to SEQ ID NO: 62810
  Genomic contig location: Contig_ID=SeqID_39499; Location=357..412; Strand=+
  SCN-specific regions: Sequence locations=1-56

SEQ ID NO: 68058 - DNA, 887 bp, Heterodera glycines
  Genomic contig location: Contig_ID=SeqID_8435; Location=1602..2488; Strand=-
  SCN-specific regions: Sequence locations=1-146,170-185,251-280,306 -636,702-802,824-887
atgggacggagaattcgattgggacattttgtgatcatgtttttgacaaaaaatcaaataattggggattccctaatttcgtttcgtttgcggtaagtgccaattcaaacaaatattttaatttgacattcgtggaccagccaatattgaagttcatttatttatttgtctgatgtaaagaaatcaaaaaaaaaaataaattataattatgaatgtaatttttaggtttttatcttttttaaaaatatatccctaagaaatgaaaatttctcgaaattcatttcttaaatttatttatttactttcttgacaagaattttgatttaaaaaaattatgattttctaatttatgatttggcctaattttgttgctttttaaaaaaaatttcgattttacacccccctaaatttgaaagtttttagcaaaatttttagcacctattttggggggtttttagaacctaaaaactacatttttggcagtttttagcacctaaaatcattttccttttgtgcgatgctccaaaagaaggtccaaattaaatgctaataaaaaaaagtaattaattgccattaagaccaaaattggagatggaggacagaataaacaatttataattttttgttgatgattgaaactaacctaatttttattcactttattatttcaaaaaatagaaattttaagtaaaattatatttgagattgttttagaaaaaagaatatgtgcatttgcattttttgcacattgtcattttgggcgagtgtcggcatttatccgtcgttacaccaaaaagcccacaataaagaaactgtaacaaaaattgtctttatccatctctttctttgtaactaaattctacaacgattttttatgctttaataaa

SEQ ID NO: 68059 - DNA, 776 bp, Heterodera glycines
  Genomic contig location: Contig_ID=SeqID_8435; Location=2622..3397; Strand=-
  SCN-specific regions: Sequence locations=1-117,183-346,404-776
atgccgacactttgctcaaatcggaggaatttttacaaattgaccaaaaaacattgtgcgaaattttgtcgcgtgacgaattgcaaatcaatggagaaatttcaatttggaacgctgtaattattttacaaataaattaaaactctaaattttattattaatttatttattttttaaattaaccattatttcctatttatttttcggcactccgttgggccgatgcaaaatgccatcaaaatggaattgaatgctcggcaaagaatcgtcgtgccgttctcggcccagcactgttcaaaattcgctttccgcttttctcaattgaagaattttcgaacaaaattggtaaaataactaatatcaaattattaattaaaattttttcaataattttaatttttatccatttattttagttaaaggggggggggtgacaaaaaggataagaaccaatatttacagttcccttcggtgttttgtcaaaagatgaagtgatcgccgtttaccagttcaaatcccttccaaattgtcatgggatttccgacggatttttcccaatgccatttccgactaatggacggatttccgatcggaaaaaaggcacacttttaattgacattgaaaaagtgtcggaatttgcactagagaaagttggaagcagtcggtacagcaaaaaagtgtacataaatggacttccatggagaataatggcgaaaataaaaacgaaaattggaagcactgacaataatgagaaatggttgggcattttcatttga

SEQ ID NO: 68060 - DNA, 1472 bp, Heterodera glycines
  misc_feature (148)..(148): n is a, c, g, or t
  misc_feature (1009)..(1009): n is a, c, g, or t
  misc_feature (1011)..(1011): n is a, c, g, or t
  misc_feature (1013)..(1016): n is a, c, g, or t
  misc_feature (1029)..(1029): n is a, c, g, or t
  misc_feature (1031)..(1031): n is a, c, g, or t
  misc_feature (1033)..(1033): n is a, c, g, or t
  misc_feature (1051)..(1051): n is a, c, g, or t
  misc_feature (1057)..(1057): n is a, c, g, or t
  misc_feature (1060)..(1062): n is a, c, g, or t
  misc_feature (1066)..(1066): n is a, c, g, or t
  misc_feature (1073)..(1074): n is a, c, g, or t
  misc_feature (1077)..(1078): n is a, c, g, or t
  misc_feature (1086)..(1088): n is a, c, g, or t
  misc_feature (1099)..(1099): n is a, c, g, or t
  misc_feature (1101)..(1103): n is a, c, g, or t
  misc_feature (1111)..(1111): n is a, c, g, or t
  misc_feature (1116)..(1117): n is a, c, g, or t
  misc_feature (1120)..(1120): n is a, c, g, or t
  misc_feature (1128)..(1129): n is a, c, g, or t
  misc_feature (1147)..(1149): n is a, c, g, or t
  misc_feature (1159)..(1159): n is a, c, g, or t
  misc_feature (1162)..(1162): n is a, c, g, or t
  misc_feature (1170)..(1172): n is a, c, g, or t
  misc_feature (1174)..(1175): n is a, c, g, or t
  misc_feature (1180)..(1180): n is a, c, g, or t
  misc_feature (1185)..(1185): n is a, c, g, or t
  misc_feature (1188)..(1190): n is a, c, g, or t
  misc_feature (1218)..(1219): n is a, c, g, or t
  misc_feature (1235)..(1235): n is a, c, g, or t
  misc_feature (1249)..(1249): n is a, c, g, or t
  misc_feature (1253)..(1253): n is a, c, g, or t
  misc_feature (1267)..(1267): n is a, c, g, or t
  misc_feature (1271)..(1271): n is a, c, g, or t
  misc_feature (1273)..(1273): n is a, c, g, or t
  misc_feature (1277)..(1278): n is a, c, g, or t
  misc_feature (1282)..(1283): n is a, c, g, or t
  misc_feature (1291)..(1291): n is a, c, g, or t
  misc_feature (1297)..(1298): n is a, c, g, or t
  misc_feature (1301)..(1301): n is a, c, g, or t
  misc_feature (1306)..(1309): n is a, c, g, or t
  misc_feature (1315)..(1315): n is a, c, g, or t
  misc_feature (1325)..(1325): n is a, c, g, or t
  misc_feature (1335)..(1335): n is a, c, g, or t
  misc_feature (1346)..(1346): n is a, c, g, or t
  misc_feature (1358)..(1358): n is a, c, g, or t
  misc_feature (1367)..(1367): n is a, c, g, or t
  misc_feature (1370)..(1371): n is a, c, g, or t
  misc_feature (1381)..(1382): n is a, c, g, or t
  misc_feature (1385)..(1385): n is a, c, g, or t
  misc_feature (1391)..(1391): n is a, c, g, or t
  misc_feature (1397)..(1397): n is a, c, g, or t
  misc_feature (1399)..(1399): n is a, c, g, or t
  misc_feature (1405)..(1407): n is a, c, g, or t
  misc_feature (1409)..(1409): n is a, c, g, or t
  misc_feature (1415)..(1417): n is a, c, g, or t
  misc_feature (1422)..(1423): n is a, c, g, or t
  misc_feature (1425)..(1426): n is a, c, g, or t
  misc_feature (1429)..(1430): n is a, c, g, or t
  misc_feature (1434)..(1435): n is a, c, g, or t
  misc_feature (1441)..(1442): n is a, c, g, or t
  misc_feature (1446)..(1447): n is a, c, g, or t
  misc_feature (1456)..(1456): n is a, c, g, or t
  misc_feature (1462)..(1462): n is a, c, g, or t
  Genomic contig location: Contig_ID=SeqID_39503; Location=1..1472; Strand=-
  SCN-specific regions: Sequence locations=1-325,347-472,494-1472
  Gene Ontology: Mol. function=ubiquitin activating enzyme activity; Biological process=reproduction
gacgaaggtgctgaagaagtggaggcaaaaacattgccaatggctgaagaagcgggcgaaacgatagaagagaatgagtcggaagagagttcggaggaatgatgcgacttttcgttttccttaccattttatattgcataaagcgttnaacaattaatttgaaaagctactgttttgcagccttttactgttcgagttaaatacggattgcttacatatttgggatacaagttttaaatatagattctttggcgttatgattggttttttctgagaatgtgaatgaaattacctagccaaaatttttcgttgactgattttgtaataaaaagaaaacaatcaagtggtttttgctcacattccaattctttcttttagtttgccccgttgaatttttattctcatttattggcagtggtcaattgccttacaattagagccgaatattagccgtttgattgaataacattcggagttattttgatgatttttgacccaataattgctcggatgcaattggccactgaaaattagattcgttttttccatttccagtggtttatgcagtcatctgaccttattattgaggaaccagcaacgaaaaaggcaaaaatcatctgtgaactgccgaactccgaggcatcagaaaacgtcactttttgttctattggttgctcattttcttgctgactcttttccgtttaggcaccaaagagtaacggagaacaaatggcggccatcgacaccaatttgtactctcggcagatgtaagcagcaacaaatgcctttgatataattgcttattgtggtttttcctgtttagttatgcgcttggacattccgccatggaacacttgcgcaaggcgtcggttctcgtcagtggcctcggctccgtgggcgtggaggtggcgaagaatctgatccttggtgccgccattctttgattttactttgcatgactaaacaatcgccgcttttcaggcggtgttcgctcggtgactcttcacgncncnnnngcgttggcgttcngngntttgtcggcgcctttctncgcccnggnnngcgncgtgggnncgnnccgtgccnnngtttgcttcgncnnnttggcggngctcnncgnccctgtgnnctgtgccttgtctgtggnnnttctgtcggnggntttcgtcnnncnnttcgncgtcngcnnncgcttccttccttttcccttctcgcctnnttccgtcgttctttcngttggtcgttctcnccgncgcgtccttttccnctcngntggnngtgnncggttggntgcgcnnccntcgcnnnntgttcntctcggccgncgcgcgcggnctgttctcttntgcctttgtggncttgggcgncgnnttcgttgtgnncgnttccgncggggngncgtgcnnngnggtggnnnttggnntnnttnntttnnttgcgnnttgnntggttccgnttttcnggtgctcgtt

SEQ ID NO: 68061 - DNA, 88 bp, Heterodera glycines
  Genomic contig location: Contig_ID=SeqID_39505; Location=112..199; Strand=+
  SCN-specific regions: Sequence locations=1-88
ggaggaccggacattttttataatttgtggacccaaatcgcggaattgtacccaataagcacataaatctcctttatttggtattcaa

SEQ ID NO: 68062 - DNA, 345 bp, Heterodera glycines
  Genomic contig location: Contig_ID=SeqID_39509; Location=893..1237; Strand=+
  SCN-specific regions: Sequence locations=1-345
atgtatctgttgtacctttttaatcacttttgtacctcttttatcaaatttgtacctcttctaatcactgttgtgcctcttctaatcattgttgtacctcttctaatcattgttgcacctcttctaatcactgttgtacctcttctaatcactgttgtacctcttcatatcactgttgtacctcttctaatcactgttgtacctcttctaatcactgttctatttcttctaatcattgttgtacctcttctaatcactgttgtacctcttctaatcattgttgtacctcttctaatcacttttgtacctcttctaatcactgttgtacctcttctaatctctgtt

SEQ ID NO: 68063 - DNA, 963 bp, Heterodera glycines
  Genomic contig location: Contig_ID=SeqID_39510; Location=1..963; Strand=-
  SCN-specific regions: Sequence locations=1-19,41-653,683-963
  Gene Ontology: Cellular component=integral to membrane
tgcccgtccctgtgggcaagttcattcctttcccttccctttgcctttggccagatgccgtgacctcccctcccccttcagcttattttcaggtcgttttcttgcccactcgcgtttacttccttttgtgtttgtttgggcgccaatttcgcatttgggagcaaagggattccatggcatacttcgaatattactttccgctgatgacttttctgcaactgatgtgttacatgggctggctgaaaatggccgaatctttgctcaaccctttgggggaggacgacgaggactttgagagttcgtttcgcaatacgtacgctgaacagcgacgaaaaacaattcgacgctttttcaggcggttatataatcgaccgaaatttggccgttgggatgacaatggtggacgaattctatggccaactgcccacccaaaagccggacaaattcggcaaggagggcgaagtgccgtcagcgtacacagagttagcgggggtcagtcattggcactttgccaactcaatggaaatggcatttcggctcagaatgagtcccaacatcaactggtcggatctgccaaattggctgctgagaacaatccaagtgttttggaaggacggcggaacgccaaacgccgccgacaaatagtgggagagattaaaaacaaaatattttaaaaaaatttgtaaaggcgaacggaagcgcagcagcattttcgggaggtttctgcaaagggcgagcggcgatcgaattggcacggacgacgcgggacggaagcggcacaatcggtcgctgttcggcacacgacggcgatcggcgacaacggcgggcccaataagtgccgaagagggaaaagaaaaaatggtaaaggcatttaggaaaaagtaaaacgaaattgaaaaatgagaccgaaactaactttgaatgaaaagtcgtggaagcagcgcaaatcgaaatcaatcgctt

SEQ ID NO: 68064 - DNA, 346 bp, Heterodera glycines
  Genomic contig location: Contig_ID=SeqID_39511; Location=303..648; Strand=-
  SCN-specific regions: Sequence locations=1-155,177-346
atgtgcaaggcagtcagaccattgaagaaacagtgccaaatattgtcgaaacaacaccggacacggaaaatgccattaatgaccattcaatgtcaaatgtcaccgaaacttcggacattgaaaatgccattaatgtccattcaataccaaatgtcatcgaaactttggacactgaaaatgcccataatttccattcaatgcaaaatgtcagcgaaaacaatggacaatgaaaatgccattatttacaataaaaatgaaaatgtaattcaaaaataacaaaataatattttgtttatggtatttcgttctactgaatatttactctttactgcttgtaaataataaa

SEQ ID NO: 68065 - DNA, 697 bp, Heterodera glycines
  Genomic contig location: Contig_ID=SeqID_8438; Location=394..1090; Strand=-
  SCN-specific regions: Sequence locations=1-344,370-672,694-697
atggaatgggccgctgccttcctacagctggagggcccgttcatggagcacttcaatcgtgttgctgacagaaaaagcaacagctgcttcatctatttttttgtagacgcttaaccacacagtgcagcgccactccgactcaaaaagtcgctggaccgacatggtcaccaccagtgaccagggcagctgcatatcgcatacccagcgcaaatttggtaaggatttcggtataaagaattggtggacgtacgtgaaaaagaacgtacgcgctacaccctttgccgcttaacccttttccccacctatcggtacatttacatgggtacccccgtaaatgtaccgataggtggggaaaagggtgaaaaactgaaatattaaaaacttttttccagttcgcccaaatttgcggatggtccttacagacttcatgttgaacaactgcggccgggccgctgctgtgcagcaacgctgggacgaactggcagatgtggcccatcgagtgcgctccggcgttgactattgtacttccacggagaaaccgaagaaggaggtaaaatgcttttcaaaattattcacaaaattaaaaaaaaaactttttttttgttaagccaccggttgccggctacgacttcgtgccggcaacaaaggcggaggaaatgtacaagcgccatggccttgcgcaggcactgctttgcat

SEQ ID NO: 68066 - DNA, 334 bp, Heterodera glycines
  Genomic contig location: Contig_ID=SeqID_39512; Location=954..1287; Strand=-
  SCN-specific regions: Sequence locations=1-334
atgcattcatcggttgacgacggccagggcacggttcgacttgtttggggactacgaacgcacattgtgccgtacataaaacgactccaaattgttgaggaggaggaaaagagactgttggaggacagaacagtgagacggaaacaaactgttgctactgcttcatgacatgatcggaaagagattacgatgaagattttgacagcatgcttttttgtttttatttttttatttttaggattttgttgaagtttggatctcttcgtttggtgctaaatttgtattttcatgccccataaattttacgactaaaatcatttaaaacaacaataaa

SEQ ID NO: 68067 - DNA, 303 bp, Heterodera glycines
  Genomic contig location: Contig_ID=SeqID_39514; Location=570..872; Strand=-
  SCN-specific regions: Sequence locations=1-303
ctgtttctgagtgccaccattgccgtcagctttatcatttggttgcattcctttgaacatgatgctgattccaatggggaccaatttgagctggtgaattcgtgcactcgtgaacggttgacaggccgaataattggggaggatgatcaatttttgattgaacggtgtccaatcgttggcaaaagtgcggaccacccggacgaatggggccgagaagaagcatggaagacgaagggcgaaggaagaagcaaaatgctcacttttggcacgcctttctttgaatggaacaacaccttttcatag

SEQ ID NO: 68068 - DNA, 944 bp, Heterodera glycines
  Genomic contig location: Contig_ID=SeqID_39515; Location=251..1194; Strand=-
  SCN-specific regions: Sequence locations=1-192,215-392,678-804,835-944
atgggtggacaaacaatcggaggaaattcaggcaatttaaaggacaaaaaagccaaaataagcaacaaaataaatttgcagaagaaatacgtcgagtttgagcaggaaagggaacgggcgaaggccgagggcgaagcggcgcacgaagaagcggtgagaaagttcagcgaagcggcgaaaaaggcggacaagtgagaaaatgagaaaaaagaacgacggaaaagcaaaacacgaatgcttaagggaactgaccgaaatcgcgaacaaccccaatttgtcggcaaatgataaggcggaaatgatcaacagaaaagtgcagtcactgcccaaaaaagtgagggacgaaataggaggagcaatgggcggaggcggaggaggtcaatagcagcggaagaagtgaagaggaagaggaagtaataggaaggagagggagaggagaggagcgaagaaagagtgatgggacaaaaaggaggaggaacgagaagaaaaggaagaggagagtgagagaagataagagaaagagaggagagtgaggaagtgaaagaatgagaaaaatgggtggaggagaggataagaagagagatgagagaaggggagaggagagtgagagaagatgagagaaagagaggagagtgaggaagtgagagaagaagagagatgggaggagagtgagaagaaatgacctgacttctctgattgagaaaggatgagcaaactttaacgaaatgcattgtgctttaaatttaaatgataaagctacttcaaacaatttgtgactaatttttaagaatagttttctatttgaataataaaattttattttaagaaaataaagggtaaataattttgcgtaacaatgtcgactctataaaaaaacacactgaaaaggcccattcgagaaaatacaataattaacggaattaaagcttttttatggcaataaa

SEQ ID NO: 68069 - DNA, 467 bp, Heterodera glycines
  Genomic contig location: Contig_ID=SeqID_39516; Location=6..472; Strand=+
  SCN-specific regions: Sequence locations=1-293,316-335,357-467
atgcacgaaaaatttcgcagtgttttcacaaggtgggcgataaattttttattgaattcttctatattgcaggtgattgttgtctgataagtgatgacatttctttcccaatttcatttttcagttgcgctgcaaaccgtgccgaggcaccaaagggcgccacgcgtgtcaatgatggaaatgagaatgtgtgatgacaaaaactaattgatgaagaacataacgaaaccgatgatgaagaatgagaatggttagacatggccaactttagcataaaacttgtgaattatttatggaattaattacaaaatttaatgtcttatcatgcgtacgagatgtatatatgtgtacatatagaattattatgagtccaaatacccacgactagagaagcgagaaccgaaccaatcccgaaactcgatacccagaccctgacttaagtccgaaagacaacctggagattgcaa

SEQ ID NO: 68070 - DNA, 957 bp, Heterodera glycines
  Genomic contig location: Contig_ID=SeqID_39518; Location=77..1033; Strand=-
  SCN-specific regions: Sequence locations=1-319,341-491,514-899,927-957
atgtgcgcgtttcatgtgaagcaagcgataaatcgccgaattcaatcaatgggatttatgcaattgtacagctcaaaagaaccaaatggacttgagtttcagcgccttgttcgcaaaattggggctctacaattctgtcctcccaactatttagcccgttcgcttcaactcatgcgccatctcatcacacactctccattggaaactttacaacagggcgcattgagtgaacttctcgattactgcgtaaataaatgtaaaactacttagacaacaccaaatatacagaacaacacatggatcaacaacagaatagggctgcacttttttgcactttttgacgttgttcggcatcgaaccatcaaccatgctgagtcttaccacggacgacagcaacgcttttaccagcctggtttcttgctcggccgatggatagcgagttttcaggtacttgtttgtctctaacttttgtatcgtaaatgataggaactaagtcatgctgaagaagaaaccgcagtggccgttgatgaaggaagacaattgccagctcgcccgcttgaattaactcttgaattggacagaggaattgcctcagcgaaggcggatattttggcttttttgaacacggattactgcaatgatgaatttgttgaagccatgtctaattattatggaagaattggacatttggttggcttcaatccgccgtcaaaccgtaatgaagctgaagaaatgataattgaagaagatgcaaggcttttgcttgaacaaagtttggatgaaaatgggctgcatgttgatcaatactttgaagaaatgggtttgaatgaagtgcaagatgaaaactcgcctgatgttaattcagaggatggagaagtggatatcatgaattaattcatatgaatttttatttaacttttatatttgaagatgcttaaattttacattgttattaaa

SEQ ID NO: 68071 - DNA, 583 bp, Heterodera glycines
  Genomic contig location: Contig_ID=SeqID_1114; Location=252..834; Strand=+
  SCN-specific regions: Sequence locations=1-335,359-432,455-583
atgtttttgcttaaattatcaatactttttgcacattatttcattaatgtgcaattagccgaggaacaaaaatgtggggaatattcaatcggagaacttgtaaaaagaactaaatacagatcatataaaaacaggaagcagccaaaggaggttaaaacaagcggaaatgatgactttagcggctcttttggagaggtaaatttgcgacaatgcccaagccccgaaatgatcaattagtcctaattagtacagaatccaatgtttcacattaaccgtcattagggatggttaaatttcactaattgccatgattggccaaatattgtccaatcagctttttcccttctctctgttcactttgtttgactttggttttcctaagatttcggttggatttatcgtctatgagaaccaaaagcaatgtgtggcggttaaattctttaaaaacgaaaaggacgaaaaggaaacggacgaaagcggcaatttgaaattgcacacgaaggcaatcgaagtggccaaacgcattacgaaatgcctggaggaaaaggaacgacggcatctgatcgaaatgatcgacgcgtaa

SEQ ID NO: 68072 - DNA, 1311 bp, Heterodera glycines
  Genomic contig location: Contig_ID=SeqID_1115; Location=173..1483; Strand=+
  SCN-specific regions: Sequence locations=1-75,104-120,142-359,381 -471,514-538,594-699,721-724,752-794,831-873,903-1102,1128-1311
atgataattcatgaagcatttgttgacaagctccgccaggaaaacggcaaagaaacgttggaattggtaaagcatattttgggttttaataaaaaatatttcctttattcttatatcaattataaattggctcattttttaggaagatcgggagcgatttatgacagaaatgagaaatttgtacgactatgaaagcttcagcaaaagttacattatgaaaatgctgaacaagtcgtcaaatattacgtcaatcgaccaatttgacgccaaaacgtgggagaggaacaacaatttggtcgaaattgtgctcgaattttggcaacgatacccaaagacggcacttttggtgacggtaaaaattatcaaaaatgaatgtttttaagaaaatctttttacgtggttggccattcacaaaaagtgcaaatttggtcctttacaaaaaagtgcaaaaatcaaaaatctgttttttcctataattttttaatcgattttttaaattagataaataatattcttctaaaagtttttttgtatctcgtataaaaataaaaaaaattactaaatattaaataattgattactaaaattttaaagcttaaatggcgcctttaaattttacaaaataaagcctaagcataggcctaggcccaagcaatttagcttgagttgaagtggatacatttcaacataaatatttccatttttatatattttatttaagttcatttttacttttatcccatttgtaattacacttctatgtatataaaaaattcaaagtaatctggctaatgattttatttaattaggtaaattaaattatttttattcgagatccaagaaaaacttttagaagaatatgtattaagcatcaatttaattaaattttaacattaaaaaatcataggaaaaatcagacttttgattttgattttgtgaagcgtccaaattgcatttttgtgaaatgacctagaaccatcttttcagaatatgctgcacccgacttggcaacagcgactgacggccaaaggcattttggactttgtcgccggaaagtgttacctgcgcgagttcaaatgggcacgaaaggcaaaaaacttgcgcctttttaattactttaaatttggcgaattgaaacaaatgatagtgcgaaaacagcgaatggttcgagttcaattttggaagaaaaatcgaaagcaaatgcaagagaaatttgggaatttgaaaagaaaagtggccgaaataatggagcagcagcagaaggaaatggccgagataagcaaaatgagcacgaactgtgaaaacgaatga

SEQ ID NO: 68073 - DNA, 200 bp, Heterodera glycines
  Genomic contig location: Contig_ID=SeqID_1115; Location=2005..2204; Strand=-
  SCN-specific regions: Sequence locations=1-200
  Gene Ontology: Biological process=morphogenesis of an epithelium
aaggtcatccaggacagccaggaggccaaggaccgcccggacctcttggcgcgcccggtcagcccggccagcctggaacctctggccagcctggacagcccggagcaccgggacatcccggcaaggacagcggctactgtccgtgcccgccccgctcttccgtgttggcagtcaaaaagaagatggcggcagccaagaaa

SEQ ID NO: 68074 - DNA, 645 bp, Heterodera glycines
  Genomic contig location: Contig_ID=SeqID_1115; Location=1557..2201; Strand=-
  SCN-specific regions: Sequence locations=1-448,470-645
gtcatccaggacagccaggaggccaaggaccgcccggacctcttggcgcgcccggtcagcccggccagcctggaacctctggccagcctggacagcccggagcaccgggacatcccggcaaggacagcggctactgtccgtgcccgccccgctcttccgtgttggcagtcaaaaagaagatggcggcagccaagaaagcataagcgacaagcgcagggagaagagaaccgaaagacaaaggaccgacgcgaaagcgaagctgaagatgatcataattgggtggaagttgttgtcggaatttgtgttcaccagcgcatttcccacacgaataaagggcattcactaattgctgttttttgcatttttgaaaatgccgaaatcgcattggtcaactttttatttaattcggcacttttcattttaactcattaaattaattgcaaataatttttattagcctagaattaatcttttcttttattcgcttacaactaattgttgagatacattccataaattgagaaatgctaagtagtttaatccattttgttgttgtatttggcactttgcattttaacatggccaactaattatcatttggctattgtacctaatattcgtttaaatagttcctttttaaataaa

SEQ ID NO: 68075 - DNA, 3238 bp, Heterodera glycines
  Genomic contig location: Contig_ID=SeqID_1116; Location=3601..6838; Strand=+
  SCN-specific regions: Sequence locations=1-246,271-524,546-735,768 -900,922-1342,1364-1762,1784-1897,1933-2129,2166-2328,2360-2393,2415 -2442,2465-2556,2592-2789,2811-2847,2931-3238
ctgagagccacagagatccttttctcatcctccctttgcttttgcttgtccaaaccagcgatttccccgcgagggtttcggaaggaataattaatttttgtgtggttccgccgcgtcccacgtcccacccgtcgctgaagcaaactcaaagttcacgaagcgtccgtcacaatttgtcgctgtgttctcaagcgtaccattccgccgtcctatcactttccctccggcgcaatttgccccattcatctgctgctgctgctgctgctgctgatgttcccattccttttcattgtccgtccgtctgtctcccgctaatgatcggccaatgattgatcgggccaaaagaggttccgcttctccccccgcccccccaccgcttttccctcgcttcttcgcctccctttttaccttccttttcttctttccttctgcttactgatgctgtcaaaaagggtgtccaacgtggaaaatgggaacgactcgacccgacccgacaccccaacccaattcaattccatttccaatttttcttttcttttcgctttgccccccccccccccgctcccctcgcgcgacttccgttgtccattatttttatttattgtctttttggccacagaaacaataaaaatttctaacaacttttttgcgccatttattgtgaccccgtgggggccaaacaatgggaataatacgtggacggagcgggcgcagcagagtcgagcagcacaatcgggaacaaaaacaacagcagcagcagaagcaacgcccaccgccccccagcggaagacagaaaccgcaactgatcagcagcagaagaagtgcggccgttgacccgcaaaccccattattctcatcattctcctccgcctgtcccattccctccacaaattggccccatttttgttgcttttggtgtccaacaattggccaatatgttcagcctttgctgttggctccgcttctcacttctcccgccgctgattttgccgcttgtttttggcccggcattggccagcggtggtggcccaaattcttcgcagagacatccatcgcatcatcaacagcagcagctgcacagtgaaccgcttcaactccttcactcatcagctgaaacggtggtgaacatgagcagcactaacggacaacgggcggcagacgccgccacacttggcaaaagtgggccggaagggccgccccctggcaaatggttgggctgcgaagacgcgccggacgaatggcgaagacgaacctgcattaaagtaggacgaagcaagcacacatagaggagtgactcattcataaaaatcctattcaattctggcacaaaacgaaaattcagttgcgacagattgaccgcaaggcacggcaagcgttgacccgtcgcgtcaagcagatggtctcgccaccgtcgatgcccggctcgccggcgtggttgaagccactcccggtcccagtgaaccatcggggccaaatcgcgtcgcatccctttgagtgcatgacccttcgctgcctttgccccttcttcaaagtgattggattaaaacaaaaataggtaaatttaattcccaattcctccaagggcaaaatgcgtcgtgatggcctttgttatttgcccagcggaaagccgctttcgatggcctaccgtaaggagtaccgtatgctcagtgatgaggaacggcgccgtttccatgtcgcaatgaatgagctgaaacgccaaggcatttatcgctttttcggcactcagcaccgccgggtggccaccggtggggcccactcgggacccgcttttttgccgtggcaccgcgaatttgtgaagcgcttagagattgccctgcgtttgctcgacccgtcgctggcggtgccctattgggactcgggtggaaagcacaatttcaaaaattaaattaacaaaaaaaaaattgtttatttcccggcattaagtgatggacaattatttgccggacccgcgcgactcaatttttttctcgccaatgtttgccggcgacacggacccgaacggatatgtggtcaacggaccgtttgccttttggcgaacattggagggacgggcagccattctgaggtttaaaattggggcattaaaaaaacatttttaattggcaccatttaaaaacaaattaattaattttacaccgtttttagggatttgggaaaggacgcgcagcttttcaccgaaagacagctcttagcggtggcaaacgagcgcaacatttggaacgttctctcctacaccgtccccttccgcggctgtcccattccgacaaattttgacgcgttggaatattcgcacacaaacgttgtatgattttttaaaattatttttaaattattaaatgcaactttttttttagcatttttgggttggtggcgatttggccacgcccgaactgtcggcaaatgacccaatcttttacatggtaattaatcattttttgacaaaattttcacccaatttatttagcaccattcttttgtcgaccttatttttgaaatttggcgtcagatgcaacaatcgcggcaagaacaaaaaacaaaaatatttttaagtgtaattaatttattaattagtttttcatttttagttctgaaagagaaaacatttacaccgcaagtaattctattgtaatttttgaaaattagcttaagaaaaacagatttgaaaagctgtgccaatgaatttcatttctcccattcgctgatggcaccgttcaacacactgacaaacattgacggtcagtggaagcgaaattaatgagagagtccagcagaatttggggggaggaagggtcgtaggaattagcttggaaatgattcgaaaaatcgaaaatttaaaaaaaaaattattttcattaattacagaatattcgagttttattttatttattttttatcttgtaaattaaaaactctctgtttccaattaaaggtctttcaaatgcgtacactgatcagctgtaccgttatgccctgcggccggtgtgcactcgcaaaaggcccacctgcgactcgaggcatattagcccccctcacccattaatcaagactaattgccatctcaatttatttattttgggtatttattctgcgatctcgaccacggcgtgccccattgtgtgtcaaaggtcaaattgggcggcaattgccgcgggtttgagggcaaagatgcctgtttcaatgggctgtgtctgtttgggctgtgccaaccgggcccaac

SEQ ID NO: 68076 - DNA, 1049 bp, Heterodera glycines
  Genomic contig location: Contig_ID=SeqID_1117; Location=611..1659; Strand=-
  SCN-specific regions: Sequence locations=1-132,154-564,595-651,682 -890,914-972,994-1049
atggccgaatgtgaagaacgtgtgacgaaaatgttggaagacaaattggtaaaaaaaaagccaataaataagtagttggacggaattaaaatttttattttagaagcagataaaagcattggacagaaagcgaaatcaaacagtttttgaacagtaacagccggggttagatgatgaaacggaaaaggcggtcacattgaggaaatgaattgagaatgccaattgataaattcatctgattgttttcactgcccacatttttagcgcggcaaaaagcttggcggtgggcgtttggatggcgatgctctcgtgtgcggtcggagccactgtgaccgcgcgggagattttgcctgctcccttgcggccactcggcgcacgcccgcccctcgtccgccttcgccccctactcgctgggccacaagggcccgccacgaccctcgggtgaggaattaattgactataagcgaatgggaaaagcgagcagcagagagtgtctctcaccaaacacacactatttcttactatttcttccactgagtgggaaccaaatatatggaaaaggccaaaaagcattatttttaaaaatacatttatggagatgtttctcaaaaaacgcattttgcgttgaagagatgataaaaaaaattcgtaaaaacaaatacaattattttatgctttttacatgtgttatgtgaaatattgaccagttaatcccataaactttccggcggcttctatcggcaccgtcggcccccaaaaactcctaatttctctaaaaaattgtctcgcgcaaaaattttattttttgggcaaattctgttaacaaatttcacaattttcaaaaatttttctagcggcgtctaacggcaccaccgcccatccttttctatttcccaaaagtttttttgaaaaagcgcgtcgcaaaaaaaaccggttatgaaaagcaaaaaaaaaaaagtcgccaaattatgtcaattttgtgtttgttatttaccattaattctgcaacattattttagtgcttttagttttaatatccggataataaa

SEQ ID NO: 68077 - DNA, 1540 bp, Heterodera glycines
  Genomic contig location: Contig_ID=SeqID_8440; Location=296..1835; Strand=-
  SCN-specific regions: Sequence locations=1-394,416-632,671-833,855 -1086,1108-1408,1430-1540
atggttgcacactccgacaaccgatggacagccaaagcgattcttgttgcgatttttataatgagtccgacgaagagtaatgagtcaacaattgcaaagaggtcggaataagtccatttaaatgctatactcggggtcccagatcaataatattcatttcgtttctcgaccggccaaatttttcatcggctttctctccaatggcagtgccgctgcgtcgagtgaaactaaataccaccggttcatttttgcgacaattaacattattttccgtcttctagtgacggaaaagtgaattgttgtcgtaaaaatgggctaaatttcacggataaaaacatcccaaatcggcgagacgtcgaacttcgccctttttcaagtgcagcagttaagtataaatgaacccacttttgttttttacattaagcggtggtcgtggcggagagtttttcttttttttgttattcatcaatgaaagtgggagagaaatgaattaaaatcaattcgcttaaaagaattcatgctttcctaaattttgatgctgatcaataggacaaagaaatttttttatttttgaaaaatgataaaaatatgcatttacacaaaatattaaaaacctccaaaaaagtacgtactaaatatgtaaatattttttcttttataaaaaaaaattcttcgatttggtgttttggcatataaaaacatatcgcacatatttttgctaagaaaaatacaaaaaattgaagaaaaaacacaaataagatctttgacttaattgcggcaacaattgcattggtggtatgctgctaaaatgaccgtctttaagaaaagtgccaacatgtaaaatgcttttttaattgttggaggcgactcggaaaaaccattttcacacttttgacagaataatatcaatgtgcctgaagcggaatgatttgttgttaatatgtaaatgctttcaattctaaattagtaatttcaaatcgctcaaagcaaaattagttgggcaacccaatgtccttgcggactccaactgttggtccccaactcgtaatttcccactgaaatgttttcacaatgacagtgtcgctgaagttccacagagtttgttcaatattcaaaaacaggcaatttgctaaataaattaattgaaaatattgcctgaggaaacgacacacaaaatgccaaaaggctgctaaaagtgcagctgaacgggacaaacggtgaacacggcacaatcgctcgagaattcgtgccaactttttgtggaagacaaatcgtgggaagtgccatagttacgtgccggcacaatttcaacgcggcacaaagttggagaatatcggaaaaagatggaataaattcagaaaaaaatttattccgtaataccttgaaaatgggaccaaaaattttttccaaaaatttaaaaaaaaaatttctagcaaaaacaaattgttcgcaattctgtcaaatccgagaaacgaccaaattcaacattctggcattttgttacttttattagctgataggcaactttaatcggaataaa

SEQ ID NO: 68078 - DNA, 2654 bp, Heterodera glycines
  Genomic contig location: Contig_ID=SeqID_8441; Location=4..2657; Strand=-
  SCN-specific regions: Sequence locations=1-46,73-137,160-196,219 -313,335-763,785-790,820-1401,1423-1554,1576-2040,2062-2144,2166 -2186,2208-2581
atgcggactgaaactgagattattaaaaaagtagaaatagaaatggaaggaacaaacaaaacccaaaaagaagttaagaatgttagtgaaccaaaattaacaggaaacatcaaaattgagaaggaaatagtcgaaaatctcccaaaaagtttggaaaatgaaattgtggccgaccaaggcgaaagcttggaaattgaggatgaaaatttggaggaaaataatggaatgagttatgaaaatgaggaagagtttgaaatttatgatgtggataggaggaaaaggacaacagtaacaactccggacgcaaggtggataaagaaagttgaaggaagcaaattacgaaaaaagggcggacaagaaaataagaatatgaatacacgagttaattatgcattataccggctaaatgaagagagaaagcgtcaatatgaccatatatttactcaagcttgtgaaaactcaaattttcaacttcaattggcaaaagcaattttgcaaataagcccaaatgaaggagtcagacggatttttgatagagacgatttggtcgctcgatggaagggtcaaacattagaggtcggattttgtgtaccgattattcccgaaaaaatcatttgggacaagaaaatcggagctgattgttacgaacagacacccatttttgctgaaaacacaaccttttttgtgcaagccggcactagggaattaagcatcttggggagaagaattgagtgcggaaaaattgaagaccttgaaaatgtccaaaatgctacacaaaaagaaatcatacataaattaaataaaaatttagaaaaaattcgtccaaaatatagaaatatgcaaaaccctttaatattaaaatcgggagcacttttcgagtctgaaaccataagaattgaagagacaatgttggaatacagaagaaaagcgaacaatttaccatcatccgccttacgattaattcaaagaccaaatttaactgatgtcattaaattaatcaaagatgaagcaactgaaaaattggatgttgtcctagggaaaacgggaagttggcttgaaatgatgagggacatccccaaaaaagcaaaagaggcggttaattatttaaagggcatttcatatgcattaattattatcccattatttatacttatcgcaatagttatatatattgtagtgaaatattggacagtaatttcagcaggctttcgagcgggtacatttttggcaaggattattcggagcattattggtctaaaaaggaaaagaacacaaattgtggctgtgccaacagcaccggatttggactcaattgatgaagatgcatatgttttggactatttgccaccacgaagagtggcagtaatcacaaatgatccaagaaggcttccctcaattcgtgtacattttaatggtttattaacatccgcattggtggactcatgcgcaagtgtatcatactgtcgtgaatcaacagcccgaaaagcgggattaaaaattagcgaattgagtgagagaaattcaaatttaacagcagcaaatgattcacaaatacaaattttgggaaaaacaaatgcaaagataagaatagaagatcaaaccacgggaaaaactggtgaatgggaattaactttacttgtttctcctgacaagcactgtcccggacctttacttttgggattaccattattatctgacttaaaaggaattattgcttttggagaacggaaagtacgattgggagaaatatggactaatattgtatcggttatcgatgcgcatgttcctaaaacaattaaagtcacaatggaaaaaaccgaaatatttgagccaagaactgagaatgttacaaccctggacataagaaaggaagatcgattaagcgtcattggaaaagtcggacttggatttaacggccgacgtatggccgagaattgcataagaagtgcggaaaagagcattttgcagtcagagatcattcaacctgaaggaatgaggaaacaaattccagtccggaacgaattggaggcaaaagaaacagaagaagagttggagcgaagaaaacgcttcgcagcaaaaacaccggcaactcaagggcagtttgccaattgtgtttgggaggaaacagcacaaaatacaaaagaggagaaaatgaagaaaattgagaacagcatttgccaaaaaataaaccaaattcaacaacaaatgacaaaggcttttggaggattaaaggaattagccaaagaaatggatgaactgacgaaaatcgccaaaaaagaaatggaaaaagcggaagaatttcatccgaattcgaaccgatttgccaacacaaatacgtcgacttggcgacaacatgacgagttccgctaccgtaatcgtgggacggtcggcagatgggtcaacaacagccgtggacgcgggcgacagcgcccataccaccacaattggcgcgggaatgaaggatgggccagaaatgatcattcacaatcagaaccatcaacaagtggcgcatttaaccgtttaccaaagatcaatttaaagatgattcgaataaataccgaccatagaatagtgatgatggttaatatttaatatttaaaaaaaaataataataataataagaaaacaattttattaatcaaaaaattattaaa

SEQ ID NO: 68079 - DNA, 375 bp, Heterodera glycines
  Genomic contig location: Contig_ID=SeqID_39524; Location=250..624; Strand=-
  SCN-specific regions: Sequence locations=1-375
atgcacgcgttttgcgctcgagctatttatcatcgggcttgtcaatccaaagcgaaacaacaaagatggtgttttgaacaaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaatttttgttgctctaattaaccgggataaaaacattcgaatcaattaaatagcttctgagataataaggtttatcataaaatttcaattaaaaataaa

SEQ ID NO: 68080 - DNA, 335 bp, Heterodera glycines
  Genomic contig location: Contig_ID=SeqID_39529; Location=43..377; Strand=+
  SCN-specific regions: Sequence locations=1-215,240-335
aggtcatagtcaaatttgaaaaatttgtacgcgatgaaacacgcaattttgacgccaaattggtggccctgcgcattgaaaatgctctaaaaactggcgaaaatttggacgactcttcgcttggcgcaggcgcaaacagcagtaccgacgatgttgtgaccacaaattgcgatgttagtcaccacgtaaatgtgcatcatctttttgcccatttcacttaaaatttttaaaaattaaggaaaaaaaatgaaaatttcattttttagagctctcctaaagctgtgaccggaaacgctgacaatgaggcagaaacgctttttgaagagcaatttcag

SEQ ID NO: 68081 - DNA, 483 bp, Heterodera glycines
  Genomic contig location: Contig_ID=SeqID_39530; Location=1..483; Strand=-
  SCN-specific regions: Sequence locations=1-43,65-483
aaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcgtttccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggggga

SEQ ID NO: 68082 - DNA, 657 bp, Heterodera glycines
  Genomic contig location: Contig_ID=SeqID_39530; Location=153..809; Strand=+
  SCN-specific regions: Sequence locations=1-267,289-657
gttttcggggcagtccccccgaaccgatgcgcccagatttatggggaaacgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttt

SEQ ID NO: 68083 - DNA, 571 bp, Heterodera glycines
  Genomic contig location: Contig_ID=SeqID_39531; Location=353..923; Strand=+
  SCN-specific regions: Sequence locations=1-115,146-201,224-310,338 -542,564-571
atggattttgcaacggggccaacgaagaaattctgcgagatctgtcggagctggattgacttatttgaggataaaattcaagtggaaaagttgatgagtaagccggagtgttttgatttaaaataattaattaattttttttaaacaaaaatgtcatctaaaagcattgtaaaaaaataaaaataagtttatgagcattggaatattattttccattttttaaaccttagatatgaaaatttgtataaataattattaattctttcctataagcccttgaattctaaaatatcttcttatctaattcaatattaattaattaactaattaattaattgcccattttcaaatattagtgcacaagcgttgcttcgtttgcgcaatttgcgactgtccgcttgagccgggcaactgttcccgagatgacgggatcatctactgccaattcatgtgcaacgaccgtgtgccagtgtggttttgttctgcccatatgatgttgggatcgggcgaaaaatgccaattgttgaaggaaaaatggatgaaggaaaatgaggaaaagcaggaaatatga

SEQ ID NO: 68084 - DNA, 4207 bp, Heterodera glycines
  Genomic contig location: Contig_ID=SeqID_8442; Location=1024..5230; Strand=-
  SCN-specific regions: Sequence locations=1-118,169-214,236-370,417 -533,559-753,775-895,918-1021,1072-1129,1166-1319,1354-1729,1754 -1812,1846-1877,1922-1977,2000-2020,2246-2538,2581-2620,2642 -2694,2739-3295,3317-3928,...
  SCN-specific regions: Sequence locations=...3950-3974,4001-4050,4073 -4207
  Gene Ontology: Mol. function=protein kinase activator activity; Cellular component=synaptic vesicle; Biological process=synaptic vesicle fusion
gaggcgggaattcgaagaccccttattttgatcattgggaaaaataatttatgacatgtattttttttaaattttccgcgccgggcagaaaaaagcaggaatttatagtcattttgtgaaattttcaattttatttatatttttcaaggtattttttttttaaattttccgcgccgggcagaaaaaagcaggaatttatagtcattttgtgaaattttcaattttatttatatttttcaagatgcacctttgccatgtgccgatcagagttatacaacaaaaaattcgtcgtctgcttggcaaggcacacattgggctgatttattccaaacgcatcaatctgttgttggacgaactttcgaaccttgtgaatttatttttttgaattttaattaaattttttttaaatttttttagcctttcggcgctaaaatcccattgaaaccactcggcagtcggctcattcagaaagaagtgtttacagtgcacaccggctcttcccctgatgggccaatgtgctttttggaagtagcttatttaaaaaaaattttttttttaccaatttcctaacaaaattccatgaaaattttcatcaatttggttgggatgtaattacgattcataaataaccgaataaaaaaaaataaactaaaaccgaggaataaggtacagaaaatctggtagtcccaaatttttaagtttgtacggtagatacaaaaatcaataaccatttttttgtacgatacttacaaaaatagaattaatttcaaaaaaggtttgtgatgatgcgctgattttgcgtgatgctaatggtgttgtgcaagaacggtggtggtatgagaggcttgtgaacatgacatattcaccggtgtgtttctacgttttttgggtctccataaaaatataattaataaattggaaaatttaattagaaaacgcgagtgctttgcttatggcgtcgtcatgatgaccaagtttacatgcataaattccatacaaaaaaggtgaatgaatatctgggattaaaaaataaataattatgtatatgtatcaaacataattaaaatttaagtgccgtcatttgtacaacagtatgaaaacagcaatggaacgggcagcatcaagaggcaaaaaaaaaaaaactaataataataattgaatttatgacaattgaataagtgtatgatgttaggtcgtttcatattttatgacgttagtcagaaatcgtcaaatgaaaaaaattttgttattcataaactttgctcgattttcaaaggtgtatttttttaaattcccaaaaagtcgatcctcatgggtaatttttcgtttttattacatttttcttcaaaaatttgccaaaatgaccaaaataagccctaaactcctcaaaatggcaaaatatgcatttatatgcactaaaaccctttaacaaattaaaaattttttacgtagaaatagtgtttttttgagatccttttttcatcacatatgcgcagaaaaaatatgcaaaggcatacaatttatagccctaattacattatttaaattgacaatatagctaaaattatttaattaatttgaaggaaaagtgcaagtggctggccgagagttgggcggcgaatttccaatccatgacgtggaacgaaatgaaggtggtctgctcaaagttcgcattgatggcatcgcattgcaatttgtgaattcgcaggcacaaaattttaaaaaccccaattttttttaaattttaaatttaggaatttattgaactaagcaacatcaaaaaatgtaacactatcggtaaattggagggacaatattaattttaaaaattttgaaatattttaaggcggcaacattttcatcctggaagaatttagtaaaatattttaattaatattgaaatattttaattgaaattaaacagatcgtgccaacaatcagcttatacagcgccgatacatttcttcggtggtcagttttatttattccttttttaattcaaaaactttgtatttatgggttaaaattcttataaaattatattataaaacaaatcttacttgtaaaaataaatctaaaaataaaataaagaatgacttttcaaaatttaatgattcaactttttctaatgattaaaaaaaatttataactttaaaaaattttttttaatgattcgaaaattttatttttttaatgattaaaattatttcttttttctattttatttgcattttttttaaaaattcgatatattttccaataaacaattttttgtgccgattttgtcacttttttttttgttgccaatgttttttaattggaagtgttgtgccaccagtgtttgtgttgcttaaggcagcctcaatttcatggtcacttcatcgtgttttttctgtgcaccaaactctggacgaggagtgcaatgaacagcttcgtgaaaagctggacaacaatgtttgtgttctgtttgttgttgttgtgtgtggtgtctttgtcagggatgtaaattcaattcaaaaagcctttttatggtccaacaaaatttaaaatttcaaaaaaatgatttattaaaatttaatagtttctgtagtttgcccccactttttttttgctttcatttataagtaactataaatgatttaaacgctagaaaattagtaaaaattcattagaaggttttcaacagcagctgtctttcccatgcagttgtaaaaaattttagttttttccttttccttcgaattcgggttagagtcgagattgtcaaaactaaaagtcatattcatccgaaaaacccagatatgtatttgacaacttttcagaattaaaatttttttgctgaaaatgggaagtgggcaaaaaatgaatgataaaaatgtttacttatataactttttatcctaataaatacacatccctgaccttttttatacaatatactcatatatttttttcaatttctgttcaggtaactctttatcgctctccacaagaccctaatgagtctaggataatccttcctatgaaggccccacaaattgatggtaattagtctaaattgtttaaaaaatcgatacttttttttattaattatcctgtcaatttagaatgtttgtgtggttcgtattctgaaaatgacgaaactgcatcagtttttgaaaggccaaggtcgaacacactttcagacctccgaattcatcgagaaccaaaatacaaaggaccaattctatttccaatgatttaaattttgggtggagcaaaaaaaaatttgcaattttcttataattaagacaataagaaaaacaggacttcatttcaaaaatgcgaaaaccgtaaaaattagtattaaaaattgaagccctgtccctgacaggggtgtgcgaaaaccaaaaaaaataattttcgaaaacgaaacgaaaatatttatttttcacgaaaacgaaacacgaaacgaaaatttaaaatttcaaaactcgaaaacgaaacgaaaattttttacggacgaaaacgaaactcaaaaagtgacgaaaaaaggggacgacacgaaaacgacacgaaatttcgcacacccctggtccctgacgaaaaaaaataaatggctctgttcgtcgcagtttacaagataataaaataaatgtaatgcatttttctataatcatccaaattaaacattcatggtatcatttgatagcccaaagagttctctattggtttaccaagatttaaaaaaaattaccttaagatccaaaaacttatggtcaaaaatgctcagaaagtttttttttttttgaattttctgatcataacttttttaaaagataacgaaattctttgaaatttttgtgaatcctgtagactgcaatagagccaaaaataataattacataaccttcttttctgctgtgtgctttaagtgctttaattacacatttattattatattatttttgttttggcactcattttatgcttatacaaatatttttgtacttatatttttgctgtcgttgtgatccattgtttgttgtgcttatcaataaatttctatctaaattttttgaattttataaaattacaaaaaacaaccattaaactttttgaaattaggttcatttaacaaatttaggccgatcaaatttgctattctgtgctatgcgttttttcatttgcagcggcacatcgtcacagcatattaacacatcaaaaa

SEQ ID NO: 68085 - DNA, 668 bp, Heterodera glycines
  Genomic contig location: Contig_ID=SeqID_8443; Location=328..995; Strand=-
  SCN-specific regions: Sequence locations=1-2,26-117,166-226,250 -259,281-298,364-512,534-668
atgccaccaccacaaccaccaccattgtcattcactatggacgcgcctccaccagtgccaaaaaggccaagccttccaacaaccgataaaaagccgtcattgactgctgcttctgtgaattttaaaattttatttattcaaaaataattattttattgaatttaaggaaattttaccaaattctacaacgcctgagctgctgtgcgaaaatgatcaagctcaaattcagaaaaatgttcacaaaatttcagtgaaggatcaacaactgtttaaagatgaattggcaaacaaaaaggcgattattataaaatattattatttttatttttaaaatttaataaataaattaaattgaaattttttgaggaagcgccaaaaatccaagtgcctcaacatttgaatttgaactcacttgaagcaatgttgccttctacatcttttgttgatgaacaaattccaccgagaaatttcttgttctatgatttaatagggccatgtaaattaatttctaatttttacaaattaacacaatgccagatttatttcgcgcatttttaagcgccaaatcattcgtcaaatgtgttatggcaacagatgccgttgtgggaaaccgcctttctggacatggttgcacaggagagggacaaaattggagtaatttgaaatga

SEQ ID NO: 68086 - DNA, 583 bp, Heterodera glycines
  Genomic contig location: Contig_ID=SeqID_39533; Location=213..795; Strand=+
  SCN-specific regions: Sequence locations=1-96,133-232,254-298,330 -347,369-419,441-491,513-583
atggcggacagtgaacgcaaatccgaggctgagttggccaaggcgaaagaagaacttcgccagttgaaactccaagcagccaaagaggcggaggaacagaaaagggagttggaggaggcgcagcgaatggagagggaattgaaagagcgagtgaatcggaagttggccaaactgagggcattggaagagatttgatggaaaagttgggcattttactttgattacttacacttttgattttactgtacttacatttttttatatttccttaaaaattctgaaaaacagtgaattgcaattgaaattcaaaataatatttatttgtattagattcgtgttttaaattggttttacaaatacagaaacatgcataaatatccgtttggtaatgcaaaaggcgtcacccgcagctccgctcgttcgaatgcgaatcctccaagtgcagcgaccgaatggttccaccgcaaattcggcgctgccattcaactttcggagcgaaagaaaaagtaaagtcggcttacaatcaacaaaatcaaattggtttttaattttagcgaatgcgaacgcaaacaaaaaaagcaaa

SEQ ID NO: 68087 - DNA, 794 bp, Heterodera glycines
  misc_feature (726)..(726): n is a, c, g, or t
  misc_feature (746)..(746): n is a, c, g, or t
  Genomic contig location: Contig_ID=SeqID_39535; Location=305..1098; Strand=+
  SCN-specific regions: Sequence locations=1-146,169-412,435-440,485 -640,665-768,790-794
ctgctggcaactcactcagattttttccgtgctttattttttggtccaaatgcagatgaaaacccaaaaattgtgatcgatgacgagggtgaaaatgccgtggcaaattttgaacggacaatttcaatgctgagttcacccgatgcagaattggatggtaaataaaatcggaacattcatttattatattttaatgaactaattgaatgtaagaaaaaatgaccatgtttttgggttagagttggataatctcttccagttttggttttttgggttttaaaagcccgaaaatctttttgcatttaccaaaattttgattgaaatgcaatcaatgcaaaatgcaaaaaataagatcttaaatgactttttctaaactaaaaattcatgaaaaatcaaaaaaaaattgagtaaggaaaattttcattttatgcttttctaagattaaaaaaataaaataataattattaaaaaaataaataaatttcagatgactatgtggaaaatgttcttctgttggccaaccgttttctgtttgattccattgagaatcgttgcgtcaattttcttatgaacgatagccaaaagccgaaaattttcaagtttcgattggctaatcagtgtgccatcattggcatgaaggtgaaaaattggactaataaaataaagtcaagaaaagaacggcagctaatcaaacacgcttcccccctcatttcggccattttttanataggagaaaattccattanatcaaaaattgcaaagattcctgccaatttgtcataatgtataaaata

SEQ ID NO: 68088 - DNA, 729 bp, Heterodera glycines
  Genomic contig location: Contig_ID=SeqID_39539; Location=17..745; Strand=-
  SCN-specific regions: Sequence locations=1-59,166-690,719-729
atggcaaaggacggcggagggagcagcggaaattggagcagtacggcacggtcatcgtcagaagaagccgaaaagggagaaaaggaagacgaagaagaaaaagaagaagcaatgggtgaagaagaaaggcaaagagaaaaaggaaaaagggaaggacaaaaagaaatgggaaaagcaatgggaaacggaagccaaacggagcaaattgggacaacagaaatgggaacagcagcagaaggacagacggagcaaaactgtgagagcagcgacgcacaacgccatgccaatgttgcggtgttcgttttgggtgcgtatgccacaacccccgctagtcaaacataatacccggggtttaatttgatcattctgatcattcctgcactaatcagggtctcctggctgatcagcattccattccaattttggcttttcctgtcgttgatcataattcgatttcccctcaatgccttcattctcagtccctttcctgattgattgattatttcgctgttcctctctcactctctctgctgatcactgatcagtcccttccaattccaatcccttttcagtcatcgtttttattgtggtcggtgtgctgttgacggcgtttttgtgctgtcgtcaacttgtcacgcctttaccccctgacaatcgctgctcataaaagacaaattctcggccaatttctggcaaaaagaacagaaaaaagtcatgggataaattaaa

SEQ ID NO: 68089 - DNA, 276 bp, Heterodera glycines
  Genomic contig location: Contig_ID=SeqID_39539; Location=1..276; Strand=+
  SCN-specific regions: Sequence locations=1-27,56-276
ccattgaaacggcacttttaatttatcccatgacttttttctgttctttttgccagaaattggccgagaatttgtcttttatgagcagcgattgtcagggggtaaaggcgtgacaagttgacgacagcacaaaaacgccgtcaacagcacaccgaccacaataaaaacgatgactgaaaagggattggaattggaagggactgatcagtgatcagcagagagagtgagagaggaacagcgaaataatcaatcaatcaggaaagggactgagaatga

SEQ ID NO: 68090 - DNA, 1080 bp, Heterodera glycines
  Genomic contig location: Contig_ID=SeqID_39540; Location=4..1083; Strand=+
  SCN-specific regions: Sequence locations=1-354,384-558,582-609,639 -1080
  Gene Ontology: Mol. function=cation-transporting ATPase activity; Cellular component=integral to membrane; Biological process=mitotic spindle orientation
attaatgcggatgactgttcccatgacgggtctctgtctgtggagaatgtgctttgggccaacacggtgttagcaagcggtacagccattggactggtggtgtacaccgggcgggagacgaggtgagagaaccaaccgatcgaccacttattttttgtacactttttcgctaacattttttggttacatgctgccgataacatttacaatattattcaggtcggtgatgaacacgacattgcccgacagtaaagttggcctgctcgatcgtgaggtgaggcaaatttgcgaggaaaaaagttttagttgaacaaagggcttacaattagctaggggcacaaactgaattgtgtctccaggtccagaaaagaaatacaaaaggttacccgccaaggtttcagaaaacggcagaattttgaaaaaaaaccaggctaggacacggctttaagagtcttactcggaaaatatttctaactaacaaaacgtcttgttttaatcagactccggatcctgatgaattcctctaatccggaagaattaaaacccccaaaaaaaccacaccaaaattgtcatcctttgtcgttaaatgaggtgccttccccctcctgaacaggtgaacaacttgaccaaaattttgttcctgttcgtgctcactttgtccgctgtgatggtgctgatgaagggtcctgaccatctgtggtaccgttatctgatgcgctttgtgctcctcttctcctacatcatcccgatttcgttgcgcgtcaacttggacatcggccaaactgttctactcgtggcaaattgggcgggacaaggccatcgcggagacggttaccattttattttgttgaaaattccgggtttttatggtcgagcgatataattaatgccaagtatccttgtatttggtaattatgtcgatcattattcgaaaaatgttcaattcgtattccgaattttcttaaagtcactttttaggtggtccgaagcagtaccatccctgaagagcttggccgaatctcttttctgctgtccgacaagacgggcacattgacgcgaaatgaaatgcgattcaaaaag

SEQ ID NO: 68091 - DNA, 88 bp, Heterodera glycines
  Genomic contig location: Contig_ID=SeqID_39541; Location=123..210; Strand=-
  SCN-specific regions: Sequence locations=1-88
atggctaagaagcataataaggacggcaacaagcaaaacagtgggtccgacgacgatgaaagcaaaggcagcgacagcagcagcgaaa

SEQ ID NO: 68092 - DNA, 344 bp, Heterodera glycines
  Genomic contig location: Contig_ID=SeqID_39541; Location=424..767; Strand=-
  SCN-specific regions: Sequence locations=1-194,231-273,295-310,332-344
atgaataaaaaggaaagactcagatttttgaaaaattttctagagcaagctagctcggcgatcatttcagtgtaagttagtccttttccggggagtatccctgtaaagtttggtatgcttctgctcaattagcaaaaaataagagtgatcaatctctcagctaaacagttaagcgtaaactttttcccaaagttaaaacgcaattaaatcatttttaaaattttattcacctccgttattgatagaaaagcatcagagaatcttattaacttgtaaataaaatttggtgggtttcagaaccctttgtgaaaaaatatttatgaattaattttgcaaaaaataaa

SEQ ID NO: 68093 - DNA, 2252 bp, Heterodera glycines
  Genomic contig location: Contig_ID=SeqID_8444; Location=760..3011; Strand=-
  SCN-specific regions: Sequence locations=1-487,520-673,710-1053,1090 -1119,1166-1314,1363-1364,1396-1477,1522-1718,1741-1903,1925 -1935,1986-2055,2094-2252
atgttgcgtgcccaacagcaccagcagcacggcttggagacagtgggcgtcgtcactgagactgtcaccgtatcgccacagcctaccgtagaaaccgttatggtagaccaacggcgtccagcggcaatgccaacacacattgtggaccctttttcgtccaccattgttgatgccggcgggccaccgccgatgacacccggcacgcgacaccgcttgcaggagcacggcgtgcacaaagcgcacgacttaaaggtgcgtttgccgaatacagtaatggggccaaaacactagcgcttactgcaaatggttgatttgtaactgggtttggttaaatgtgtaactcaaaaaaagtccctatggttgtcccgacatttgcgcctttgtccaaaatcgggttcaaaattaagtattttcaatccctgacaaatgaaagcttaaatagcattatttaagtgatagagagttgttatgtctgataatttgatagttattaaatttttgaaaaaaattataattattcaaacagctgaattaagtttcctaataaactagaaaactgggttttcttaatttaaatgctgtttaggctatcaaggcttgaaaaaattcaattttgaatccgcttttggacataggcgcaaataccggggctctggtgctaacgagaccaatgtagaaaaatttataatttgtaattggtttttaatttatttcgtaccataactggttttgggggatataagtcccatttaggccgaaaatttgaatttttattggaccataataaattttcaccgtttgtctcaaaaggaaagcccaatccatttgacttaatattcaaatacttttttttcactttttatctttataattattgtattaatttttttgaaaactttctcaattggggaaatggttgtaccgcgtgaactgctcccctcccccctcaatcacaccaaaattcaggaaacgttaccttcaccagtcgaaggacgaggctcagccacaacaacggatcacgaggctgagtcggaaacaccgaggcaagtggagaaattaaaaaataataaataataatttcattaattacaatgtttatgaaacattcgaggttagcggaaaaatttaaaaaaatatagcaattaattataatattcaatttttagttcaaggcattcttcaaaagcaacaacgccgcggctgagcttgaaattccggggcaaagacaaaacggacggcgtttttgagtggggaaaatcgaaactgagcagcaaacattcggtgagaaaagcgaaataattttcatttaaaaggaataattatttaattataataacaattaatttgaacaattatttaattgcaataaaaattggaaaatattttgtctctttgtctcaggtcgtccgtcgtggtaaagaggtggaggtgaagctggacgggctcaagttgggcaaagaagacgttttgcgagtggtaatttaaacaaataattaatttaaaaacttaattaataaatttgccatttttgcttgtaactcctcccgccacgagtgccgccagcgctcaaattgcaggcgaacaacgcgtggcagaaccaactgcagcacaaccgcaagccgttgagattgttcaccgactccgcaagacgggcagcaaaacgtgggagatcagcttcaaaccaacggaggtgaaaatgggcatttgtcaattggaacttaaacacaaattttaaaaatggaacaataaaaatggaacaataaaaatgtgccatattaagacatttaatatttcattatttggaaagaattggttttaggtcattttttaaattccgccagaagtgtttttgtactggtaaaaccaaagaaaaaatttttttttgttaattttcaaaattgttatagaacatttaaacaccgaattataccaagaaactatttaaatgacgaatttttatttcaaaaaatttaaaaggtttctgaacaaatgtgtcattttcaggtcggaacgcacaaagtgttggtgttcgtgaacaacatggtggcattttggaaataatttttagattaaatttaataaatttttaaaatgtttagccccatccccaaactccgttcccaattcgggtttatgatgctggccaaattgtggtggaagacattgtcaccgaagcgactgtcaatgatacggtggaatttactgtggacgctggcagggccggatttggaaacttggagatggccataaag

SEQ ID NO: 68094 - DNA, 896 bp, Heterodera glycines
  Genomic contig location: Contig_ID=SeqID_8444; Location=2263..3158; Strand=+
  SCN-specific regions: Sequence locations=1-40,77-230,263-896
atgggacttatatcccccaaaaccagttatggtacgaaataaattaaaaaccaattacaaattataaatttttctacattggtctcgttagcaccagagccccggtatttgcgcctatgtccaaaagcggattcaaaattgaattttttcaagccttgatagcctaaacagcatttaaattaagaaaacccagttttctagtttattaggaaacttaattcagctgtttgaataattataatttttttcaaaaatttaataactatcaaattatcagacataacaactctctatcacttaaataatgctatttaagctttcatttgtcagggattgaaaatacttaattttgaacccgattttggacaaaggcgcaaatgtcgggacaaccatagggactttttttgagttacacatttaaccaaacccagttacaaatcaaccatttgcagtaagcgctagtgttttggccccattactgtattcggcaaacgcacctttaagtcgtgcgctttgtgcacgccgtgctcctgcaagcggtgtcgcgtgccgggtgtcatcggcggtggcccgccggcatcaacaatggtggacgaaaaagggtccacaatgtgtgttggcattgccgctggacgccgttggtctaccataacggtttctacggtaggctgtggcgatacggtgacagtctcagtgacgacgcccactgtctccaagccgtgctgctggtgctgttgggcacgcaacatttccacagtgcgacgcgctaattgaataacaaattgactaattaaaaattggaaacggaaaaaagggggggaaatggattttttttgaaaagtatggtcatttcttaaaaaaatgtttaaagaagaaagcttttgatatcctttaca

SEQ ID NO: 68095 - DNA, 1175 bp, Heterodera glycines
  Genomic contig location: Contig_ID=SeqID_8444; Location=3468..4642; Strand=-
  SCN-specific regions: Sequence locations=1-186,224-232,255-422,445 -580,602-624,647-846,868-877,922-1144,1166-1175
cggctgtctatggctctccgccgacccctcgcggcgcctccgtgccgctggagcgtggcccgtcctccgcttaccattcgtccgtgtcgccccacgcggacaccgcctcttcttacgcgccttctccgtcatcgccggcgtatattgcgcgcgcggtacgtaaaaaaatgttatcttcaaaatggacaaataaaataattttaatttgaaacacaataattttttgattcatcataaattaaacccttatttattagtacttttatggcatttttaacgaaaattaactaatattttgctttaaatattaaatatcgttattgttttttaattttatcagcattcgcagcacgcgtcgcccgtcgagcagcgtcgccacgatctgtccgctgagcctgtgacgactgccggcgacttgcgcagcacctcactgctgcagtccgcgatgcgacagcgggagaagagtgaaccgccgcgggggctactcggttatacggtaggaggaacttttgtatttttatcaaaagcaattagcaaataaaataacatatagtgacagttaattattggaaaatatgctctttcaaaacatccaaaatctacaaataaaggtggcacagtatgacaaaacaacaaccacaacacatactgtggagcgtcgtatgtccccgttgccacccccacgagagacggtaaattttattcaatcaaattaaaaaattaaaaagcaatttaaatactgttattaattccagcaatttggtggccgtattccatcaccgtcacctaaagctgctgtttcgccaccacacaaatattttggcactgaaactgacgtgaaaaaaccgccgccaccgccgggggttggtttgacatgaatttaatatttattaatttaaaaattcaaattattttaaaaaacgaattttgaggctgactctgaggcggcccaatttgagatgaccagatcagctgaactcactttgctcaaagaacacccatcgaccagtgaacagaaagaggtggacaaatattggtgcactccaaaatatcgctggatgatattttggaccataactttttttaattattaaccaaattaagagaatttccagaattgttcgatagctttatgcttttactattttctgcaaaatttcaaatacgccaaataa

SEQ ID NO: 68096 - DNA, 701 bp, Heterodera glycines
  Genomic contig location: Contig_ID=SeqID_8445; Location=555..1255; Strand=-
  SCN-specific regions: Sequence locations=1-196,222-350,377-552,596 -619,690-701
atggatttgttgtgagttttgtatgggccaatcacaacgttctttttattacttatttttttgtttgctttccgctgaaaatatcgatgagaagaaacaaattgaaaaaccttctcaatttactctttgtggcagaagaattacatccactcattttcataaaagtttttgaatatattttttattcgctcatttctaataaaattttaaattaaatttttcattttcattaatccccccccagcatttagtttatgcaacacattttatttgtttttcttccctccccaattttatttttttatagaataatcagtgccaaggcctcatttgctaggcctccaaatcgcaaaaattgtttttgttttctgaattcgttgaaaatgtcctccggcgatggcctcggccctccgttgtcctccccgcgctatgtgtcccaattgtacgttatccctgcagttgacgcgaccgaggcgggcaagggacagttggaaatttcggtcaaccaaggccaagtgccgaacaacgtgcaaatgcagggtgaatttggccaatatttcaatttattttaaaatgaaaaatttatcatttttatcaaatcctgtttttttgttgcttgaatataataattaattattaattaatgactttttttaatttataaaatttttaattaaattatattttttgcgtttaataaa

SEQ ID NO: 68097 - DNA, 191 bp, Heterodera glycines
  Genomic contig location: Contig_ID=SeqID_39543; Location=192..382; Strand=+
  SCN-specific regions: Sequence locations=1-118,164-191
atgtccatcactgatggacgacctgccgatccgtcgtcaacagctgcacttggggtggtcaccagtgctggaagtggtggaaaacgtgttgtgcaagcaaaacataaccaggtgggcgtaaatttttaaaattttcttattatttttttaaatataaaaaaatctctagtaaatatttatttcaattttga

SEQ ID NO: 68098 - DNA, 494 bp, Heterodera glycines
  Genomic contig location: Contig_ID=SeqID_39546; Location=322..815; Strand=-
  SCN-specific regions: Sequence locations=1-179,203-365,398-494
atgcagaatacttttctcgatttactctttaccaggggctcccataattggaacgtaagcgtaatttttgtaacccagagtctctacggtcgggacattaaaacggcaagagcgaacgcccattatctggttttaatgcgcaacccttcaggacaattacaagtgaggactctagggtcacaactgttcccaaaaagactgaattatttcatggatgcatatcatgatgcgaccaataatcaatttagctatctcatgattaacatgcacccaaattctgatgaggaattcagattatgtagcaaaatttttccagatgagactctggaaatttatttaccaattgaatagtatataagaatatgaatttaaattaaattaaaaatgtataaatttagctccgaagtgaaggagaatacagcattcctaaagaagcttgcctccaccagatcagaacaaaagaagaacgaattaatcgaaaacgctacagctga

SEQ ID NO: 68099 - DNA, 187 bp, Heterodera glycines
  Genomic contig location: Contig_ID=SeqID_39548; Location=1194..1380; Strand=-
  SCN-specific regions: Sequence locations=1-40,64-64,89-187
ttcattctctatacatttagtgtcttatttcatgaacttctatataatttaattttaaataaagaggcaaatttttacagaaaataaatagacgctgactaattagctaacatttataaagaaagtagaaatttgattaaatgcatatacaaaatattacttttttaaaatttgtataaagttccta

SEQ ID NO: 68100 - DNA, 1211 bp, Heterodera glycines
  misc_feature (70)..(70): n is a, c, g, or t
  Genomic contig location: Contig_ID=SeqID_39550; Location=126..1336; Strand=-
  SCN-specific regions: Sequence locations=1-3,49-354,400-489,518 -559,610-712,734-743,780-826,848-1126,1149-1157,1179-1211
atgaattattattatttcatttgtatattttttctaattttattaaatcatcgcaatttcaatgccttcncaagtgtaaatgctgcggttgtaagttgccattttaacaaattagctaatttaaatacttttataatcccattataacaagaatgaagatgacgctttggttgcacttgcgaaaggcccggaacattttgacagattttgcgcaattaacggcttaaccattgatgagaaaaagcaattgttgtctgaaaaatatgaggcacaccttggcactttgtattatctaagaatggattggcatgagattcagcagattacgaaagtaagagcatccgctgacaaatgaatattaatttttaaaaccataaaaaagtttaaaatataaaaaatgagaaaaaaattcgctttcgcaatttaaattttttaatttcctaacgaaattgatttttatattatgataaaaatttcggttcttgcatgttaattttttcaaaatatatatttttttgtttctatttttgtgaaaagtaattatttgattttcgttttcaaaaatagaatttttttatttttgatttattttttaattcaaaattatatgaattgtcgaatattttcatgattttaagcagaaccaattttatgcgccagaatgggaaaggtcacgcaaatttgctttcattctgtacgagtatttgttccgcgaatatgttgctgaatatgtaaaaggttcgaataattttcaataaaaaatttacttaatataattagtagagacctacttttgaggcatatgccttttttcggccctctagtttagatatattaagcataaaaaacaaattttatacttggtttgaggcttctacgtttactttctattatgccttttttgccattttgccgttttggtgcctttttggcgtgtttttccaaaaccattaaaaaaagcagtaaaatcgtgaaattacacccctaagaatgacttgaaaaaatgttcagtaaatacacccttaagaatcgaaaaattttctcaaaaattaatcgttaaaatttcatttttttctttataaaaaagtcttaggtttaaaattttccttattcgaataactattataaaacctttaataatttaaagggccaaaattaagttatttggttaaattttacgttgttttgctcatctaaaaatccttaataaa

SEQ ID NO: 68101 - DNA, 1199 bp, Heterodera glycines
  Genomic contig location: Contig_ID=SeqID_8447; Location=85..1283; Strand=+
  SCN-specific regions: Sequence locations=1-24,48-190,222-248,286 -929,958-1199
atgtcgggcgatgacgaggactttgttgtgatggtttgtctgtttttatgttgcaattcaaaaatataaatacattctagaacacttgccaatcggtgtttgaccaagtcaatcagccgcaacaaatggtggtgcatcaccatcactacgagaagaagaagaagaagggtagcaaaaagaagcgcagttcgtccacctcctcttcatcttcctcttcttccgaggaatcgtccgtttcaaggaggagaaagaaagagaagaagaagagcaaaaaggagaagaagagggaacgaaagcgaaaacactcggacgaattggcggagagttcggcagacgaaggtgagagggattcgggatttacaacaaatagttaaataattgacacgttcaaggacgatcgacgtcaaaaaaacagcccattgtttactccgaattcgaccacaagcgaaacccatggaaattattgcgcaaaaacgagtgggtccacaaaccgatgcacatggtcgtggacacgttcggtgacccggagaatgcgaaatatgacaactcgcaccggtttgtatttgccatttctatttgtgttaactaaaaaaagtacaaaaatttaattctattgctaaatttgttgaaattctttttccattatagttttacatttgttccccttctcagtggcgatgtgcccgactatcgcgcgcccaattcggaggacagtcccttctggcgagttttttccgaactctacaaagggctgctcagtaaccccgagagcggtgcggtgggaaaagaacagcgcgcgttttccgcccgtgtcatgaagcagtggggcaaatgtgcgcccgagcgcgttttccgcaatcgcgccaacgacaaattcgaaaattatgtgaaaatttcgcatgctccgtgtccaccggatgaagaaggggtaaagaacagaaatgggaaaagcgtttttcaacttgcgattttatccccatttttaggcagtctctttgggtgttataaaacatgagatggacccgcagatgctcaacaccattaacattgaagactttgagcacattatgcgcagtcaaaatgcatcgtatgaagaagcgctcgagtcggacgtgcaaacacggtacagcattctacaggcaatggttcttcgagagccggacaatgttgacgcgtggctcaagttcgtggacattcag

SEQ ID NO: 68102 - DNA, 3452 bp, Heterodera glycines
  Genomic contig location: Contig_ID=SeqID_8448; Location=37..3488; Strand=+
  SCN-specific regions: Sequence locations=1-1609,1631-1978,2000 -2987,3013-3067,3089-3388,3410-3452
atgcggcagaatgatcgtgcagtcttcgatttgagaaaaatggtaggcgaaatgtctaacaataaaccaatttaaaaaaatgtttctatgtaaggtattgatggactccgctcggacggagtcgcgacttccactgattgaccattgcatcaaaaaacttgtcgaaattaaaaatggaacaatcaaaaggtgacgtttttcctcctaattgtattgtgatttttcatcatttgctcttttccttcagtcacgcgatgatggaagggactgaacaggtgacgcatttttgtttgaatttatttgagtgtttaaattctgtaacagtttcttgtcgacctgttggtgcaacggtgccgcctccaagtggtcgctggacacgtcgcaaaagctgtggctgtgctgcaggtccgattgacactcaccatacgcttaaattaaaatctagatgtcatattgccaccttattttccaggccttggccgaattccacttcttccgtcccgaggtgtacaaaaacttcaggccggacaccaaacctcacgtgatgcaacaagaattgaagaagggcttcaaaactttttggactagtggactgcctcgaatcggagagccgagcgccaatgggtttttatatcgttaaaagtagcgaaaacccaccaaagttctgtccttaagatggcttcgctttgagagaagtgacgtggactcgcaacatccgaaacatgacgaggcggaagtgttggagcagaaatggagttgcatgcacgaggaggagaaggctttgatggccaagtacaagggccttggcttgtcgtctgtggaaatacgccgtcgcttggagaagtttcgggcaaaagttcgttatcctcagatcatttgcattggcaatggtctcaaatcaaacatgcattaatggtaataaattattcagtggttttggttcccggtgcacttcaaacatgacgacgagaaactttatgaggtgaaattcgttgaactaatttaaaattacgtaaatattgcctaacccaactttcagcacaaagcacgcattgtcagttttgaggagttggagccgttacttttctcattcaatgacaccaactgtgtgaaggatctgatcttcaaactgttgcacatatttggcgttccaattccggatatagtgggtttttttattattcgacagaacattacctaattaatcgtttttcgttcattaaaccgtttgcttttttagtttattgaaacccaagagaatattcttcggcagttttcccgttcttatttccactccaactcaccaatttcgttggatttaaatgggtttagcaaatttattgactgttttgtcactcaaattgcggaatccccaatgatggattcgcctcgcatttacacggcattgatcacatcgtacgcagcaaaatatttcctttttttgttattcccttttttaagaatttcgaattctccgctttccactcaaaagaaatacaacacattgaggcagctcgtcaggggcaaaattcagactttaaaacggcatggaaaggaaacaaaattgagcagagaagtgcaattgtcgctttacctcaccgcctttgaagaggtttttaaatcaatttactgacaaattttcaatttcatgtcgaatattttgatataaattgtttcgtttagatgatcaaaattaaacaagagcacaatgacgagtgtactgacgcaactgatgagtcaaatccgccaattactgagtccgaggagtgcaaaatgtgtttggcggtgttgcgcatgaatttggacgccaaagaccgttccctttgggagattggggagacgggcgacgtggacaaacgcaaggaaaaattggtaagaaaaatcgaaaagaataaagctataaaacccccactcattgtcagttcttcatgcgttttgctgtgtttttggttcgtcaattgcctttttcgacagatccggacgaaagaaagaaggagaaccgagcagtcatagctaggaatggaacaataattgggtatttggccaccaaacgtgaatttttgctcagtctgttctaccacgggcgtgttttgcaggtcacaatcaaattgagtccccttttcaaatgtttttttaggtggcggaaaatgcggagacaaaacaaaaggcatataaaaattttgttgaacgcttatcgcacccggcagcactaattttggacgaccctttgcgttggatcggtgacgaaaatgaattggtgaaactgtgcaaaaaaaaaaagaatttctgttccattttcaggtgttcgaactttgtgcctactacaactatgaatttcccattagtccattagttcgtattagctcttttgtgcgcgttgacagccccttttacacgacgaaactcgccgaattattgaaggaaaggccgtgtgtgcaggagacgcgcattgccattctccaggttctttcattcccatggacaatgtgctcataaccttacttataattaaacgtatatttttttactaatatttaaacgtttgcgttggtttcattattggcttttttccttttcagcacattgtggccacaagtgcattctttacaccgggcgaattgcgcgaacagctcagccaattggtgcagcgttttccgcacaacatcccaattttgcaagcacttctgcgtgttggcagcgattttcacaggcgccgctttttggcacaacatcctggtacaggtgagtgataagagttggacctcaatttgggaaaagcattagcaatggtttggcttaatcagatgatcgttctcgtctgatccgcacctgtggtcgtattttcgccgctcatcatcactacttggccgagcacaaacgatattatgagcagaaattcgacaaccaagcctttcgaactttgctctaccaatatgtgcacctcttacgcaaggctgccgaggaaaattggtcctttttagtgatttgaatatttactttatacaaattaattggaaaagttcaaaattctagtggtagtgcgcttcccgacgactatatttgggttttcttgatgcaacacatcacatcggagaggacaatgttaccaaggcgcgttattgacgaggttctgcagccccacagcttcttttgcgtattaattttcttcttcaggtgtttacaattggccaaggtcgttgcccctggagtaagcagtttctcatggagtcgttgcgcggctgttgcgaccgcaccgacccatcggtgacaatggtaaacgccacaatgaaaacgcatggcatcagtgtgtactgcacggacccggaagtccaactgctgcttgagaagtacagcaataacaacacttttcgccttccaagcaatgatttccacttttctgttttagcgtgtgattttggccttcgtacgaacgacgcattcattgcctgggg

SEQ ID NO: 68103 - DNA, 978 bp, Heterodera glycines
  Genomic contig location: Contig_ID=SeqID_39554; Location=1..978; Strand=+
  SCN-specific regions: Sequence locations=1-52,74-198,323-559,581 -604,626-978
  Gene Ontology: Cellular component=nucleus; Biological process=cell fate commitment
cgagcattataacagatcacatgcgcctttcgttgcagcggcatatggccacggtcggcaagccattggccaagccagcacgtgcaatggccaagcattgaaatggccaaagaaatacgacaggagggcttcgatttgctaagcaaagatttgtgcgccagcagcccatccacaagcagtgcagcaaatgctgctgttcaacaccatcaaaacaacaacaattataacaacaacaaagcacaacagtaccaacagcagcagacaccgcaacagcagacaaatactgtaaatacagtaacaacagcggtgacaacgactacgatgatggagggcgacgcgtggttgatgagcacagtgcaagcggaggacaaactgttacaagcgcacacgaacagggaaaaagtattttccattctgaagacattgcgcgacagacacttggacttcagtggatcagcaacaacaaaacagctggtcaaagtgagcagagaagggaagggtcagatcaggtcaaaaagagatgagcaacaatgaatgataggcaaaagattaccaatacaaaccaaaggggggaaaggaatgtgaaccaattttgggtcgagaatttaaattgaaattattggcacaaagcaaataattaataaccgttattatgcattatttaacataattgtcaggtgctcgtgctgtatgagtgcgaaaaacattatgccaactatgaatggaacggtaacatttttaaaccttttgaaaacgtacaggcaaatggtattttcagatttctgtcttggcgaccgaatcattggcattcttctgcaaatggtcaactgtttgcagtgccggcggtgcccccatttttttctgcctcagatggacctgttgaaaaaccggtcgcccaaatcgctagacgaaagtgctcgagccgtgtgggcattggtccggcaactgatgctgaatggcaaagcattggaacagctt

SEQ ID NO: 68104 - DNA, 270 bp, Heterodera glycines
  Genomic contig location: Contig_ID=SeqID_39559; Location=147..416; Strand=+
  SCN-specific regions: Sequence locations=1-270
gagaattcgcatccacgtttcgaaactattgtcttggacgaaaccgaagatgatggccaccacaacaatcttgtgggtacggattcagacaaagagaatgatgaattggaactttagcgttaaagccctttagatttttttgattactatggttttttgccttttgcgctttttttgttgcaattattcttctttttttataaaatcattccctttccccttggtttatgctcttattgcttctcggtcaaatgatgacctaaacatcaa

SEQ ID NO: 68105 - DNA, 762 bp, Heterodera glycines
  Genomic contig location: Contig_ID=SeqID_8449; Location=2749..3510; Strand=+
  SCN-specific regions: Sequence locations=1-245,267-723
atgccccctaatttgatattcacttctctgcattttaaacgcgcaaaggacggcaccggtgccgtactcgaaacaagcaaagattgggcgcaaaaaatggaagtggagctggtgccaatgaatagcattccatttcagcgcagaatcaaacaattcggcactttggccataacgtaagtttggatgcaaaattttgatcaatttgttaaaattagttagttttttttaacaccggaatgatggcccgttgagcctttctaagttcatttaaaaaaatccgggggctaaaagtgatcaaaatttgctaattttaattaatgttattatgaaaattacggttttgaaaatcaaaaaaaaaatcgctcagttgacacaacccggccttttagtgccttaagaaaatttcgccataaaaaaatttcccgttcagttacattgaccgaactgtcatcgcctttctacacagcattaagcatgtgtttagcctggataactcgcgcagaaattctttgatgggtagggctgggattttatgtgctaaatggccaagaaaaatgtaaaaatatgtactaaaacatgttctattaaaaagtgcaaaaacatttcttaatattagcgacattttctcaattattctcatgccccttaaattttaggcctttgcctaaaaatgcaaatcccgttaaatgttttttaattttaaattttcatgatcttttttgcttatattataattatttaaaaattattttatatatttaa

SEQ ID NO: 68106 - DNA, 306 bp, Heterodera glycines
  Genomic contig location: Contig_ID=SeqID_39563; Location=183..488; Strand=-
  SCN-specific regions: Sequence locations=1-126,148-306
atgacttctttggcgactcaaaatcgggcagagaatgaaaaagcggacgaatggccgcccatcgaattgtgtgctccgaaattgggcattttgtcacagttttccaggtgttcaacgaaaacaacctttgctttctcccatttaataatggtttccttaattgggttattttgctcccatttcagtgtctctgccgattctgtggcgcatgttttggtccgcgagttggccgaacgcgtcgaccgtccatccgccgccgaagtgaacagtttcaagaatgacacggaagtggaatgggttatgcag

SEQ ID NO: 68107 - DNA, 659 bp, Heterodera glycines
  Genomic contig location: Contig_ID=SeqID_39564; Location=182..840; Strand=-
  SCN-specific regions: Sequence locations=1-659
atggaggttgaccatcaatcacttgacagcatttgcgaaaatattttgtcaatttctcgtcatttgggtcttccgctaactgataatctcgacaatgcccatttgtcactcttcaagactaaggttggtaaccgaagcaatgaaagggcggggagaccaataaaataacctctaattgtatttttagctgactgaatttgctaaagaaagcaaaaaacaaaaagccattccgagtttattgcttccgtcgaatttgtcgttgaatgacaacgaatgggccaaatttggacagtacgtcgacttaatgaatgccgattatgcggagagggcattattgctgaagagacgtgccgaagtgaccatcgattcttttctttggtaacgttaattaagtttttaggatggctaatcagaagattggtatattttggtctagatacattaaaacctccccaaaagcaccatcagtgaatgggtccatttcggttgctttttcggaactagcctaaagtaccgctaaactatttgtacttttgagtttaggtcggatcgcgtcaaacaaattgaggacaaaattcgacaggttttggaagtcggcggattcacaaatgttcattttgaccctgtccatgccgacgatgttttggccgctaatttgg

SEQ ID NO: 68108 - DNA, 481 bp, Heterodera glycines
  misc_feature (3)..(3): n is a, c, g, or t
  misc_feature (10)..(10): n is a, c, g, or t
  misc_feature (59)..(59): n is a, c, g, or t
  misc_feature (64)..(64): n is a, c, g, or t
  misc_feature (99)..(99): n is a, c, g, or t
  misc_feature (110)..(110): n is a, c, g, or t
  misc_feature (131)..(131): n is a, c, g, or t
  misc_feature (148)..(148): n is a, c, g, or t
  misc_feature (182)..(182): n is a, c, g, or t
  misc_feature (186)..(186): n is a, c, g, or t
  Genomic contig location: Contig_ID=SeqID_39565; Location=624..1104; Strand=-
  SCN-specific regions: Sequence locations=1-64,369-481
atnatttgtnaaaaaatggtgatttgtgagagagaaaaggtaaaaaaaaattgattatngaagnatattaatttatttaatatttttataattaaatanatttttaaaantaaggtattttaaaataattnaaaaattataatatatntaaaaatgaataaaagagttaaaatattttattnattntataataaaaaataatatttaaaatgttaattaaaaaataatattattgctaaattctttgaaaataaaaaatacataaaaaagcttgaaatttaaaaaaataataccaaattttccaagaaaaaaaaaaactttataaactaaaagaataaataagtttattaaattaataataaaattatgcagcatttatgtaaattaaataaaaagagcaaacatcgccgattaccacgaaccaacaaaattattatttttttcaagctcttacaaatattcaaaaattaaaatcaataaa

SEQ ID NO: 68109 - DNA, 434 bp, Heterodera glycines
  Genomic contig location: Contig_ID=SeqID_39567; Location=564..997; Strand=+
  SCN-specific regions: Sequence locations=1-10,32-346,368-434
atggcaaatgataaaaactctattttattaattaatttgaaaattcaggtcaattcacttcaaatcaaaggaagccgacaacgagtgtttactaacccaaaagattttcgatacaattggactcggattgaggttgattgttatgtgagttggggttttctaattccaaaaatttgtttaattgattaattttacagaaggccgatgcgggcactgtaagcttttggggctacagtaacccggagacaaaggaaatcattcgggtggacgaattacactgtttgacttatgaaactgctggagtgccaaaacggttcaaaagtttgcaagtcgaagaacagccgccgatgaaaaaactgagtccaagtccattcttggccaataatgcttcatcacttatccatgtgttcgtgccatttgttggccatccatga

SEQ ID NO: 68110 - DNA, 59 bp, Heterodera glycines; identical to SEQ ID NO: 55001
  Genomic contig location: Contig_ID=SeqID_39570; Location=154..212; Strand=+
  SCN-specific regions: Sequence locations=1-59

SEQ ID NO: 68111 - DNA, 159 bp, Heterodera glycines
  Genomic contig location: Contig_ID=SeqID_39570; Location=773..931; Strand=+
  SCN-specific regions: Sequence locations=1-19,48-159
ttccaatttttttgacagattttcttgtttatttttatttgaatattagcgctgggagacgacaaaaccaatttccgccctgtcaatagcctaaatggggtgcatccacagtgtgagcgacaaaatgcgaaggcaaggagcaggcaaattgacgaacag

SEQ ID NO: 68112 - DNA, 910 bp, Heterodera glycines
  Genomic contig location: Contig_ID=SeqID_39575; Location=586..1495; Strand=-
  SCN-specific regions: Sequence locations=1-226,248-584,619-910
atgaaggaaaagcagcagcgaacgctcactttggacgagttgggcatcgacatggagcagttcatggaatttgtggaggccatctcaaccacagctatccacaagccaattttaccaaatcgtaaattcattatttgataatttcagcaattattaaacttattctgattatgaaaatggatatcatccatttcgattaatttttaacattgacaccggacatttcttataaaattattattttaaaccaccgagcaaataaattttttttttattcggttttttatcgaatatcaaaatgactgaatggatatgatattcttgagcagtgaccttgaaaaccctcggatataatattggaaaaatttaggaccacaaataattaaaaaagcgctaaattttttattatttccaatttagcaaaaaatgtgctcattctgctcaaattggccgactatttccaagtggattggctgaaatcgcgctgtgaggcgcatctgatcaattgccctgaaattccattgatcgaccgttttttgatgatcgatcactatcgtctcgacaattttaaggcataatttttcaaaaacatttcaattttaaagaaaaatttccccatttagaattattttttgaatttggaggttgacaaattgcgtgcattttacaaggctaaccgcgaccaattgtcgccagggaaaacggctgtctgtgatcaattgttaggggaattggtcaaccgactttgtggatgatttgatattttgcggaaaaaacagtaatcggatttaagggatgaaaatttttgaaaaaggcaccttaaataggcacgaaaaaatgaaaatggcaaaaagagaataagtattaacaaattacggaaaatttttttataagaataagaaaaaataaa

SEQ ID NO: 68113 - DNA, 638 bp, Heterodera glycines
  Genomic contig location: Contig_ID=SeqID_39577; Location=11..648; Strand=+
  SCN-specific regions: Sequence locations=1-244,267-638
gcatttgccaatgcttcatctcctgccaatttcattgccatcatttcgtttccgttgccttttgctgactcagttgtgccatttgcgctgaccaacgaattgactcgcgaacaattggcattgaaagtgattgacaatagccatcgttttctgtttgtccgttgtccaattgcgcgagacgaaagcaaatggacaaaatgggagaaggaagcgattggctggagaatttcttatctatggaacagaattgatattcaaattaattatgagcgtcaaatcggagatgggtaagtgaatgctttctcaaaatttatttaggtatttcatttttgtttttaggcttctcgatgaaattcccggcccaagtgatcagcagcagaagtgaatgaatgaattgttgagaagggatcgatcaatttgaattgcggcgttggataaagaatttgatgttcagaaaattgttctttttttgttgcggtgatcaatttgatctaattgaattatgtaattgccaaatgaatttgatgctattttgacctatgatcataaaaattctttactttttttgttgttggaattatcaacataataatctttgttaagccctaatttgtaaggttaatttagtgtttatttca

SEQ ID NO: 68114 - DNA, 49 bp, Heterodera glycines; identical to SEQ ID NO: 51181
  Genomic contig location: Contig_ID=SeqID_39578; Location=673..721; Strand=-
  SCN-specific regions: Sequence locations=1-49

SEQ ID NO: 68115 - DNA, 294 bp, Heterodera glycines
  Genomic contig location: Contig_ID=SeqID_39580; Location=1045..1338; Strand=-
  SCN-specific regions: Sequence locations=1-138,196-294
gtgattcgattggaggcggaaaatgccattctccgagaacacattccgcgggatgtgcttgacagaatttgcttgccccaccatttccccagcggcgcggcgtccgtcgcctcaattgcccagtgaatttgacatgccaataataataataaaataacatttaatgaaagtgattataaattattgttattattacaataggctttttactttttacttttgtctttgtcagattttttttaccgaaaaaagctttttaattatgcaaaaaaaaacagcaaataaatcatttgt

SEQ ID NO: 68116 - DNA, 116 bp, Heterodera glycines
  Genomic contig location: Contig_ID=SeqID_39580; Location=1414..1529; Strand=-
  SCN-specific regions: Sequence locations=1-116
tgtttttttcaagatttaaatgtttcctacatcaatattcctacggaagtacaaaacttttcgttttctgttttttggggttttcgatttgttgcttcatcgactccgaaataata

SEQ ID NO: 68117 - DNA, 3336 bp, Heterodera glycines
  Genomic contig location: Contig_ID=SeqID_8453; Location=1..3336; Strand=-
  SCN-specific regions: Sequence locations=1-203,225-303,344-809,831 -862,893-1022,1071-1310,1336-1384,1417-1633,1656-2129,2151-2253,2275 -2293,2316-3279,3301-3336
aaattttttttctaaaatcacaaaaagatacaaaatctatatccaccaaatcgtaaaacaaatcgcttacaaatatttttatgcgcatttttaattttattgaataacatttaatgtggcttttatattatttttatgaaaaagaattaatcaccattagagtcgtcccaattttcaaaatcattgcgcataaatctgtattgcaaagatttgagagttaatttgaaaaaaatattattttgtcttttcttgcaatgaaattaactctggctaaagcagacataaatttgattaattttgggcataaaattaaataaaaaatttttttttgttttattaaaatccccaaatgtctagtccccaaatttaacgtctattgcttaatttttacttttgccatcaatttttcttgtgtgcttttctcgcttattaaataacaaaattactaatgtttaatgtgccaaaaaacaggtgaaacgtctaaaaaggccaattatactctgaactcatcagtaaaagaatttttgaccttaattaagtctcaatattatatcatttaattaattatttgattggattcttcatttccttgcatttttttaaatttaattcgcgttgaattgcgccaattttttgattaaataatattccaaataaatcgactaataatatgagtaataacgttaattcatcttcgtccgttaatgaatttggagagtccgaccaaatttacgtgtacaccagtttgggtgacaatcattcagcaaattttgtcactttttggcattgccctaaacagtgccatcgtttacatcaccatcaagcacaagtaaaagagaagatttgaaaattgcataggaattgttttgaattttaattttgttttgactttacttttggatattataaaaatgcatttttaattatgaaattaggaaactccaccgaagtttcggctttctgttggccatctgttctttttgtgatgcactcactgaattggccactccattggctaccggtaaaataattaaataattttatttttattattattttttaaatttttagtcctcgtttttctttgtttacggattcctctgttgacttgtgtttatgcgcaatttattgcaccactttcatgtttagattcttcactaaatttgttttggataagcgttgatagttttgtggcattggcatttcccgttttgtaatttaaaatagtttaattttccagaaaattaatcacttcctttttaagttttcgtaacatctcaacatcatccggaaaatatgtgataattgccaatgtgttttccttgtcaattattttttatgttgtttctttgtcgtttatatttgatctacaacatctcaaatgtaactaattaattaactaattgatcaattaataataaattttaccaattaaaagaatggtttattgtgagcctggcgatatgcttcaaggcgaattttaatcaaaatcattctcccggcctcaaaattccaaaggcagctgctggcggaatggaacaaaaaacgggcccacatcaagcaaagtgggaagtggcaacacctgaacattcgaccatcgctcagtccggcagaactggaggagcgcagggcgatgcaaaaagaatgcacagagcgaaggaaggccgaacccaacgccgattggatcatttacgccggaaacttagacttagttttgccggcaaatgatcaaattgtaaagcaatgtactattgaaggtggtgttttttcatcggatcatttagcgcaaattttcacattgactattccaaaaacactacaaaaaacaaacttcttttacaatcgacggttttttccgtcgaatgtttctctttttaatattatggtttcttctagaattagcgctttatctaacgagcattttagtgtgaacgaaaaatacaacgcctttaataatacattgctagaaaccttaaacgagtgtattccaatgaaaaaaattaccaaaaaagatttgacccctaaatatccaacgcatttattggcctccatcaaagagaaagccagactgtataggcaatgtaaaactgacccaacaaaaaaagcactttatgatagcattagtttacacataaaaatacaaacaaataaatttcactcgcaaattgagaaaaaggctatttcaaagggaagaaattccatttttaaatacctacaaaaatacgatgttaatccctttgaaataccgaatttagtctttgaaaacaaatgctatcatgatggtgatgaaaaatgtgaattatttgccaacttatttgcaaattcgtttaacaattctgatgttgacccaggctacctaaacttgggcaatacttttgttaatcaatgctttatatcagatatagactttaacatcatcgagacacaaaaacttttgaaaaaacttccgaataaaaacgggacctccccggataatattagctataaaatattgaaaaactgccattcttcattagcaactgttattactgacctattcaggatttcattagactctggttctcttccagatatctggaaggaatcaatagtttttcctcttttcaaaaaaggggacaaatttaatcctgaaaattataggcctatttctataacctgctcactttgcagggttatggaaagaattcttagccaaaatatttacaacttcctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaatttcaaatttgtcattctttcaaatttgtcattctttcaaatttgtcattctttcaaatttgtcattctttcaaatttgtcattctttcaaatttgtcattctttcaaatttgtcattctttcaaaaataaaattatatgctgatgatgttaaattatatatttgttaaagagcaagaaccgacacagaaattatgcataaagcat

SEQ ID NO: 68118 - DNA, 423 bp, Heterodera glycines
  Genomic contig location: Contig_ID=SeqID_39583; Location=8..430; Strand=-
  SCN-specific regions: Sequence locations=1-5,27-280,302-423
atggaacagcaggagccaatctccgctgaagtaagttttatgttgccaattttacttgtgcattgtaaaatttcgtctttatcaaataaataagaaatttattaagatgttgcgtttccatgccgcaattgaactggttaaacaacgtgttgccgttgcgaacctttctggcgtccgtcttgtgcggctgtttcatcgtacgttacagacctaatcatgattcatgatcagaattttacaaaatatataattattagggatgtgaattttagtgactaaaaacttcaattttgctcaagttgattttggtaatttggttcaggatcaccagaattgctggaaattttgcatgaaaatactttaaaatgattcctatcaccctgcaaaatttcagagtttttcatattggtaaaacttttttag

SEQ ID NO: 68119 - DNA, 1013 bp, Heterodera glycines
  Genomic contig location: Contig_ID=SeqID_39584; Location=91..1103; Strand=-
  SCN-specific regions: Sequence locations=1-84,106-118,140-311,333 -960,983-1013
atggatttgttttgtggtaccgaattggcatttagcaattcctattttggaccgacacgacactcgcgcattatcaaaattagttcaggtgaacagtgtgcttttcctttctccaaattggtttgtttacctttttcagatacccctgtccgttcgttgaccaccgccgaaattccgccatccgccggctcattttcaagcagtgatggcggtcttcagagtcgcttcattttatggcatgcattttcacactggccaaccgactaaatctttttgtgccaaaaccactatgtccttggggttaaatttccaattttttaaactaatttttgaccgattgtcttactaatagaattctctttcatcaatactcaaaatgtcaatttttaaggcgtgccgaaggagcgaatttattcctcaatgaatactctgttgaccgcgatttgattgacgcgtcgctatgcattaatttttcacaatcactggttcgatatttttaatgcatttttctatttaattgagccaggaaattgactcaatattcaaagttcgaacacaattcaagttggattcaaaaaaagaatccctccaatggttgaaagaaaaaagtataattttatagatggtggccgggagagctacaaaaacggaaaagcgcctaaatttgggtccaattgcgaacaccttttcccttcgttaagctgatcccgggcacccaactgtgcattgtgcgccgcaagttgctgcttttggctgtgcccactcagtccggcatccaccgcttctacgtgcatttggcacggcaccaggacgattcgctggtcagacttacttacccatttgtcagatttgttcgaaattgtccatccaaacatgaaattcaatggattacgtattcttggagaatttggcacttattttttcgattaaaaaactgcatttcaaattcacagcaaaaaacaaaacttgttattagtttgaatttagcttcctccgaatttttcggaaataaa

SEQ ID NO: 68120 - DNA, 900 bp, Heterodera glycines
  misc_feature (695)..(695): n is a, c, g, or t
  Genomic contig location: Contig_ID=SeqID_39585; Location=9..908; Strand=+
  SCN-specific regions: Sequence locations=1-618,640-900
atgcaatctgagcaccagccaacatttacggcacaagcaatgccatttgagtaccaaacacaagcaatggcacctgagcaccagccaacatttacggcacaagcaatgccatttgagtaccaaacacaagcaatggcacctgagcaccagccaacatttacggcacaagcaatgccatttgagcatcagccaacatttacggcagaagcaattccatttaagcaactgacacaaacaatgcaatctgagcaccagccaacatttacggcacaagcaatgccatttgagcatcagccaacatttacggcagaagcaattccatttaagcaactgacacaaacaatacaatctgagcaccagccaacaacatttacggcacaagcaatgccatttgagcatcagccaacatttacggcacaagcaatgccatttgagcatcagccaacatttacggcagaagcaattccatttaagcaactgacacaaacaatacaatctgagcaccagccaacaacatttacggcacaagcaatgccatttgagcgccagacacaagtaatgccatctgagcaccagccaatatttacggcagaatcaattccatttgagcaccagccaacatttgcagcagaagcagtgccatttgagcaccaaacacaaggagggcaaactgagtaccaaaatcaaccaacatntacggcacaaacaatgccatttgagcaccgaactcaaacaacttttatcaagcaagcaaatcttattaggtaccaatcacaaccagccgaaaattgcaactcaagttcgcctccgccagttttctggcattatgaaactgacaatgatcttaatgggatttttgccccataaaatgacgtttatgaaaaattccgaaagatttaa

SEQ ID NO: 68121 - DNA, 1012 bp, Heterodera glycines
  Genomic contig location: Contig_ID=SeqID_39589; Location=575..1586; Strand=-
  SCN-specific regions: Sequence locations=1-36,85-87,109-224,297 -313,372-412,439-486,508-598,655-858,881-1012
  Gene Ontology: Biological process=synaptic vesicle maturation
tgaaaaaggctcgtcttcaaggcacaatcggttagcaaattaaataatttaaataaattaaattattaaaaaaaaattaaaaatgccaaaattaaattttctaaaattcttttccagaagatttccatgcctatgtgacgttaaaattacaaaatgtgaagtcaacaacaatcgctgtcaaaggcaatcagccgcaatgggagcaggaatttgtgttgtaagagaatataaataaaataaataaaatttattaaaattgaatttatttttaatttaattttatatcaaaaaatttactctgatgactcatccatccatttatttcattttttattgcttaatttatttcaatgtatgtgaattgaacaaaaattaacttaatatagagtgaattaaaattctgccgttaatttaaaaaggaattatttggcacaaagtgcccgccactgacatatgccgtcctgacggaccggcctagtatggcacctctgattttattttactttactcacaaatttttttttcccatttaaacgtttataataaattattcaatgagttatgtgcataattattataattgcctcattaggcatgcaattaatttttcatttagtttttttgataataattttttcaaattttaattttatacattcatcactccgcctgttttggcaccattttcggggatattttcggcccggcatttgaccccgactcgggtcgaacgttgtgccgggattgggcaaaggttccccaagaattaatggcaccaaatttgccaaatcctattggatttgttgtgttagctctgatcactctgatcatttttgtttgccatttcagtgaaactgatcagctggaccagggcctggtacttgagctgtggaacaagggcgtgttgtgggacaaactgctcggtgttcacttcttgccacttcgtcagattggctatgcccaagaggcggggcccggccgatggctccagggcaagaaaaaaatgccataa

SEQ ID NO: 68122 - DNA, 229 bp, Heterodera glycines
  misc_feature (8)..(8): n is a, c, g, or t
  misc_feature (15)..(15): n is a, c, g, or t
  misc_feature (32)..(32): n is a, c, g, or t
  misc_feature (35)..(35): n is a, c, g, or t
  Genomic contig location: Contig_ID=SeqID_39591; Location=603..831; Strand=-
  SCN-specific regions: Sequence locations=1-61,128-131,156-229
atggctanacatganatcttagatcatttagntanaatgatttccttttattataaatgggaaaaatagatattaaattataaattaaaaaataaaaatgtatataatttaaaaaaaaactaaatttggcacagccacaaaaaatatttttagaacagataaactattacaaaaactaatgatgcaatataaagagtttaataattctttataatatgaaaataataaa

SEQ ID NO: 68123 - DNA, 430 bp, Heterodera glycines
  Genomic contig location: Contig_ID=SeqID_8454; Location=48..477; Strand=+
  SCN-specific regions: Sequence locations=1-76,109-143,165-403,429-430
atgtcggatgaactaagtatagaaactttagttaatggaatgaagtacggaccaaaaactggtaaggaatcattgcaataaaattaacaataaaataaaattataaatggaatgtgaaaatttaatatgaatttaaatttagacccaaacttttgtgaaaattttaaaagggcgtatgcagaatattcaaaaacaatgaaagataaccaaattgcggcacaaatttacaaagtctgccagtctaaaattagttattggaaaaagatatgcggaattgagtttaaactaaagaaaaagatgacgaacaattaaaaaagcattgactttcgctatcgtgataaattatttgtaaaaaaagatttgtttttaggggtaattagaatattgcatgctttggtttttgtaaaaaaaatttaaaaaaaatttttca

SEQ ID NO: 68124 - DNA, 925 bp, Heterodera glycines
  Genomic contig location: Contig_ID=SeqID_8454; Location=873..1797; Strand=+
  SCN-specific regions: Sequence locations=1-393,433-486,508-699,728-925
atgttcttctttatattcgattttgattttttgggtttttgtttgactttccttttcactgcgcaaaaacttctattcattccattgttattctatgtttgtcataaagggaagaatgaaaagatatgtgttgtattcagaaaatcctgtatttatttgtcatttttattgggatttatttattcaattattttgggatgttttttattgttattaattttattgtatggcacttgagaaagaaattggcagaaaaaattgtttttgttacaccaaaaattggaagtatttaagggcatggaactgttgttgtggcacattcgaaacatttttcaacagcaaattccatctcgaaaattcaattaattccattctaaaatggcttcatcatcgattaaattgtaaattttcttttattaattacccaattattaaaaacccctttagggtttcggtttcaatgtttctgctcgtcctttgcattggcatggccattgagcagacccaagcttattatgtacaaaatattttcaaaattccccttctcgttcttaaaactttcattttttcattttctttttaagggctggggtggctacggctatgtctatccttacggattttatggcaaacggcaagccggttttggtccatccgaaaatgctggcacttttggtggcggtggagaaggaaattccaacggaggaggaagaagaggaggaggaccatcatcaccaaacaatttttgagagaaaaaaggaattacaaaaccaaaattgagcttttcccattttgtaattgatgatcaatcggataaaaaaaatggccaaaagaattttctatttattttttgccaattattaataattttatgcatttttgcaatatgaatatttttaaatgaagcttcaaaacaagaagaaga

SEQ ID NO: 68125 - DNA, 860 bp, Heterodera glycines
  Genomic contig location: Contig_ID=SeqID_8454; Location=2184..3043; Strand=-
  SCN-specific regions: Sequence locations=1-214,237-240,278-367,390 -431,459-503,535-666,710-860
atggaggacatttacggtggcaattggggtgttttgattataaaagagcctgatttgatttccaccataatccactggacatttcctgaccatcggtatgtgttatggtaggatgtgggcgggcgagggggttaaaattagagtagagcgggaccgggaattttgagcaaaaccgggaccgggacgggacctcgatttttgtccgggaccgggcccgggacctgagcttttcaaaatcctggacctcggatgaccgggaattcccggcccggtcccggtcccgctctactctatttaaaatacatcttaaagcctaatcgacattattctttgactcgatgttttaataaaattgtaactaaaatgctttttaaattgaataaacaaaattacgaaactttataaatttttcctgcgaaaaatttttcaatatttaatttgaaaatgaatttaaagttaaggacagaggtttaacttgttgttgaaataagttttagcatctcattttatttgttattatattttaaatttaaagccatcgtgatggttctgctgctttttgccttcaagttgaaaatggttggcaatataatgtgttcaaaactggggacattgacactgaagaccgtttaactgttgagaaagtgatggagcaaataaatcggcaaattaactaattaaaataattaatttaaaaaaataataattaggcgaaatgtttcacatccatcgtcaactcaaaaatctgcacaaatacgagcaaaatttggcaatgtgttgaagaaggacagcagattcacaaattcattgcttattcaacgaaattagacagccacaatttattgaaccaacaaaataaa

SEQ ID NO: 68126 - DNA, 603 bp, Heterodera glycines
  Genomic contig location: Contig_ID=SeqID_8455; Location=82..684; Strand=+
  SCN-specific regions: Sequence locations=1-132,154-199,254-350,372 -548,595-603
atgtttgcgaactgttgcacattgttactcataaatacatcggcgctgactgcgcactgcgcccgggcgaacgtttggtggtggtggacaacggagacaaggattggaagcacaggttcaaggagtataaaattttaaattttaaggatttttaatagttattgaaggctcattttatgagttgtctctaaaattgctcatttttataattgataaaacaaaattataaattaaaaaacatatataataattagggttcgaagttgtatgattaaaaatgctcactagccattgttttggtgttttaaaagtcaattcttaatttaaacacaatttttggcattttttgagggttaaaagccattttgggtaatttttaaggcatattttactgcatatttggggtttttagggcatatttgggggatttttagtgcatattttatgcgcatgtttggcattttttagtgcatacaacttcgaaccctaataataattgggtttattgtatttttcccgcttattgagtctattcatgatacggagtgaaaatttttaaataacaaaaattttgttaattaaaaaaatattttagctgaatga

SEQ ID NO: 68127 - DNA, 289 bp, Heterodera glycines
  Genomic contig location: Contig_ID=SeqID_39593; Location=15..303; Strand=+
  SCN-specific regions: Sequence locations=1-149,197-289
aaatttttaaaaattttccagcaaataatggaaatttttttcgaattcccccccccccctcccaaacgaaaattaaaaagtttaataggcaaatttcgtaacaagtagcactcaaatttccaaaaatgtttcccggcggcgcctatcggcaccgccggacctccattttccactatttttacaagttttttgccttaaaacggccaaaattgggtcatttttagtgaaaaagtgcagttgttacccagcagtggaaaaaaaagttattggttaaatagcaaaaaaaaaa

SEQ ID NO: 68128 - DNA, 785 bp, Heterodera glycines; identical to SEQ ID NO: 39595
  Genomic contig location: Contig_ID=SeqID_39595; Location=1..785; Strand=+
  SCN-specific regions: Sequence locations=1-431,454-785
  Gene Ontology: Mol. function=signal transducer activity; Cellular component=cytoplasm; Biological process=cell-matrix adhesion

SEQ ID NO: 68129 - DNA, 447 bp, Heterodera glycines
  Genomic contig location: Contig_ID=SeqID_39597; Location=581..1027; Strand=+
  SCN-specific regions: Sequence locations=1-77,99-356,389-411,434-447
atgagccatgaactaagccgagagttcatcaaagacattgacgaatggatagcgcagttgtacgagtgcaagcagctcagcgagacacaagtgcgactgctctgtgacaaggttggccatttcaaatttggtcaatggaaaattgccgtaatgtcccgaaatgtaacaaaaattgcgttaccaaaatgccattttttgttgggttggagttgtttacagtgtagagcaactaacttttcttagagacaaccaaattaaacatactttgagatatggttcgatagtcctaaatcttttctattagaaatgaaaaattccaaaaaaaaacatttcgtaaaatttgccaatagtatcacatattttttgaattaatttttattttttaaaagctataaaacacactttttaggggggttttcggtcacaaatttgacatccgtttcatag

SEQ ID NO: 68130 - DNA, 1295 bp, Heterodera glycines; identical to SEQ ID NO: 39601
  Genomic contig location: Contig_ID=SeqID_39601; Location=1..1295; Strand=+
  SCN-specific regions: Sequence locations=1-185,208-466,489-529,552 -846,904-1116,1138-1160,1194-1295

SEQ ID NO: 68131 - DNA, 632 bp, Heterodera glycines
  Genomic contig location: Contig_ID=SeqID_39602; Location=25..656; Strand=-
  SCN-specific regions: Sequence locations=1-327,349-388,411-580,609-632
atgggaaaagcagattgtgatgtgcttgatgaagaggtcagtaaaaaaacaatggcccaacatggcataaaggcagaggcaaatatttatgtattagtggatggatttgaaattttggtggaatatgaggaggaggaaattgataaatatggtgttgtgaagtggaaatcgaagccctactacatttatttcgtgaatgccaccgccactgtggcaactttgaagcgcaagatcgcggaagagattgacagttttcactctattcgtactatttatgcacatcaactgacaattagacatggtagccattatgacattgcgcttgatgacaacaaaacaatgaaagattatggcattggaagactcggaatcgtttatgcttcgacttttgaatttgaaattttcgttttgcatggtggcaaaccgtacaccatcaagatgaacaatggaaacacggtgcaaacactgaaacaaagaatcaaaagcagaattggcattccgcccgagcgccaaacactgagactcaacaatccatatgccaaagtgcttgaggacaataaagaaacaatggaaaattgtcacattgaaaaagaaacaataattttcttggcgttggatgaatttgaatccat

SEQ ID NO: 68132 - DNA, 673 bp, Heterodera glycines
  Genomic contig location: Contig_ID=SeqID_39605; Location=398..1070; Strand=+
  SCN-specific regions: Sequence locations=1-512,534-579,631-673
atgcatttttcgttgattcaaatgatgatgaccattttcacaaaatgtgccttaattatgggaatgttagaaaattcggaactaattgctgttggcaataaattagtaacaactgtggctcatgaaagccaaatgataccaacgctttctacaactttggtgccggtcaagatccgtgtaaaataccgtgaaagtggcgaaccagggcatgtctatgttacagtaggagattacggtaacaatcattagaatatgttaaatgctcctaaaattcagaatttgatatgacgcggtcaagtgctaggcgtagaaaattgtaagttttggcgcaattttattgtagaaatgtgaatttattcatatcccttcgaattaatgacctgaatacacacaaaaaaaacaactaaatttcggagtttggattggcatttcttgccatccgagtaaattacattttaaaacggatatatttttttataacgagcttagaaaatggactatattactagatagggaatgaaatattttgaaaatattgatttaatacttccgttgacattttttttaccaattatgcccaaaaaattaaaatattgaaaaataatttatttaattcatttttaaaaaaatgtttaagtccaattttatccgttttcccttgaccattccttaa

SEQ ID NO: 68133 - DNA, 597 bp, Heterodera glycines
  Genomic contig location: Contig_ID=SeqID_39606; Location=105..701; Strand=-
  SCN-specific regions: Sequence locations=1-369,409-480,507-597
atgttcacgtataaacatccttgtgactttctgagccctgtttggatggtcccgatgtttttgggaccgccaaaattgtactccatcgcttacccatgttttcattttgcaattgcatttgaacgaatccgttcaacctttttggccaaaagatatgagcgaatgggcacacaatcgactgtaataataatttggataattgtgagttaaatacaataataagtagagcacgactaaaaagtcaccaaaaatgcgaaaaaggcactataataggcaccaaaaatttgaaaaaaaggcattaaaaggcacgaaaatcacgaaaaaggcatgaaaataggcatttaaaatttttttattaaggatttatagggagcaaaacacgtaaaacttaatcaaaaaattcatttttggtcatttaaatgattattaatattgctttttcgaataagaaaagttttacacctaaaatttttatcaaaaatatatatatatatatatatatatatcaaattttgtcgatcaatatttgaaaaaaaatgccaaaaaatgcatttaaggcacgaaaatcccgaaagaggcaaaaaaaggcataataaa

SEQ ID NO: 68134 - DNA, 304 bp, Heterodera glycines
  Genomic contig location: Contig_ID=SeqID_39609; Location=55..358; Strand=-
  SCN-specific regions: Sequence locations=1-304
aaaattccctcaaaaataaaaggtatattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 68135 - DNA, 304 bp, Heterodera glycines
  Genomic contig location: Contig_ID=SeqID_39609; Location=435..738; Strand=-
  SCN-specific regions: Sequence locations=1-304
aaaattccctcaaaaataaaaggtaaattgcgcaccgccctccctatcatgctcgagagcatttgtatgtgtataaaatttatcaaaaaaagagatagccatttttctgggataacgtctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 68136 - DNA, 1992 bp, Heterodera glycines
  Genomic contig location: Contig_ID=SeqID_8457; Location=1855..3846; Strand=-
  SCN-specific regions: Sequence locations=1-246,268-385,407-504,539 -637,659-1403,1427-1944,1969-1992
atggtggctaaaagccgtggctgggcaagttggaagttccgccgctacgtgcacagccaacacggtcaacagggctgtcttcaaagggatgctttgcaacttatgcaacaaattggcgcacggcctggacttaatgcgtatgatgctgaaattgttgtgccccgagtggtggatcattggaacaacagccagcaacgacatcgttttgctgtgtttatttttggatcaactggtcagtacaagccgctgtacaaatacatcaacaactattacgacacaccaatctcactctacctaaacaacggccattttgatggtgtgcagaaggagtatggcttatttggacaacactactgcctagaatgtgagaagccataccagcgaccatcaagacatccaaattcttgtaaagcttgagatccaatttttgtgcagagtcaaaacaatgcaaagagtgcggagttatttggaatgttcgtgacaacaaccgtaatggaagaaaagtaaaataatttaaaaatttttaaaaaaaataattcttttagggtcaccaatgccacgagacgtattgccaattgtgcaacacttaccacaatcccgagcggggctgtttcatccaatcaattgagccgaaggaacaagacccttacagcattgtggcctttgacttggagactatgcaacaccaagcgttggacccccaacaacctgaaaagaaggaacatcagccaaacttcattgctgcccgggttgcatgccccgactgcattcaaaacggcaaatggaagagggcaactgcaggatgtcaaatatgtgggccacgtcggaccgttgtgttctgtcaacaccgattcatggacacacaagtggacaagcaagtgatcgctgagaacccgcttgagccattcgtgaattggctcgtgtttgaactgccaaaaaaatgcgacacctatgcctactcgcattttggcggtcgcttcgacatggtgcttgttttcctcgagctgttccggattggctttaaccccgaaatgctgcgacgggtactcaattacgaatttgtgtcaaaaatttaaattttcagggaaataaaatgtacgaaatgaaagtgaggaagcagaaaaggcgcaacccaaacatagtattccgggattcgttcaacctgataccgtgttcgttagctgcgctcatcccttcttatggtcttgacgtggaggacaagcccttcttcccgcatttggccaatagaccagaaaactacggcagagaaattcacccaatgccggacgactatttggcaaacggtatgatgcccgggaagaggcgccaattcgacgagtggtactccgagcaccgtcatgagccttttaggctcgatgaggcgcttgccaggtaaaagctatttttaaaatgtataaattaagtgcgcctatttcagttattgcacgaatgatttcgagattctgatcgctgcccttgtcgcattccgtcggtaattctttgagatttcgcgtcgccaggagtacgtggacgggatcgacgacagagagaaccatgatggcatcgacgtactgcgtgagtgcatgaccatcgccggcgcgtgcatgcgacactttcgcactaaccatctgccggacgaccatcttgccatcgtctcagagcgcggttacgacaacgctcaaaatcaaagccttctcgccttacggttcttccactggtactcggaggagtaggtgtggaagtgcagaccgcccattctgctggaggagagaagcgaatcggcccctactcggttgacggatggattgaggcagagggacgtgcaattgaagtgcacggtattgattattattgttattgcataaaaaatcaatattttagggctgtacatggcacggatgcaagaaatgttatccaatcgataacatgttgttgcccaacgggaagacggcggggcaggttttggggacaatatcagctcagactgcctaa

SEQ ID NO: 68137 - DNA, 415 bp, Heterodera glycines
  misc_feature (407)..(407): n is a, c, g, or t
  Genomic contig location: Contig_ID=SeqID_39613; Location=887..1301; Strand=+
  SCN-specific regions: Sequence locations=1-33,56-260,282-415
atgttctcatcggagaacgccaaacgcggctcatttgctaagaaaagtttgaatggaaatgaattggagtccgaggccaacgagggggacgcggaggacattgggaagagtttggaggagcagtcgcatcagttggcactgccacggcttttcaaggcacttctctcttttgagtttgccaattactcccgtctgaacggtaagtacgtatgcatacaattccacgccaatttcaaatgttctccagaatccgaagtcgaccctttgctgctttcctgggatgttctgatgcgtttttttggagatttggacgtcctttcccgggttcgcttttgcgatgccatcgatgtcaaaaccctttccaatgcgttggcccatttgtttaattctctctccgaccccccggngcataaag

SEQ ID NO: 68138 - DNA, 733 bp, Heterodera glycines
  Genomic contig location: Contig_ID=SeqID_39615; Location=4..736; Strand=-
  SCN-specific regions: Sequence locations=1-239,261-355,378-382,405 -680,702-733
atgcacgcgttttgcgctcgagctatttatcatcgggcttgtcaatccaaagcgaaacaacaaagatgctgttttgaacgaataaagggcataggttattttgaagaagtgtcaaaaaacatgcagcaataagcctgcaaaatctaataagtggaaaatacatgagtatagaatttattttcagaaagtgtccacagacttttggaaaaatatatttgcaatttatcaacaattttgagaggtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaataacatcagcaataagcctgcaaaatctaatgagtggaaaatacatgagtatagaatttattttcagaaagtgtcaacagacttttggaaaaatatatttgcaatttatcaacaattttgagaagtgagttagaaatgataatcttcacgattcaagccaattttcgtaatgtaattaaccgcgataaaaacattcgaatcaattaa

SEQ ID NO: 68139 - DNA, 855 bp, Heterodera glycines
  Genomic contig location: Contig_ID=SeqID_39617; Location=101..955; Strand=+
  SCN-specific regions: Sequence locations=1-279,323-451,480-523,565 -603,625-855
agcaaaaaagatcctcatttgtatttggacgtgtccgaagtgcaatggggcaatgtgtacatttttgacttgaacaaaacggaagtgatcgctgttcggccgcgcagagttgcggatgaattgaggaagttggaagagcgggaccaaccaccggtgaagagggagcaaccaaaacgtactcatttttggaatttagtaaaaaaaatattaaaggtgggaggttaatttaccagtcaatcgaaaaattactcccaaaattaagggacaattatatatcagttaatttaataatttttgaatataattaaacaattttttaatagattttggggttatgaatttgcgcgagcattggacaaagttcaattttttaaatgaacataactttatcttgggaaaggtcctaaaatgtacataaattttgaatcaaagaaaataattatgaaattgctttaattatgaaaaattaatttttaattgaacaagctccaagcggggcaatcaaattccaaattaattatggtttaaaaatttttttttttttaaattaactatatttaaaatcagagggtcaaaaatgaacatttttaagcgcaaccgcagccacaaccacaacctcaacctgtgacttttcaaaaaattctgtccggtttggtttggccaaccactgaaaagtacaccctgctggtgtcatcgcgtgattttgatttggatggacgaggatcaccgatcaaacaacgcgccaccaatcccgacccgaccagagccgagacaaactacaagggcacattcgacgtcaaaatggcactgacggaaaggccggaaactttttacgtgtgggtttcaagtgccaag

SEQ ID NO: 68140 - DNA, 98 bp, Heterodera glycines
  Genomic contig location: Contig_ID=SeqID_39618; Location=304..401; Strand=-
  SCN-specific regions: Sequence locations=1-26,73-98
ggctgctaggtccagatcccggttctcggtcccgggttttgaaaagctcaggtcccggtcccggtagggcaaacgggaaccaggaaaatcaagcactg

SEQ ID NO: 68141 - DNA, 1221 bp, Heterodera glycines
  Genomic contig location: Contig_ID=SeqID_39621; Location=136..1356; Strand=-
  SCN-specific regions: Sequence locations=1-237,282-540,562-580,625 -682,710-937,960-1010,1033-1221
atgatttcatttgtattgttagctttgcttgtttgtaagaaaacatttctcctcacagcgactcaattttgggctttctgttcaaataatatgaattttctgtcagtggtctgtgaggagttagtaaccaagtaggtcccatattcggtctaccttacactgtatgttaattttagtgcatttaaaatctaatacctaaatacgtgtggatgtttaatacaatttttaaaagatctctatttttttttaatttaatatttttttatggaaaatataaaaaagaaaaacttaaaggtccggtcgaaatcacactggcgaatcactcaatgtagaaatcaaccctgtcgaaaacatatggcacgtcgaatgaccatttttacctacctaatttatgatttactttgcaatcttaaaaaattgttgaaaactatctttttttgtatgataaaaatattgtcattgagtggactctcgagccttttcttcagattctttgatgtctgattatcctaattaaaaaaccaatgtgcgagtggttaattttctttcttctctcaaactgatggcttctaggcacaggtttaaaaaatattacttaacaaatttaattatcttaaattttttctagattggacacgcctactatttttgatgtgtgttgcgaagttgaagcggcaaaagaatttcaacaaacaaaaacaaaggcatgttttagtaaggatgacattttagtatttttgcccgatggttctgtttggctatcacccaaaccataaaattccctttatctcacatcagataattttttttcgatttcatacagacctaagtaaatacctatcaatttatactatttttaggtactttatcctttggagttttctgatgaaaacattctccgttcaataaaacagttttgcttcccattgaaaaggagtatgaggtaatgaattgatttgttcgtgacatcaaatgagcgattaacttttttagaagcgaaaatgatgctgttcaactcttcacatttgtattaaccgatgcacattctatgcactcttttggattttgcagatttacacctcggactaactcctgtttttgcatcctgaggtgttttaccgttttctttcctcttatatattccattttagtggatttctttgggtcaattttttctacaaacttcttaatacaatttcatttgtgttcaataatggaaat

SEQ ID NO: 68142 - DNA, 655 bp, Heterodera glycines
  Genomic contig location: Contig_ID=SeqID_1119; Location=102..756; Strand=+
  SCN-specific regions: Sequence locations=1-34,85-212,239-611,635-655
atgttatcccaagaagagacaggggatcgattggtaaaaattttaattattatttaaatgttgatttaattctttttatttattcaggagcgaacctctgtatgcggaattgaaggatctgatggtttgtccgggcgatttgcggaaatgtctgtcacacttcggacatcggaaggatcagcgcaacttggtcgtcgacgagctggattggcacgacgacgacgacgacgacgacgacataacagaaggagcttggtgaaagagctatgcttgtttaataaatgtcgaccggaatatctcgcgatgatgcttcgaagaaggaagaaggaaaatatcaaatttataggcgatcggaaaatcgaaactgtacatcttcgacagaatttacaaatttatccggaatcatttactctttttggtgctaatcgtatgtacgcctatcgtggtatgcttggtgtcacggtagagcaacatttatacgctaagcatcgtgtccgtctaaaatttcccaacctcccatgtgttgtacaagatggcggcaacggccatcaaagttatttcccacttgaacttttgaaaatatcttcgttagctatgcaagatgaaactgcttaattatttgttgtattttttaatggctgcaattataaagaaa

SEQ ID NO: 68143 - DNA, 2976 bp, Heterodera glycines
  Genomic contig location: Contig_ID=SeqID_1119; Location=795..3770; Strand=-
  SCN-specific regions: Sequence locations=1-56,78-357,393-659,681 -688,710-839,861-1325,1347-1971,1993-2336,2358-2892,2915-2976
atgcctgaagaagaacagacctatcgtatcatcgtatgggacactgaaacgagacttgaaaaacttgaggacgaagggcagtgtatacacgtggtcaactttctttcagcacgcattacttgtaccgattgctgtgacgcatcagagttagaaacagattgtgaaatttgttgccagaccaatgggacgtttgaacgaaccaaagaatggttgagtaaattgagtaaatttatttttcattaccaaaattcaaataggagtgaagctgatggcgatgagcaacctgttgccgcttttgtcgaatggattttaagggcgtggaacaatcaatacaaaacctacatatgggttagggtgaaaaaaaattatttttaaaattttataaattattaggctcataacgcctcaagatttgatggccattttgcgctaaattatatctgcaaaaccgttaggcgacctgatgtcgttatgaatggactcaagatatacgagtttcgtgttcgacatagtccaaagcattcaatgttaatatggcgtgactcatgtctgattatgccgattccgctcgctgatttaaagacgactttcaaccttgactgcgaagacaaaccgttcttcccgtacgcgttcaacaggagggagaattattgtatacgactggagaaacttcctgatcagaaaatgtatgaacccggctcaatgaaggcggacaaatatgaaaagtttaaaaaatggtacagcgaaaatgaagacactccttttttcttgcctgaacaactccgaacctattgtcataacgacaccgaaattttgctcaaagccttggtgaaatttcgccatattttaattaataaaatcacccaagggtttgatgttctaccgataagttgtacaatagccaggttaatcaatcatacacaacatttgtatttatattccgttaatttacagtgcctgtatgaacatcttcaaggcacaatttatgcaagaggatcagctagcaatggtccccgaacttggatatgaacgtaacgatagagccagcgtaattgcgatcaaatatttggattggagagcaaaaagcgaagggattgatatacaacatgcgggcaacggacgggaaaaacaatggaaaaaatttaaacttgacgggtggattgaaagtcagcaacgatgcattgaagtgatcggctgctattggcacgggtgtgatcgatgtttcaaacctgacgagcagctcgttgacgaaaagacgtgtcaagagctgaatgaaatgacgcaagaccgacttcgtcaacttcgcgagcctgacacggatgggcgcagtctacaggttgaagaaatatgggaatgcgaaataaacgaccagctgaagaaaaaccacgagatgaaagtgtttttcgatgacttggcaaacgaacgtggccctttagaccctagacttgcatattgcggtggacgaacgggtccattacgactttttgctgaagcgtccgcggatgaaaaaatttccgtattcgacattgtctcactatacccatgggtcaactacgacacggcttatccaattggtgttcctacaattattcgtcctagcgcggaggagatgatagtcaactggaccaaacctgaacatctaagttaccagggtctttatcgagttcgtgtcatccctcctcgtggtctacgaataccagttctaccgatgaaaattgatgagagactgctgttcagctgttgccatcgatgtgcggctttgtttcgtaaaagtgtgacacgctgtgcacacaaatgcgaacattcggaacagcagagagccttcactggaaatttcactcatattgaattggaaaaagcgttggaaatgggctacgtcatcgatcgattttggagagcatggcattatgatgaatggagtgatcaggtgttcaaaggatatgttcgccaattcatcaggcttaaggtccgtcattcaacaaatattttattcaaaattattttcacaggtggaatcaagcggatttccagatggcgtggaaacgttagaagaaaagcatcaatatatccgcgagtaccggcgcatatacggagttgatttagaatttgggagtattaaaaagaatccaggactacgattcatcgcaaaattaatgcttaatagtctatggtcagtttaaaaaatttttgtttggcattttagtttatattttttaggggaaaattcagcatgagaaatcagcttggctcgaacaaagtgataacgagaccgcaggagttttatgatctagtgctaaaccatagaatggttaggttttttctacatatattgagttatttttaaaaattaaggaaatatcgtcaataatccccatatccgatgcagctattcgagtgctgtataagccgaagaaaaacttcatcgtagaacatacatcaagcaatattgtcctaagcctttggacaacgagtcgagctaggctgaaactgcttgactatatgctgcaatgttataatacaccgggcaccgagttactatacactgacacagacagtgtaattgttcggcataagcgagaccttgttccagttcacacgggcgagtatttgggtcaaatgagcgaagaatacgccgattacgacattttaacttttgcatgtggcggagcgaaacaatatgcaatgaaaatggtgcataaacagacaaaagcagttaaatttgtgcaaaagattcgaggcattacattcgacgtcaacaattctcaggagcttcagtttgagcattttgtacgcaaagtgatcaactacgggaaagaggatgagcaggagaatgcagtagtcttcaattataataaaatacagccgacaaaagataatcgaattataactaggaaacaaaataaaaaatatttacctgtctgtcagaaaggcattattaatcaaacccttgaggttttaccgtttggatatgaatga

SEQ ID NO: 68144 - DNA, 914 bp, Heterodera glycines
  Genomic contig location: Contig_ID=SeqID_1120; Location=999..1912; Strand=+
  SCN-specific regions: Sequence locations=1-233,255-313,335-356,411 -468,491-582,652-914
atgttcgatgcccttggtggacaaggaagtcgccggaagcgaaaagcctcaactccccacccaaatctttttgatcacgcaccatataaccctttgggtgtgtttgtgttttttttgttgccagtatgccacacatttccggttttttttgggtgtggaattccgattatattatatcctagaaaattatttggtttcggaagtccgatttccgaatagttttcaccatcagtgttcctattttttaaatcagaaatcagtggcatgaaaacaaagatctccgatctttggaagggatataaaaatgatcgtcagaaaataaaaaataaatatactacggaaataggtaattggtgaaaaataataaaatatattaaatttttgatttgaaaaaatattttaattaatttgtatttgagttttttcgtttttaattattatgattttttctccaaatttaactcatacatttaatttaaaaattttttaagaagttttgcaaaacggattggtgccatcgactagcgccgccgcttgggttgggcacgaggaaattggtgataatttggatgattttccatcaaaaattaattttaaaaatataaaaatttaaaaaagataatttgaaaaaattttaaaactttttaaaaactgcctagttggacatcaaccgtcaagtggcgcgcgttattcgccaatatcacccaattattttgaaaaagaataacaacaatttgcggcaatattggcgtcgatgtgatcaatttaatatgtaatgtttcccaatttaatgtgataattagtattttaatatgtgattttttcaatttagtatggtattttagataacttaatgtttaataaacatggtaatggtgtcggtgattgattatatgcataggtaaatgatgtaa

SEQ ID NO: 68145 - DNA, 593 bp, Heterodera glycines
  Genomic contig location: Contig_ID=SeqID_1120; Location=2207..2799; Strand=-
  SCN-specific regions: Sequence locations=1-241,303-390,433-525,548-593
atgtgcaacactcttttttatttgtttttcgccgtcgcttttcttctattcctccctactattggcgcggaggacaagtgggaagtggtcacaaatgctcgccgcgccaattgtaccgcggccggttccaaatgttggaaaccgatcggttatgtccggccactgatctgtctcaaggccgattacgatctcaacttaacagatcagtggccggacatagccgaggaccaccattggtccgataaaaaaatgtatgtaaaaaataaaaaattttaataaaatgaataataaaaaaatattttccatagtttattgctgatcaactggtccgtccttgccattttttttttctggttgatcgggttgaccattttcatcgttttcggtaacaaaattaaaaaaaaaacaaaataaaaatttttataaaattttcagttttcaaaaaaatggccgccccgagacccgcgcctccgacaatcacggcaccgttcgagctctcccatgttttttcgagccagtgaaatgatatttaaaaatttttttttatcatttctcaatcaatcaaatattttataatttttggctataataaa

SEQ ID NO: 68146 - DNA, 2613 bp, Heterodera glycines
  Genomic contig location: Contig_ID=SeqID_8459; Location=232..2844; Strand=-
  SCN-specific regions: Sequence locations=1-31,53-120,168-205,230 -267,289-296,347-355,399-817,879-938,971-1087,1110-1113,1154 -1376,1401-1445,1467-1625,1662-1759,1864-2298,2322-2495,2517-2613
atgagtaatttttggcgagaaacggctttagtgaaaaagccaaaacaccaactaaaattgataaagcccatttttagaaaactgataaaagataaaggtaagcaaattgccgacccaattaatattgatgatgatgaagataaagataaagaagaaactgtagaaaaattcatgaacttaaaagaccgttacacaaagagaaaacaagtaaataaaaatgaaataacaactattttttaaacattttaccggactaaaaatatttgatttttaaagtgcttttataaggttatttcaaataataattttaatataaactaatattaaattaattataataataaatcaggattattcaaaaaagaaagtattttatcgatttatttttgagattttgttaccctaaactttttagtttctgtgccaggagtctgatgatgatgaaccggatgaatgcgaagaatgcaaaaaagtggccaaaatcgatgcgacaattagccaaatgcgggaaacgctgcacggaacgcaacagatcgttgatcagatgattgccagtgcgaacaaaaccgatgcttcttcctccactggtccaaagagcaaaacaaaagcaaggatgatgaagattagcagcgaaagtgccaaaaaatatttgaatatggctggcgacacgatatacatggccatacttggttggtaaagttcggtttccattggaatggcaattaggcaattcattagcactcgggccacgtaaattgcatgtattcagttttcaaatgattattaaggaagggttttcaacagggaactcatatggaaaaatttaaaaaatgtaatatttaaaagcaaactatttaaatattaaaaaatttaaaattgttggtatcatttcctggagcttgcctaattgtttttagtagtttttaaatctcaaaaagttttaaattaaaaaaaattattatttttttttggattttgttgggcattgctttataatggaaaaatcatttttcattttgcagactaatagagctttggagtgatctcaagattatgtgcgaatttttccacttttaatggccaattaataagctgcaaaaactgttactcaactaaaaaatatttttaaatttttaaatttaattaatttttaggcgtttatttgtctttcattgcaatttataatggtgatgacaaattgaatgttttgagtgaaatttcaccacaaatggttgaaggcattggtgatgcattgaacaggcataaaggattggtcaacgacaaattgaaaaaatatgttgacgaaataaaatatcgtcagttgaaagaaaatggacaatttttgccaaaaaatgagctgattaaaaatatggaggtataattataaaatatattttaatgctataaatttcatttttatctcagaaaaaatgcgatttcttttgtaaaaagaaacaataaaaattttacaaaccatatttatttaattcgaaccccccccccacgaattagaacccctccctgaaataaagccctctttcgaggggggcataaaaataaaagccctagggctctaattcaaaatatgggtatttatatttttctgagattcttctaagtcatcgaaatttttaaaaatgtatataaaaaaaaaattttatcttctaaactaaattttgggttatactaactcattttaaaaagataaaattcttaatatctgaaaagtaattttacaaatttcaaaatttatcttccgtaaataaagtttaatttgtttatcaaaatatttaaaatgatttagatttttttaaatattttcaatattattggctttattagaattttatttaatattttttagggttttttacaagctgttgaacaaaaggtgccaaacaaaaaagaattgtttaaaaacatcaatttttacatcaatttgtacgccgacatgaaggtcaatttgacccatcagcaaacccaaatccgaagcttggccatcggcaataatgccaatgcttcgcccgcaaatttggttgacgtgttgaaaagtgttgcggcaattatcgacaaattgttggccaaattccatgtactgctccaaaaggcaaccgacgctgaggaggaagaaagaaggaacccagtgattgttgagatcagctccgactcgtcggcggacgagaaagaatcggccgagaaaaagcacggcgagcaggagaaagattccgacgaaacgttgtcagactgtccaacggacgaactcggtaaaattacaattttatgttgtaggtatactggtaatattatttttttaaatttttggctaatttttatcgaaaaatcggcaatagattgcgattttttatataggacaaaaggtttgttggcattttttgaaaaaaatgccatttccgcaccttttggtctgtctataagttaattttcggtgagatataaccatgagatttaaaacaattttgtaaagccaaaaattatgttaaatgaattatttcagaaatttttttagagtatactcaaaacgttttagccttacaaaaaacgtcactattttatttttacacccttttttggaaaaatgttaaaattttttaa

SEQ ID NO: 68147 - DNA, 273 bp, Heterodera glycines
  Genomic contig location: Contig_ID=SeqID_39628; Location=171..443; Strand=-
  SCN-specific regions: Sequence locations=1-273
atgcagcacattctgttggacattcactttttggactattttttggccaaaacggaaataaatcagcgagaaaatgaacaaaaaattcaaatttacacaattatttatttgcttagagtgaaagcggaacaaaataaggcgaaattggaaagaatggaaagacaacaatcggaggaagagaaaagagcgggaagaaaacagcagaagaagaagaaaggacgaagtgaaagaagtgacgaatgcttacggaaaattggacgaagaattgggaaa

SEQ ID NO: 68148 - DNA, 98 bp, Heterodera glycines
  Genomic contig location: Contig_ID=SeqID_39628; Location=1157..1254; Strand=-
  SCN-specific regions: Sequence locations=1-64,86-98
attggcatggaaaagtgatcagttcgagcagaaaatgtgcaatttcgaaattacacaataaaaaactgatgaaaaattggggtataaagaataaaaaa

SEQ ID NO: 68149 - DNA, 1155 bp, Heterodera glycines
  Genomic contig location: Contig_ID=SeqID_39629; Location=87..1241; Strand=+
  SCN-specific regions: Sequence locations=1-228,253-287,309-674,696 -748,773-1155
atggacgaatcggcgaaaaagacgctaaaacaaattccactgctgaaaacaaatgcagggccacggtaaataaacaaaaagtttacgcattttaaagtccaaaatgagttaggaaagtgacacatgacaaaattcatacagagaccttgccaaaacacttgtttttttttaaattttgggtaggagacagggacgatcatttattgttgttaacccaaatatcggcagatatttaaaaaataataattttttgcttattgccagagacggacccctttggcttgaacggttgaaggaggagtacaacagtttgatcgcgttcattgagcacaacaagcagggcgatgccgactggtttcgacttgagtcgagcgcggatggcactcgatggtcggtgaatttggcatgtaaattggtgatgattgttaactttgttttctcccccccccccctttcttacaaaaatgtttcattttttcatgaaatccttgggtttccgggatcgctgagctcgaaaacgacattgattttgtcggacggatttttcgaatttaattttggtgtgaaagcggtttatataatgctgaaagcatttttcgaagtttagtcatttcagcgatgggctggaattcggaattgttgcacgtaattaaattaatgcggtgttttttttaaatttttggtgccattaaatacgcctgccgtttaacgaacccttgtttttaagtaattgcttggatctcgattgttaaaatgggaaaatggcttttgttggttttatatggcatggaaaacattcaatttttgtttaggttcggcaaatgttggacctaccacaacaaaatcaaatacgaattcgatgtggagttcgacgtgccgattacatacccaaaaactgctccagaaattggtgggtaaatggaaatagaatttaattacttacttctcttctggattttcatattttcagcccttcccgaattggacggaaaaacggcgaaaatgtacaggggaggcaaaatttgtttaagtgcgtttttcattaaaaaaataccgaaaattctattttttctcctcgttttttaggtgatcacttcaagccattgtgggcgaggatggccaatttctctttttttaaacttagaaaaatttaaa

SEQ ID NO: 68150 - DNA, 561 bp, Heterodera glycines
  Genomic contig location: Contig_ID=SeqID_39630; Location=375..935; Strand=+
  SCN-specific regions: Sequence locations=1-177,200-208,234-346,383 -453,475-561
atgaccatgattttgatgtacaccacaatcgccgctgtcgctccatcactctgtccccgccggcgtcatcaaattgttgccatcgccaaagcaacgggggcaccaataaaaatattgatattgggtgagtgggtgaataataattgtaattactaataaaagaattttcggtgcggtaaaaattccattggaaaaattgagaattctcaaaaaaaaaaaaattttttttttttggaaaattaagaagacattactttttttgtaatttttaaactttgcatttaaaattgagacaaaatttgtttgatttcaatcgaaaaatgtggagttttaaaagaaagtctccattaaaaaaaaattttttttaatataatttttaaaacgtataatcactaaaatatgtattattttttagaattcttgacgacaacaacgatgaccaactgttgttcataccaaggacagcagcagcagatggaaatcaacgtcaaagccatcgccttttgctttcgtccaccaccaccagtcagtcgtcctccgtgtccgtctccacctcgttga

SEQ ID NO: 68151 - DNA, 163 bp, Heterodera glycines
  Genomic contig location: Contig_ID=SeqID_39631; Location=12..174; Strand=-
  SCN-specific regions: Sequence locations=1-163
atgcgtttcttcctacctttgcggctgctcattgtcattattttggcgttgtgcatcaatttttgtgacggaatgtttcaagatccctcaacagatctctcgctgagtcagccaggtagaaaaatcagtaaaggttcaatgtatgacaaatttgaatttatcg

SEQ ID NO: 68152 - DNA, 411 bp, Heterodera glycines
  Genomic contig location: Contig_ID=SeqID_8460; Location=907..1317; Strand=-
  SCN-specific regions: Sequence locations=1-24,46-74,96-225,253-411
atgaagagatccgctgctactctttctactgctgctgctgccgctccaaatcagcatgagaataaaattgaacccattccgacacatgtggaagctgagccagatcatgagacaaagggaccgccaacaaaaaagcgcgcggtggaggaccgagatttgtggaaattagcgaagggaaaatatttgcttactacatacctctgcccgggtaaattaacaatagacaattttttattttaattaatattttaagacgactggaaccgattgtatcacaatcagcagaaggtgaagcgcctggacgacgaccgcttttctatcaactttgagctatgtcaggaatgcgtgcgggtcaattgccgagcgactgacttaattgcacccatgaagaaaaagccaaacaatgaatga

SEQ ID NO: 68153 - DNA, 1500 bp, Heterodera glycines
  Genomic contig location: Contig_ID=SeqID_8461; Location=89..1588; Strand=-
  SCN-specific regions: Sequence locations=1-502,545-715,737-1274,1296 -1381,1403-1500
atgtcaaaagtgattaaaagaggtacaacagtgattagaacaggttcaactgtgattagaagaggtgcaaccacggaagggaaaggcacaacagtgattaggagaggtacaacagtgattagaagaggtacaactgtgattagaattccagtacagcattgatgcggctgtggcggacagccgtgagcggggaattcatccaacacacctcggctgcctcatcagtagtccactgtttgcatgaccatcgccggcgcgtgcatgcgacactttcgcactaaccatctgcctgatgaacatctggccatcgtccctgagcgcggttacgacaacgctcaaaatcaaagccttctcgccttacggttcttccactggtactcggaggagtacggggtggaagtgcagaccgcccactctgccggaggagagaagagaatcggcccctactcggttgacggatggattgaggcagaggggcgtgcaattgaagtgcacggtattgattattattgttattccataaaaaatcaatattttaagactgtacttggcacggatgcaagaaatgttatccaatcgataacatgttgttgcccaacggaaagacatcggggcaggtacgcgagcgcgacgcaaagcggatggaatacatccgggcccgagtgaatcgtgtggacgtgtactgggagtgcaaaatcacgtccatagtagagcggagcaaagccatgaggaaatccttcgcgaactacgtggatgacgggccactggtgatcagggacgcatttacgggaggacggaccgggccactgaaattgttgcgcaaagcgggaccgggagagaagatctcctattacgatttcacgtcgttatacccttacataaagtcagttctttttctccatttgacaaataaattgtaaatcttaagcttcaccactcgatatcctgttgggcacccgaaagtgcatgttttaaaccaacaagtgcagtggacaagcgcatcggacaatcctttcccgctggcgctgatcaaagtctgggttgtgccgccccgtaaaattgacgttgcggtgttaacggtcaaagtggacgaccgactgtgctttccgctgtgcatcacctgtgctaaagaatatccaactggaggcgtggactacgactaccactgtcagcacactgatcaacaacgcggatgggtcagcacctgtacatcaattgagctcaacgtcgcgctagacgagggttaccgcgtcacgagggtgttccgcgttctggagtacgaacagagcgacgacaagctattccgcccctacattgcggaattcatggctcaaaaaatccaggcaagcggttttgacagcagcataagaggggacgctgagaaggaagaacaatttgtccgagagtgtgctgagcagtttggcatcaacattgacccggcaaaaatggtggtcaacaaggggaaacggtccctggcaaagctgtgcctgaacaatttat

SEQ ID NO: 68154 - DNA, 443 bp, Heterodera glycines
  Genomic contig location: Contig_ID=SeqID_8462; Location=1007..1449; Strand=+
  SCN-specific regions: Sequence locations=1-40,86-154,176-191,276-443
atggcaacaattaacaccagctcagacgaccaggtaaaagaaattaataattttttaaatttttaaataaaatttaaaaaattaacttttatgcttattttgcttttctgtgcttgatttcaatgctatttaacgaagattttttatatcctatcaaaaacaaaaataaacatagaacgtaattaaaaagctaaataaaatttattatgatttatttgtctctttatttttattttaaattaaaataaaataggaaatcaaattaaataattttactttctcagatttatttggcctaccgtttcgccggtccatccgccgatttgattgtgccggccgttgcattgaatttggttgcgttggttggcattgtgttgaacggcacagttttggtggtcactgtcaaatccaggcaaatgccatggcattttaaaattttttaa

SEQ ID NO: 68155 - DNA, 352 bp, Heterodera glycines
  Genomic contig location: Contig_ID=SeqID_39633; Location=791..1142; Strand=-
  SCN-specific regions: Sequence locations=1-40,70-125,208-214,237 -241,272-352
ggaatcgaaggtgttgtaagcttttttcctttttcacttgtaaatttatttaaattttcaatttttttagctttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcgaattttgccttttttaataaattctcttgtgaaaaggcaaaaaaataggctcttttaaataagcctatttaaattactttaattgctttcctttcgcttacgaccatacca

SEQ ID NO: 68156 - DNA, 245 bp, Heterodera glycines
  Genomic contig location: Contig_ID=SeqID_39639; Location=418..662; Strand=-
  SCN-specific regions: Sequence locations=1-87,109-245
atgggcagcagtgcctccgaatcgccgccaccgccaaaacttgtcgccatccaagacgtaagttcatcggactaaacgttattaaaattgtaaaaattcatttgttctcgagtcaattaacgataatctgtcccatcaattagtgccttcgcttcactttcagttgcccatttacaaggccgagtccgtcccggccgcacgtgctgcacggcccgtcgacaccattggcaggccggccacttttg

SEQ ID NO: 68157 - DNA, 707 bp, Heterodera glycines
  Genomic contig location: Contig_ID=SeqID_39641; Location=82..788; Strand=-
  SCN-specific regions: Sequence locations=1-194,218-342,369-707
atgactattcaagaagtgtacaagtaagttcatttctgaaaaaatttgccatgagtagacgtaacttactttttatttagttaaagattctgggatattgtgagatttactcatattttgtactcgtaaatgcatcaaaattgcttttccatttaaataagatatcgcatttatttactttggggatctggaagtttaaacttaaatatacactatttcgaatattttgctattttagctccccgtgattattagtgcttgttcctagatttgttatttttcgaattaacttcatttttgttcctccctacttgttttttctttggtctaatttctctcttccttctcactgtctctttctcagtccattttgaaaaccaaaccaaattgcaaatattttcgccggcggtgaatactgactgatccactgaagcatcataatttctagatttaaaaattagggcaaaatttccaaaaatgtaaatattgcattcaaaaagctaaattgaaattgataaaagccttctgtttaacactatttttggttcattaatgtgaaatttaggctttagctgccggcccattaaaccaccataaagaaattgccataattattgttcaattggtttcaattttacagagttattgggaagcctccattgtgtctacaaactgctgacgaagacagtgatgaacaaagatggtag

SEQ ID NO: 68158 - DNA, 3718 bp, Heterodera glycines
  Genomic contig location: Contig_ID=SeqID_8463; Location=949..4666; Strand=-
  SCN-specific regions: Sequence locations=1-309,331-1118,1140 -1624,1646-1867,1897-1899,1921-2011,2037-2588,2626-2797,2819 -3155,3191-3718
tttaagaaggaagctgcgattatgtgattccaattgccccctgcatgagtcactgcggagatacgtggtgacatataccagcctataattggtaagaacttatgtgggaccattgtaataaaatttagacattttcagccaaaggcgttggaatccggttatactgtggacagattttatagagcgtggctctaagaagaggagccggatgatttattcaaggcatacgtgcgattatttttgaagctgaaggaggagtcaagcggttttccgaagggagttgagacggaggagcacgataggatatgtggagagaagagtataaggaaaaatatggaatcgacattgaattggctaaagtgaagaagaatccaggattgcggtacataagcaagttgatgctaaatagtttatgggtaagatttagggttttgcgaaagagttttaacttaaaattttagggaaagttttcgatgagaaattgtttgaataagaatgcggtaattgatagggcgtcggaattttataaaattatgtgtgatcataaaattgaattatgtgatattgttgaatattcggaagaggcgattagattgatatacagggacaaggaggactttgtgatggagcacaagtcgagcaacatagtcatcagtttatggtgagttcaaaaaaattataaatttgtatataacctaatttttaggacgacgagtatggcgaggttaaaattattggaattcatgagagaagcggagagccatggcggggagattttgtacacggacacggacagtatttttgttaggcacgatcgggatgtggagccgatcacgacggggaaatatttgggagagatgagcgaggaatacggcggctatgagattgaagaatattgctgtggaggggcgaagcagtacgcactgaagatgagaaacaaacagacgggggagatcgaatacgttatgaagattagagggattacgttcgacgtggacaacaggaaaacattgcactacgatacattcagggagatggttctgaattatgggaaaggggaggtggacccggcattcttcgtctataagaatgattttgggtgagttttttacaaattatttgcttcattaataaatcaatatttaggccgacaagggattcgaaagtggtgacgagggagaagcataaaatgtacaggccggtctgtcagaagggtatcatcgatgaggagcttaatgtgatgccatttggattttgttaattttgtattttattgttgtttttttttgttaaataaagttgaataaaaattaaagtgatattaggactagcggggtggaacggtctaaagtgaaggcccactcctgttagccgtaatatttttataaaaaatccagcagttcaaggggaaaatagcatctatgaccgttattctggtacatagttatacatgggagttgagggaattgtagcttgacacggtgtcttgaatagaggtgctgttcaacagtaactccgaggaaacctcggtaggcaaaaagcctattagaaccgttaaatgcgatgtcatccggtgagataaactgattgtgcctaaggtgtctcgttattagggcgtgtcttctcaaaaatttcaaattttgtttcttccgctgtcgtagaatttctgataattcgtgaggttcgcaatcgttaaaatcgcataaaatttcaacgagagaatacatttttgaacaccagtaggcattttcatattcgttgcaaatccttatataccgttacctcaccgccgtatgatgaatttttaccttttctctttatttttaaaattttgagaactgaaatacagatgaagaccactatcaaatctaaaattgacaaaaaatatacccaaatatttgaacttgaaactttaattttctcaaattctttgaacacgacaaaattaaagaattcactatttgtgtctgccacatatttgggaagtatctcgtttgagtcaaatcgatctttgtatattttcttctctttaattagataaatttgtccctcaattattagtaagtcggtaaatgatgatggcatagatccgatcggtttagtaataatttcggtgccattatgatgtgtccataaattctctattgtactaatgtcaatctcgtctattcgattggcatatgcgggagggaggaccggaccgatgaaattgtttgcgaaatcgaatgagaagaaaaaaattagtgtttatgatattgtgagtctgtatccatcggtgaattatggtacagcttacccgattggttttccgaagattattataccgaagagcgatgagattaatgtaaattggacgagaccggaggatttgaagtttaatggattgtataaagtgagggtccacccgccgcgagggttgcggattccggttcttcagttgaagtgcgatgagagattattattcccgttgtgttggagatgtgcgtcaacatttaagaaggaaactacgagatgtgattacaattgcccccatgatgaggcacagcggagatacgtggcgacatatactagcgttgaattggtaagaacttatgtgggaaaattttaagaaaattttgacattttcaggcaaaggcgttggaatgcggttatactgtggacagattttatagagcgtggcactaagaagaggaggcggataatttattcaagggatacgtgcgattatttttgaagctgaaggaggaggcaagcggtttcccgaagggggttgagacgggggagcagaaggatatgtggagagaagagtataaggaaaaatatggaatcgacattgaattggctaaagtgaagaagaatccagcattgcggtacataagcaagttgatgctaaatagcttatgggtaagatttagggttttgcgaaaattttaacttaaaattttagggaaagttttcgatgagaaattatttgaataagaatgcggtgattgatagggcgtcggaattttataaaattgcgtgtgatcataaaattgaattatgtgatattgttgaatattcggaagaggcgattagattgatatacagggacaaggaggagtttgtgatggagcacaagtcgagcaacatagtcattagtttatggtgagttcaaaaaattttttttaattttttatttaaaatttttcaggacgacgagtatggcgtatgagggaggctgaaagcaacggaggggaaattttgtatacggacactgacagtatttttgttttgcacgatcgggatgtggagccgatcacaacgggaaaatatttgggagagatgagcgaggaatacggcggctatgagattgaagaatattgctgtggaggggcgaagcagtacgcactgaagatgagaagcaagcagacgggggagactgaatatgttatgaaaattagagggattacgttcgattggacaacaggaaaacattgcactacgatacattcagggagatggttttgaattatgggaaaggggaggtagacccggcattcttcgtctacaaaaatgattttgggtacgttttaaaaaaattttgactcattaataacccaatattaaggccaacgcgggattcgaaggtggtgacgaggagaagcacaaaatgtacaagccggtctgccagaaggggataatcgatgaagaacttaatgtgatgccatttggattt

SEQ ID NO: 68159 - DNA, 994 bp, Heterodera glycines
  Genomic contig location: Contig_ID=SeqID_8464; Location=179..1172; Strand=-
  SCN-specific regions: Sequence locations=1-61,83-157,180-480,502 -677,700-870,900-994
ctgaaggaggaggcaagcggtttcccgaagggagttgagacaggggagcagaaggatatgtggagagaagagtataaggaaaaatatggaatcgacattgaattggctaaagtgaagaagaatccaggattgcggtacataagcaagttgatgctaaatagcttatgggtaagaaaattgaaaataaatttacgataggtaattttcactttcggggaaagttttcgatgagaaattgtttgaacaagaatgcggtgattgatagggcgtcggaattttataaaattgcgtgtgatcatcataaaattgaattatgtgatattgttgaatattcggaagaggcgattagattgatatacagggacaaggaggactttgtgatggagcacaagtcgagcaacatagtcatcagtttatggtgagttcaaaaaattataaatttgtatataacctaatttttaggactacgagtatggcgaggttaaaattattggaatttatgagggaggctgaaagcaacggaggggaaattttgtatacggacacggacagtatttttgttttgcacgatcgggatgtggagccgatcacgacggggaaatatttgggagagatgagcgaggaatacggcggctatgagattgaagaatattgctgtggagaggcgaagcagtacgcactgaagatgaggaacaaacagacgggggagatcgaatacgttatgaagattagagggattacgttcgatgtggataataagaagactttacattacgacacattcagggagatggttctgaactatgggaaaggggaggtagacccggcattcttcgtctacaaaaatgattttgggtacgtttttaaaaaattttgactcattaataaaccaatatttaggccaacgagggattcgaaagtggtgacgagggagaagcacaaaatgtacaagccggtctgccagaaggggataatcgatgaagaacttatgtga

SEQ ID NO: 68160 - DNA, 516 bp, Heterodera glycines
  Genomic contig location: Contig_ID=SeqID_39642; Location=434..949; Strand=+
  SCN-specific regions: Sequence locations=1-11,33-103,212-220,320 -356,402-414,448-466,488-516
atgccaacagcacaaccagcagcaacaattcacttacaaaacgttcatgctgctgttgtccgtgctgttgctgctgtacgtttattgtgaatttgtgaaaaggaaattatcatttaaatttaaaaagaattttttatttaatgcaatttattttttttaaattatttcttaaaatgttttttcatttttttaaaataattctattaaaattgaaagaaaatttatttatttctttcaactttttcttttttttattattttttttagctaattttggaattttttttcctcgctaatcttttttttatttaaattttttcaatattttacaaaaaaaaaagtatttaggtaagccatgttgctgttgtggttgtgggtgtggctgctgcggttgttgttgtatgattttttcgcaaaaaattttattaaattaaattaattttttttcatccaaaataggcaacaaatgctgctgctgtccatgttgtggtgggggttgttgcggaggtcaattca

SEQ ID NO: 68161 - DNA, 527 bp, Heterodera glycines
  Genomic contig location: Contig_ID=SeqID_39651; Location=624..1150; Strand=+
  SCN-specific regions: Sequence locations=1-60,82-506
gcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaa

SEQ ID NO: 68162 - DNA, 704 bp, Heterodera glycines
  Genomic contig location: Contig_ID=SeqID_39651; Location=378..1081; Strand=-
  SCN-specific regions: Sequence locations=1-377,399-704
atgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttgtcttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggctttttgaaataaa

SEQ ID NO: 68163 - DNA, 1923 bp, Heterodera glycines
  Genomic contig location: Contig_ID=SeqID_8465; Location=2786..4708; Strand=-
  SCN-specific regions: Sequence locations=1-883,905-971,1010-1136,1159- 1177,1199-1234,1256-1463,1486-1614,1640-1923
atgggcgtctacgaggactatgtgaagtcgctgatcgccatcggactgggcccaaagcgcgagttggagccgcaggcggcgcgaccgcacgcgttcggcaacccattcaagctggacaagaagagcaacctgtacattgcggacgaggtgcggaaattgcaactggggaatgcaacgcttaactcgccggcgctttccttttaggtgggcgaaatgaacgccggtgccagcacttcggcattgccctcctccgatgtgccgtcttcgtcgtcctccaacggaggtggcgcttcaagcggtgggagtgggcgacggcgtcgagcagtgtccgaagttggcaccatggcaacaacggccggtagcgtccgaccgccccgtcgacggcccggcccaatcgacgcaaaccgtttggccatgtggcggttagtggtgccataacatttcggcacaaattcccttttttttttaataggcgccgtcgacgctcctcttcgattgcttcttgtccagacgaagcggtggctgtaactgcggaaacgacagaaggaacatcaacagccaatggtcataaattggggatgaccaaataattagcggaaagaaataatttttgcataaatcgggccgattcattggaatccatccatttgcaacaattattccccaattaccttcccttttttagagtctaacgaaatgccgaccaccactgctttgctgcggacgtcgaccattgacggcacggtggcaaccaacaccctcggcacaccgccaccagcggagacggcgtcaggattcttagacgaagagttggcaccgttgcgcatggcggacgaggaagacgaagaggaaagcgacggcggaattcagtggagggacgaagcagtagcagcaccaacggcagcggacgaaggaccaattgcagtgccggaagaggccgaactgcgctttggcatcgcacaaatcactccggcagcggcgtctcctcctcctccgtcgtcgtcgtcgttgccaccaccctccaacggtgccgctccgtttgcgctggccgagtgccaacttttggagaagcagcgccaaattcgacacattgttcgacagaaaggcccttgttcgtgcacttctttcagcctctatttcctttatttttgagttatttctttcacaaaaagcgcacacaaaagtcggagaaagaaaaaacagagagtgtgttacggtcagacaacgagacatggtacagagagagagaatgtgtgttacagtcagagaacgagagtgcttcgatcagagaagataatacaggaagagaacgagacagtctacaaaagagagagagtgtgttacagtcagcgtaagggacagcgtacaagtagagaaaacgagacattgtcacagttagagaaagaaagttgcagaaagagaacgagacagtaggggtggggtataaataaatctgtatacataaatattttgagaaaacaaattgtaattaaacaaaaagatgccgaactgtgtctcattgttggatcctttcggttttttgcttatcgttacagtaacctaattcactttcactcattttacggtattctctcttcctccataataatccatgcaattcattcattcattcattgcaactttgtagcgaattctcttctggcggaacgcgtcgctgcggtggcggccagcacttcgccgtcgtcacggaagcgcgcccgcgagctgctcgagctgggaattgaggaggcgcgacggttcaagcgggcgaagctgtgcgaaatgatcggacagcatttgcaacggcagcagcgaccggtggacgcgtcggtgacgagtaacaacagtccgtcactgaacaacaacggcggcagcgcattcgcatcggcacgacagaatgggtacagcaacaacagcagatga

SEQ ID NO: 68164 - DNA, 331 bp, Heterodera glycines
  Genomic contig location: Contig_ID=SeqID_39652; Location=1006..1336; Strand=-
  SCN-specific regions: Sequence locations=1-45,68-135,157-204,257-331
atgggaacaattggaccatctgctgtggaagagcgacatttttatgtaaaattgaattattactgaaatatattacagtatagaattaaaatttgaccaatcagttgttaacataaaattatctttgaatcaaacagtaaaaataaattaaaaatttcagaacttatgaaataattagtaaaataagtcttctaacttatttggtattttttttattattgtcaaaagataaattatttaaaaataattattttaagtcaaattgtttatgaatgagcctgggaatttctataattaatgaataactgtaaaaaaatagaccttaaataaa

SEQ ID NO: 68165 - DNA, 173 bp, Heterodera glycines
  Genomic contig location: Contig_ID=SeqID_39653; Location=551..723; Strand=+
  SCN-specific regions: Sequence locations=1-173
ggtgttgggccagtgcaaacatccgttccacatgcattgcattgtgaagtggacgaacacgcaaagcgggcagaagcccgcctgtccgctgtgtcgtcaggagtggaaatttgcgaccagctgattttttgcggggaaggcgaagaagactaataatgacttaatgtttttgt

SEQ ID NO: 68166 - DNA, 49 bp, Heterodera glycines; identical to SEQ ID NO: 51181
  Genomic contig location: Contig_ID=SeqID_39655; Location=694..742; Strand=-
  SCN-specific regions: Sequence locations=1-49

SEQ ID NO: 68167 - DNA, 148 bp, Heterodera glycines
  Genomic contig location: Contig_ID=SeqID_39656; Location=509..656; Strand=+
  SCN-specific regions: Sequence locations=1-26,48-148
aaagttgttgatgaatgagatgacagacagcagctcagttggccgacgatttttgcgtcacaaaattggcgtaataataacaaaaataaagtgttggcaatttatgtttttttggaaacgaaataattgtggtgtcattagtggcaga

SEQ ID NO: 68168 - DNA, 153 bp, Heterodera glycines
  Genomic contig location: Contig_ID=SeqID_39658; Location=88..240; Strand=-
  SCN-specific regions: Sequence locations=1-153
atgattaacattttttatggccagagattactggtctcgaatattttcactgataaacatggtcaatttgagaaatttataccagtggatgatgttatattgatagaaaattgtaaaaaaatttacattggattttacagtggaaaatccgag

SEQ ID NO: 68169 - DNA, 1129 bp, Heterodera glycines
  Genomic contig location: Contig_ID=SeqID_39660; Location=119..1247; Strand=-
  SCN-specific regions: Sequence locations=1-274,313-341,363-868,906 -967,989-1129
tgttgtgcggcagtgatgagatggagcagcggtacagaggacgcattgagaagtttgtggccccaacaaacgacgtaaaaatgccatttattttcacagagtcaaatttggcgttcccgtcaacgaggccttttgtccggacattccggcgacacttttggttggtattaccaaataataatacaaagacatgtttacaaattggaatttcctgtttaaaaaaatatctatataggttggattcgaaatatcccaattcctcaaaattcaatgagtttttaatgattcattcattgattttttataaataaatttgtaaggcattcacaataatgaatgtcatgctgaaaatcatttccaatgtttaaaacccataaaaatgggatcaatttttgccatccttccgttcaccaaactttatcatttgccaattgtttattccaatctcaacaaaataatgattatttgtcataagatgattgattggttggcctaacagattgaagatgccttcccattttcaggtgcttttgctcaaagtgaacaaagagggcccgttgaagaaggacatttggcgagcgccgggcaaccaggcgcaagtgcgcaaactgtcccatattatggtaagtggtggcagcattggttggctttatgggcctccatttaaaaaagcaaaatgcttttgtgattttggcattttctggtggaagggctatcggtagaaagtgccatttcagaaattacattgtatcaagtgggcacacacatttgtagaggtggaatccgatctagggatagaggaaagaagcgataaatctgttagcgagtcgggatttcgaactaactcaaaaacttctcacagtcaatgataaaatttgaaaaataattcaaaaatatttttttttccgctcctaaccttacgatttaatttggcaatccctaatgatattaagggagctaattttgagacatttttcaaaaattattgagcgcttaaaccctcttccttgaaaaattaatgtggcaaatactatataaaaatcgtaaaaaatctcccattttgcagcaacatggccgcctcgtcaacatttcaaacatcagcgtgtacacagccgcttcggtgatcaag

SEQ ID NO: 68170 - DNA, 402 bp, Heterodera glycines
  Genomic contig location: Contig_ID=SeqID_8466; Location=111..512; Strand=-
  SCN-specific regions: Sequence locations=1-238,264-271,293-402
  Gene Ontology: Mol. function=oxidoreductase activity, acting on single donors with incorporation of molecular oxygen, incorporation of two atoms of oxygen; Cellular component=membrane; Biological process=protein modification
gttggctttgaacatcactggttgcaaattctggacaattatgttgctccaatgcaggagaaggtgttcatcggtttctatcaacgggtaagggaaaggatggaaataatttgattactaaattaaacaccgagtgaaattttacaacaaaaaaaacctcattttttagcctatccatgccaacatgatgttcgtggtacgctatcggcctgatgaacaggtggaaatacccccccacttatataatttttaaaaatttttttcccaaggcctcactccgtccccaccacgacgccagcacgtacagcattgatgtggcgctgaacaaaaaagatgttgactacgaagggggcggtgttcgttacgttcgctacaactgcactgtgccagccgaccaaattg

SEQ ID NO: 68171 - DNA, 1476 bp, Heterodera glycines
  Genomic contig location: Contig_ID=SeqID_8468; Location=326..1801; Strand=-
  SCN-specific regions: Sequence locations=1-642,664-865,887-936,958 -1180,1237-1476
  Gene Ontology: Mol. function=oxidoreductase activity, acting on single donors with incorporation of molecular oxygen, incorporation of two atoms of oxygen; Cellular component=membrane; Biological process=protein modification
atgcgcgaacaggtgagactaattttttttttctggcaaatcccgagcccgaaaggaaaattcaatttattttttctaaatttacacttggtctaaaattggtcgaaacaacaaaaattgccgaccattgagcattaaaaaatggacattctgtacagacagactcgaacaatttgaaaattttgtcattgaaaaatgagtcatttattagaattatgaaacaaaaagaatgacggattgtgagcatgttcttgctgatcctgtcctgaattctattgtattaggcaaaatttgaattcacacattaaacatgcaaacctgccacaatctgtgaaatcagagtgctcttgtacaattaaaaattggacattttcctctttttattgcccccccccatttttcaattaaaaaaaatccaaaaggcgataataaaccgaaaatttatttaacgcatgaattgcatgcacaaattgttgatataacattgacagtaatgtatcaaaaaattgaaaacatttttagggtggtgcacaaaaaattcgactgctccgtgaatatttggagccattcaaagaccggaaggatttgattttgctgttcattgatgcgtcagtttttccatttttttttttgcgcttttcgataaataatttaaaaatttttgccctcatttttcagttatgatgtcattttgaatgccgactccgacataatccttcgcaaatttttgtcccttttcccggacaatcgtattgtgtttggtgctgaaccgttctgttggccggaccgtaccctcgccccacagtatccgcccgtggtttttggcgaaaggtttgtgtcacaaaaaattttggaaaaaaacgtggaaatgtgcttaatttttatgctcaaatcaatttttcaaaaccaccattttacagtcctaaataccatttaaaattacaaaaaacaataatgtttataattttcttgaataatttttttctttcaaatttgagcacaggcgcaaatttagggccgcaaattttctgggggacatttttccagtgtttcccgatccacgcacaagcagttttttatttttgaatgccaaaccaaattgtcaaaatgcttaacccaaacaattttcttacaattgcagcccctttctcgaaagttttttataaaaaaaattccactgtttttttttgaaaaatttatatttgaacgtttttaagaaaaaaaaaaaattaaattctcgggggaaacggcagggagtaaatgaaatgtttgtccacttgcataattgtagcaaaatttcatatcccaattcaaatatgtttccattctccatccaggtacctcaattccggcatgttcatcggttttgctcgcgaaatttacgcattgttggccattgccggggatttgaatttgcaagacggtgatgacgaccaactcttttatacgcgagtgtttctcgacacagacaatcga

SEQ ID NO: 68172 - DNA, 827 bp, Heterodera glycines
  Genomic contig location: Contig_ID=SeqID_39662; Location=164..990; Strand=-
  SCN-specific regions: Sequence locations=1-827
atggcagcagaaaatgcgatgttttataaggggataaagatggcacgagacacaggggactctacgccagcgttggtcgcagggcatgaggccgcccattcggtcgccgtgatcatgcaaacacacatgccgcatgatttcatttctgcgacgaacattgccacgccagaaaatgaaggtctgatgttggcaagtgcagtgcagccgagaaattgtttgatcaaacaaattcaggccctgcagagcggtggaattgttgttggtgggcgaaagccacggagacgaaggggacattgaagaggccaccgtgaacgcgcgggaggtttaatttatgctgtgaaaacccaacgttgctaacaggggattgaatatgcataaagctttgataattttaaaagtattttttcgatctttttttaagaatttggaaaaatttttgtgatcattggagctgtagcgaaaaaaaaccaaactgaatcaatgaattcttaacatttaaaatcggagtgttcccttgtaagtggcataagtaaaatttagctgctttgaaaaaggggatggaagccgccacgtggaagaatgcgaagaaagctctggatcgagcaatcaaaaaggtcatcgacgagtcgactgaagcggccaaagaattcctggaagcaaattggagtgcgattgaaagggtatttagttatttttaaactaaaaactgctaaaataatgttgaaaaatcatcagggtttaacagtcttacttttgatgattttaaaaccgttcataaaatagtcaatttcgtttcattcaatcatcttttttaaatctaaaataaa

SEQ ID NO: 68173 - DNA, 484 bp, Heterodera glycines
  Genomic contig location: Contig_ID=SeqID_39664; Location=545..1028; Strand=-
  SCN-specific regions: Sequence locations=1-68,91-484
atggacaaaaaaaaaagttcaaatttctgtatgactgagaaaaaatggcatttttctccgtatttaagcggtgaattccccaccaaaaccatccattcatttaattgctgcactcacttccattcttttccctccatcggtcgaatcttcatcctgctgctgctgtacaataaagataattcccgtcagtttttttttgttttgtttatttcggttttcaaaatgtattaaattttgtgcccttttttcaggatggtcagagcaacaacggccaggacaagggcatcagcagcgcgagcacggaccatcaaaatcaatcgtcgaaatgccaagaaagcgcgtgccgcaattggacgagccggacttgtgagtgacgcgcgaggggggggggggggggcaatttgtacactaattgattcagtgtctttttttaatttgccgatttttcaggcacgctatgcaaatgcgcgggagaaatgcatga

SEQ ID NO: 68174 - DNA, 59 bp, Heterodera glycines; identical to SEQ ID NO: 52422
  Genomic contig location: Contig_ID=SeqID_39666; Location=303..361; Strand=-
  SCN-specific regions: Sequence locations=1-59

SEQ ID NO: 68175 - DNA, 59 bp, Heterodera glycines; identical to SEQ ID NO: 52421
  Genomic contig location: Contig_ID=SeqID_39666; Location=433..491; Strand=-
  SCN-specific regions: Sequence locations=1-59

SEQ ID NO: 68176 - DNA, 59 bp, Heterodera glycines; identical to SEQ ID NO: 52422
  Genomic contig location: Contig_ID=SeqID_39666; Location=563..621; Strand=-
  SCN-specific regions: Sequence locations=1-59

SEQ ID NO: 68177 - DNA, 59 bp, Heterodera glycines; identical to SEQ ID NO: 52421
  Genomic contig location: Contig_ID=SeqID_39666; Location=693..751; Strand=-
  SCN-specific regions: Sequence locations=1-59

SEQ ID NO: 68178 - DNA, 59 bp, Heterodera glycines
  Genomic contig location: Contig_ID=SeqID_39666; Location=823..881; Strand=-
  SCN-specific regions: Sequence locations=1-59
accattttccttctctagtctggctctaccaaacactcacacgatatttgaaatgctaa

SEQ ID NO: 68179 - DNA, 516 bp, Heterodera glycines
  Genomic contig location: Contig_ID=SeqID_39669; Location=1..516; Strand=+
  SCN-specific regions: Sequence locations=1-369,391-464,490-516
  Gene Ontology: Mol. function=ATP dependent RNA helicase activity; Cellular component=nucleolus; Biological process=ribosome biogenesis
gatctggtggtcaatcacaatgttccccgctgttctaaaacgtatgtccatcgtgtcggaaggtcggccagggccggacgttttggggcggcggttactttcgtcacacagtacgacgtgcttttgctcaaaactattgaggtgaggtgggaacggaagatgcatgtccttcccttacggtattgttttgaatttcagggggtaattggtaagcaaatggaggaattgaaagtgagtcacaaagaagtgtcgctctacgctggcaaagtattggccacaaaaagggaggccgaaattcgaatgcaacggcgaggctttggagaacgacgggaaatatggaaacgaaaggaattggccacggaaggactgagtgaagaagaaatagagaaggcaattgagcaatggaagaacggcggaagaaaaatagtgaaagctcacaatcaacacgaggcagaagaaagtcaaaaggggagaacaaaagagtgaaaaccaacacaagagaatgaccttgaagaa

SEQ ID NO: 68180 - DNA, 251 bp, Heterodera glycines
  Genomic contig location: Contig_ID=SeqID_39669; Location=635..885; Strand=-
  SCN-specific regions: Sequence locations=1-94,117-221,243-251
  Gene Ontology: Cellular component=mitochondrion
cgggccggagctcagacaccgttgtttttagcgctaagtagacaaattaacggcgttccgggaaaatattacaggtccttacggcgcgggatcctgtaaaattcattttgttcttctagcgactgcaaagaggccaaagtgcaccaattcgcagaagacgaaatcgcgtgtgaaattctgtacaacaacagtttggagcagtgcgggttggaccattctgccatttgaagatgggaacaaaagctactttc

SEQ ID NO: 68181 - DNA, 615 bp, Heterodera glycines
  Genomic contig location: Contig_ID=SeqID_8469; Location=654..1268; Strand=-
  SCN-specific regions: Sequence locations=1-233,264-474,500-615
atgtatatttcggaacaaaatctaccattgcaaacgccaatatcctgttttacaaaatttaaaagcaaacttttgagacgcagcccagccgggcgtcgtcgtcctgaactgccccagcttgggctcgttccggaagtaagtcgttgttcatttgcgtgctataaaaagtaaatgagtgataagatattattgtaaattacttattttttgaaataaagcattaaaggtgataatctttattgagaaatataacatcaaatttaataggaattatcctcaaaatgtgggggtcgggtctacagtatgtgtacaactgcgttcctcttgtgttctctctcacaaggaaacgcatcgcttcagaatgacttcaaaaattggaagcgatttctacgtttagatgatacaaatggtaattcaaaaatttaagtagacaagtggtagagaatagcatgccacctacatcagtcctacggtcaagtattctattctctgttagaatcacttccttgcctcctcataataacgggaggccttaacaaatatgatttgaccatgggtcttcaacttatagccacataggaagagagatttctgtgccagaattttgagattaaa

SEQ ID NO: 68182 - DNA, 1162 bp, Heterodera glycines
  Genomic contig location: Contig_ID=SeqID_8469; Location=1365..2526; Strand=-
  SCN-specific regions: Sequence locations=1-14,36-146,168-208,230 -467,490-543,565-943,972-994,1016-1162
atgagaatgtttatattttgttttgataattttaattcctttcacaaagcaaaatcgtggggctattgcccaagttatcaccgagcttctgcgcaagcaaagagcacttggatgtacgatgagtaagttaaaaacgcctaatgccgataaaggtataatatatatataattcctagttgtgagcacgagcgtcgtgcaaccgaagcgcgggcggttgcggcggcagcggacgtgtcgactgaagcgtcaaccaccgccgaagatgctcctacctacaggcccgacgcggacagtttggagcaggaggacgacgagactcaagactccgtcgcctctgactcgctgatgggggtctgttggtggacaacgagaacggtgatgatgatgatcaggacgagcaggagaaggaaacctgatgggcggttgccgcctcagcatacttgcataattcgtagggcccagtcatgcccattgccaccttccccccaattaactgtttttttcaatttatttgttttttatcatacgatagccaattttggcactctttttgatagccaattttggcacttatttaactttattgtatcaaaatagttattcataaattgagttacctttaaatgtcgaaaataggtatatatattttcatcaatttaccaaaatatgggtatctcaacattacaagtgcccgatctgtcattctgttagctcatctcgaatccctaaccagaattcgaattttttagaaaatataatcattgtttttttgttgttacaaatattgctagtaccgagttaacacgattaggccccacccaaagagttttctggggctaaaattattttcagtatgtttttttaaattatgatcgccgaggcgaaaacaggaatttgttaggttttgcaccaaaaaatgacaatcttttgccatgcgagatcaatttttcgataaaaatattatattgggctccggcggtgtcgataagtgtcgacgggaaaatttttgggattttatgataagaaaaacattcaaaatttaaaaaatttgtccttttctttaaaatttttatttttgggggaggacaatgtcgaccctgcttctgaatcctttcatattgctgctacaactcaatcattccacagcaatatttgcaataaa

SEQ ID NO: 68183 - DNA, 1461 bp, Heterodera glycines
  Genomic contig location: Contig_ID=SeqID_8469; Location=3014..4474; Strand=+
  SCN-specific regions: Sequence locations=1-22,59-259,281-398,465 -535,557-858,880-1370,1392-1414,1436-1461
atggtaattggaagtttttgtattttttcttctaaaataattttacataacatatttagcgattcaagatattagcttaaatttaacgaatttgaagattttttggaaaatttagccctgaatttgaaaaaaatgtatgcacatattttgcaatttttaagcatatttattttatgtccatataattggcgtttatattcattataaaggttctattttttaaattttggattaaaaaattggttttttgaaattattgaagatgaaataatttaaaaagttttggatgaaatttacttccttgctagatattgcaccgataactaaaaaaaatcagtttttttctcgactcggtaccagttatttcgcaagcaactcttcttcttatcttttctatgtaaatttatatatgttatttaattttttctcattcttttaaaataataaaatttaaatctaattttccgatgtataatttaccgtttgtagtgattttcgatctctttaatcgttgcacattatcttcaatacatatataaattgaatttttaattaaaggactttgcccatgactgttaatcgctcattgacaaaaatggggacactttgatcaaatcgtaggaatttttgcaaattgaattgcaaatccgtgaaatttcaacttggtaagcagtaatttagttcaaaaaagtttatggctaattaattcatttgattattctccattaattttaattgcatttttcggcagaatgaatttcgacatttgggacaatttcgattgagtgccaattgaacattgccttaattaacgtaattattgttaattaagcaattgatggacccgagcaaaggctttcattgaaaaaagtgttggttttttatgagaaatcgatgggagcgaacttagaagcgaaactgttcacatcaaaggatttccgtggaaatatgggcacaaatagaaaagaaagataaaggcactgattgggctttttcctttgtgcattgcttcagaggaaggtgctattaatgttaatttaaatgataatcaatttcacttttgtgatcagagaaaacattacacttatcactgatgtccaaaattctctatcactagaaatattttgccaatttttttttattgatcagcattttgttaagcaggggcctttcagaattacgaacaatagagacaaacaaaataattgtcgtaaaacttatcattttctcgcgaaattcttgccgggaattaggcgtttctcgttcgtaattgtgatcgaactcaatgacaaacgcaaaatttcagacgacaaatatttaaggtacgctcaacccctaattgagttcactgatcaagaatccgattcaagttttcattttctgtgctttgtttatgatttttcatcaattatttagtataatgaaatttttcagattacacacaacattttaaaacagaaa

SEQ ID NO: 68184 - DNA, 635 bp, Heterodera glycines
  Genomic contig location: Contig_ID=SeqID_8470; Location=6..640; Strand=+
  SCN-specific regions: Sequence locations=1-26,58-102,131-193,216 -331,353-388,410-533,555-635
atgatcgataagatgatctttcaccatatttttggggggtaaaatttgtaagtttttgaaaaccagcatcatctatcagcactggcggacgaataaattcactttaaatttaaaaaatgatatttaaaatctcaaaaataaactgattttgtgcggaaaaatatgctaaactggttttttgtttttagcacggtaaataaaaattgttagaaattaaactgaaaaaaaattggaacgaagagaaatatttctcttaattacccatacaaaactttttatgttcggcttaaatgcccgccccttccattcacctcaattgccataaactcggagaaaccccaggggttctctttttcggagcaaaatgactgatcaaatgttttgctggtgccattgtaatgggtgttttcctcattttttggaacaacacataatgttgcagaacaagtacagctccaattcgagccttaacatcaaaaacaacacataatgttgcagaacaagtacagctccaattcgagccttaacatcaaaataactaaattattagtttatgaaaaacttttttttccaccaaaatatctatcagagaaatttaagtaaaatattcgagaaatatacaaaaaaagtcaaaa

SEQ ID NO: 68185 - DNA, 292 bp, Heterodera glycines
  Genomic contig location: Contig_ID=SeqID_39672; Location=885..1176; Strand=+
  SCN-specific regions: Sequence locations=1-16,39-176,199-292
atgtgttcttgtggcacaaataagaaagaacagctcactcatcgattaatgatttttcgctatccattttttgagccgattataatgatactcgaaagtgccttcactgttgcccatgtcatgaaaatcatcaaaattccactcttcacaatgacacttccaaactttggcatccttatattccttggggaatatggcacgacaagagacgtcggaatcttcattcgatgccggattacggccccattcaggctagtgatgcttgccaagtttcactgataatgagtggcaa

SEQ ID NO: 68186 - DNA, 1008 bp, Heterodera glycines
  Genomic contig location: Contig_ID=SeqID_39673; Location=48..1055; Strand=-
  SCN-specific regions: Sequence locations=1-217,240-553,575-659,689 -893,916-918,955-1008
  Gene Ontology: Mol. function=protein binding; Cellular component =Golgi apparatus; Biological process=cuticle biosynthesis (sensu Nematoda)
atgtggcgcgaaatgctgcacgtccaggcgattactggtggtttgccgacgtcctccgacaacggcaccgccccgctggctgtgaccgctgcacgagtgaagcgtcaaactgttggcactacggcgtatgatgcccaaatgctagcgggtgctgtagcggggggcggttcgccgccgggcagcagtggaaacccgcagggcggcagctgctgcagttgccaagtgggcccgccgggccctcccggaccgccgggcagagacggacggcccgggtcagttagacaaagcaaattatgcccggggtaagtggataaaagaattgtgccctatttcagtgccccaggacgtcctggaaacccaggacctccaggaagagatggcgtgcttttacccggaccggtgagacgtggagatgagttttgaaaaaaaaactaaaaaattcagcctccaaaacccccgtgccaaaaatgccctccagggccgcctggtaataatagtctccatgaaaattgaaaacttttcctcataaaggtccgcctggtccaccggggccgaagggtttgccaggcccccaaggcgaaggtgggatttgtttgaaattttaagaattcgttaaatttgccagctggttcatcgggcagagatggagcgcccggactgccggggccgccggggccccaggggccgcaaggaccgcccggccttcccggggacaaaggccccccaggagagccggggaaggtaaaaaacaatcgtagctattgatggcactttcaaccctcaaaaaattaaggtgattaacggggcaccgccaggaccacccggtgagtaaaaagggcaaatcaaaacgccacactttgtgaaattgtcagaaaaacataatttatattaaagggcccttgggttttccaaaaattgaataatgaatatttattatttttcttaatgtttctgccatttacaggtcctccgggcgcaccaggaccacaaggttggttcggagtataa

SEQ ID NO: 68187 - DNA, 95 bp, Heterodera glycines
  Genomic contig location: Contig_ID=SeqID_39674; Location=549..643; Strand=-
  SCN-specific regions: Sequence locations=22-95
cgttgtgtgtgttgtgtccgctttcttcggcggcggtttcggctttggcggcgacggttgctgctgtggcgattgttgttgtgactgttgttgcg

SEQ ID NO: 68188 - DNA, 80 bp, Heterodera glycines; identical to SEQ ID NO: 51817
  Genomic contig location: Contig_ID=SeqID_39675; Location=350..429; Strand=-
  SCN-specific regions: Sequence locations=69-80

SEQ ID NO: 68189 - DNA, 1107 bp, Heterodera glycines
  Genomic contig location: Contig_ID=SeqID_8471; Location=316..1422; Strand=-
  SCN-specific regions: Sequence locations=1-57,79-350,412-631,653 -1056,1083-1107
atggaagaaaattatgcgaaaatggaaatttgtatggattcggccaacacatttacgaatttggaaatcttagaagaaatccgtctagaatttttgcaacgaatgaacaaaatttggcgaattaattttttaggcaaaaaaacattcttttttggtgattacggtggttcgtccacagatggccaaaagagcattttgaaaagcgtttttgcaatgcacgaacaaagtctgaagccattgctattggtcaaccaatttcggcaaaaattgaaaggtgtattttttgtttttggtatttttgctgaataacaacgccatgaagggtaatgggcaggtcgagagtctcggccattaaatttttatttttatatttcacataattagaattattttacttttttaagaaatttacattgacacggagagaataggtggagaattgcatgaaaattcagcagtgttttcaattatcaaagaactttgccttggtgtactgtactcagacggtaagggaagcgtttgaaagatctctccaattctttaaaaatactatttttatattgaatagaaaaagttttttgttactcaattttagccaccctaaaaagggactcattttagagagtaattttggttttcagaggaaaagaatatgtacaaattgttgaaaaagtattttctgcttttgattcgaacttcggatgagccaatttcagaggaggaaaagcaaaaattcaacatcgaaacgtataaagcaaacaacgaaattgtggtggccaatctgctcaaatttgtgtcaaatttaaatgccgaaaatgaaaggcaattaatttggattgtaagcgaagcggcgacggaattggccaatttgggattaatacacacaaaaagggacaaatccgaggaagaattgggcgaggagagcatcggagaaaaactgaggaaaatttgttacttcgaaagcttttcattttggctggcaaacaatgggacgatattgaaaagtgaaaaatggagaaaatttatcctccaacagaattatgtttcaaaggttacatttttatatttaaaaaattaaaataggcaaagaaaattaatgcgattaaa

SEQ ID NO: 68190 - DNA, 1446 bp, Heterodera glycines
  Genomic contig location: Contig_ID=SeqID_8472; Location=33..1478; Strand=-
  SCN-specific regions: Sequence locations=1-164,202-221,245-377,430 -664,687-704,747-1263,1306-1446
atgcgcattgagaataatgaaaaggcaattcttgaatttaaaagtgcggttgaacagctaattggacccattttgctgagtcaaattgaaaatcggcatccatttttaatggcattcggtaatgggaaatccatttgatgaaaagagagcggacagtaggcactaaaaatgccaaaaaggcacaaaacaacaaaattttatgcttttcgaaaattgtttgcataaaataaataattaattttaacttacaatagaaacaaaataaaaactaaaaagaataaaaacccagagaatttaaaacaaaacttaaaaagcttttggtccatggcaatcaaagcgctctcaaaattataaaacaatttttcgaataatcgcacaatatttaaaaattgataatagtattattattttgttttatttaatattttacttctcaagatttggtgactaatgcgaaatgggcggacgaatatttgctcattttatcaaaagagacaattgttgcgggcattggcgaatttcgaatttcctcgcgcatttatttttctcgaatttttgaaatattccaaaaattttatttactgcaacgaaaatatttgcataagacggatgcaaaaatcagcaacatttttaaagaaattgaagagaaatgggaggaaaacataaatatgttttctgtccttttcaaggagaacaaagttaaagacataagtgacattgtggaaatctttgacttttggcaaaaattggcacttttgtacaacaaaatgccaatgttggaggcgcacgaaaaaatccaacgggtggaggaaaatgcgaaagtttggcacaacgaaagccatttaaagattctttttgcacggatggaactggtcgatgaacatgcccaaaatgtgctcagattctacgcggaatttttggcgcagcatttgcaaaattcgctttttgaaagcaccggcgctttgtaccgactcaaaaaatttctgtgcccaaaacaaatggaaaaattcgtttcatttggacaactgacgcaaaagtacccgcaactgaaagagatactcagacgaagtgagtaattgggaacaaaaagtgaatacttaagacaacgacttactgtgacagtaaccactcgaccgatcagtggcttatgtcaccagcacggcatactgcactcatttaactgtcctttgggcttcttttttttgagaattctgccggagttaatttgcccaatttgtcgcttaattgagtcatttaaatcccaatttaaaaatacaaataaaaatattttttaatttttttattgccattttagggctgaacactgttgaaataatgcaactccaaatggtaaattacatctcattgttcgacttcgatacagctgctccccattggaaacagtcacagtttttgctggacaatctcgcgtattatatatggtaa

SEQ ID NO: 68191 - DNA, 869 bp, Heterodera glycines
  Genomic contig location: Contig_ID=SeqID_8472; Location=1975..2843; Strand=+
  SCN-specific regions: Sequence locations=1-152,175-247,285-523,556 -724,746-869
atggccttaaatgggacctatcttttcaacctgagcttgtactgctccaactccatgcatgaagttcgagctgtacaggtttgttgcgatcccagagaccaaatctaagaccatattcgaactcaacatacccgatttaccttgtttaattaaatccagaatttccaaaaccacttttaaaacattatgttacttggtggtcttgaaaaatgccgtttttggagaccactttcagtctcggctctccaataattcaatttttgtaattaaaattttatatttttgtgttcttatagtcctaactttgctctatttaatcactaattctctggctctgtatctcttttatttttctttaaatcagccatcaaaaatacctaactctaaaatgaccatttttacttacttaactctaactccctaactccctttccattggtattgattgatctcttgccagaataatggcaacatattattgataataatggcgggtattttgaatcatgattgtgttttgttgaaattaaaaaaaaattttattaaaaaaaatttgggtatcaaaaattatgttccaccctaagtatttgcatataaaagtcgggacttttatttgcatatttaggtttttatgcatatttcatgcatattttgccattttttgtgcatattttaagatgttttgcatattttgccatttttcgtcaaatttttccgatttgcccttggggaaaaatttgattatccttaaattaaatataaatctgaatggatgcgcgagtggatcaacactaataagcttcactgacgaaaatgttgagaaatttttgatttgcaattgcaaaaataaccgataaaatttatgagga

SEQ ID NO: 68192 - DNA, 961 bp, Heterodera glycines
  Genomic contig location: Contig_ID=SeqID_8472; Location=3030..3990; Strand=-
  SCN-specific regions: Sequence locations=1-91,113-214,246-269,291 -314,336-482,504-531,567-600,622-628,650-927
atgcctttttgtcatttgacaagcgcaattttcgcctttttcgtccttttttcatttgatcgtgccaattgcattagttttggtttgtttaaccccaatttttaaacaaaattcctaaattattttagttttaacaatcaaagaaattgacgcgctttattctcagcttttgaatttgccaaatgaacagaaagccttagaaaatgagctgccgaaaaaggaaatgaaattaaaattggaattggcacttttttacgacgtttctcatcaaatatttgtttcgatgaaaaacaagaaattaacaaatgttcaacaaaaattaattgaagaaaaaagagtggaattttctgagttggcggaaagaattgaaaaaacggacgaatggacggcggaaatcggaaaatgcaaattatggaaattttggcatcatttgaagatttttttgggtaattaataactcattgcatttttaaagcgctttcggcatacaaaaaatgttaagagaattagtccatttttcagtctgtcatcatttatttatttttcctaattttttattttaaaaagaaaaggcaaagaattattatgcataaaggcattgcccctgaaattgaagtgcccattttcatttaaacacatttttattttagcggaaatattaggcgaagaatttggacgaatgattttggagagtgaaaatacggcccaaaaaatgattgactgtgaacaaattgagcaaatgttgtctaaaaatgatgagaatggaattggtagcgacgaacaaattgaaataataaaaaaatatttggaggacacaaaaagcgcaacgcatttcaaagcactgatggcactaatggaaggccaaaaaaagggagagaattggcaaaatgaggggaaatggcattggcaaggacttttaaaaagaagaaattattattatattatttttaattaaaataaa

SEQ ID NO: 68193 - DNA, 59 bp, Heterodera glycines; identical to SEQ ID NO: 52421
  Genomic contig location: Contig_ID=SeqID_39684; Location=121..179; Strand=-
  SCN-specific regions: Sequence locations=1-59

SEQ ID NO: 68194 - DNA, 59 bp, Heterodera glycines; identical to SEQ ID NO: 52421
  Genomic contig location: Contig_ID=SeqID_39684; Location=251..309; Strand=-
  SCN-specific regions: Sequence locations=1-59

SEQ ID NO: 68195 - DNA, 59 bp, Heterodera glycines; identical to SEQ ID NO: 52422
  Genomic contig location: Contig_ID=SeqID_39684; Location=381..439; Strand=-
  SCN-specific regions: Sequence locations=1-59

SEQ ID NO: 68196 - DNA, 59 bp, Heterodera glycines; identical to SEQ ID NO: 52421
  Genomic contig location: Contig_ID=SeqID_39684; Location=511..569; Strand=-
  SCN-specific regions: Sequence locations=1-59

SEQ ID NO: 68197 - DNA, 59 bp, Heterodera glycines; identical to SEQ ID NO: 52422
  Genomic contig location: Contig_ID=SeqID_39684; Location=641..699; Strand=-
  SCN-specific regions: Sequence locations=1-59

SEQ ID NO: 68198 - DNA, 59 bp, Heterodera glycines; identical to SEQ ID NO: 52421
  Genomic contig location: Contig_ID=SeqID_39684; Location=771..829; Strand=-
  SCN-specific regions: Sequence locations=1-59

SEQ ID NO: 68199 - DNA, 400 bp, Heterodera glycines
  Genomic contig location: Contig_ID=SeqID_39688; Location=182..581; Strand=-
  SCN-specific regions: Sequence locations=1-77,100-160,195-400
atgttcgacgaggacgaaaacgacaggtatttttgcgaaccccgaacccgaattcgaactattaccgtaataatttcccgctcacatttaaggtgttcaagctgaaagtaatgttgaattgaatgaagatgagcgaacggcgaataaagtgggtttactcaaatttttaaaaaattcaaaattaaattttttttccgtttttaaggaactggataatgtgatcaacagttgtgaaatgagtgccaatgccaacaatgggaccaatgatgaaggggtaagtaattgtgattaaagttttgaatttttgatcaatattcccttttgatttaaggtggcggcggcggtgaacaacggcggaacaaacagtgccaatgccaacaatcggaccaattgtgaaggg

SEQ ID NO: 68200 - DNA, 403 bp, Heterodera glycines
  Genomic contig location: Contig_ID=SeqID_39689; Location=317..719; Strand=-
  SCN-specific regions: Sequence locations=1-146,169-403
  Gene Ontology: Mol. function=chaperone activity; Cellular component =cytoplasm; Biological process=muscle contraction
attgctctgctaaaatgccggatttgtctccgtccctaaatgctctcccatttgaagcacaaggatggcgttgtgcgtgtcgacaatggccacgaccgctgggaggtcggcttagacgcggccttttttcgacccgacgaaattgaggcatttaaaaataattggtttaataaatccaatattttgtaccatttttttcttctttttttcctccgcttagatcagtttggccggtgaccatctgttcgtctattgtcaccacgaagaacggtcggatgagcacggctcgataagccgcgagatcaagcgcagctacaaactgccggacgacgtggacacggccaccatccgatcgcatctgacgctgcagggcattttgcgagtcaccgcccaaaagaaaaag

SEQ ID NO: 68201 - DNA, 81 bp, Heterodera glycines; identical to SEQ ID NO: 58971
  Genomic contig location: Contig_ID=SeqID_39690; Location=522..602; Strand=+
  SCN-specific regions: Sequence locations=1-13,47-81

SEQ ID NO: 68202 - DNA, 313 bp, Heterodera glycines
  Genomic contig location: Contig_ID=SeqID_39691; Location=57..369; Strand=-
  SCN-specific regions: Sequence locations=1-186,219-313
aaatttttaaaaattttccagcaaataaagtgaatttttttcgaattcccccccccaaacgaaaattaggggggggggaaaaaaaaaaaaaagctttatataggcgaagatttcagtaacaaatgtagcaactctaaatttccaaaaattttttccggcggcgcctatcggcaccgccggacctacattttccactatttttacaagttttttgccttaaaacggccaaaatttggtcatttttagtgaaaaagtgcagttgttacccagcagtggaaaaaaagttattggttaaatagcaaaaaaaaaagaa

SEQ ID NO: 68203 - DNA, 710 bp, Heterodera glycines
  Genomic contig location: Contig_ID=SeqID_8474; Location=1093..1802; Strand=+
  SCN-specific regions: Sequence locations=1-6,28-603,629-710
atgccatcgtcgtcgccgccgtcgcctggtgagtcccatcggtgcccggtatgtcgccgaacactgcagcgctcgtacactttgcggggcctcctctgggcaatggtgtgcttcccgtgcgggatgtactgctgcatgaggaggctgaggaggcgttgcaccgcttgtgaaagcgatgtgagtgcgacggaagggcgggcgccaggggatttaatgcaattttacgtagaaaaaactaggattcggtattaaaccttgtcctggattccatgaaaaacaggttgccaaaaatggcttggacctctggatccaggcctgggtccggacaaagccaaaaaaataggcaaaatttttttttaatttccctacgtttgtgcaggccataaaaattctgaaaaacgatctttttgttatacaatacagttaccatagtatacataattgtgtatgagaaacatttcctctcccattggcaggtgatcatctcggacggcggtgtgccaaccgttgcccaaacgtacaacacatttgccgagttcaaatggcaatttccaccttcggcacttcgcagaaaaagtgccaaccccaagcatgacaaggaccatgatgatgacgatggtgatgatcaacatcacggcagcaatgatcaggagacggaaatccaacggctgtgccctgctacccgtccgtccaatcaacagcagcagtga

SEQ ID NO: 68204 - DNA, 694 bp, Heterodera glycines
  Genomic contig location: Contig_ID=SeqID_39692; Location=197..890; Strand=+
  SCN-specific regions: Sequence locations=1-74,121-136,168-196,292 -435,487-562,584-586,608-620,642-694
atgcggcagcaaatgcacaccggcgcagttcgtccatggccgatttgggaggtgcaaaaataaatttgtgattgattaaaatttttaacatttaaaaatatttatgtaaataattttaaacggagaaaatgaatgctttcagcaaattttaaaaacatttttgtaaatttttcaagacttggtaaaacaatgaagcaaaaaaaaaaaaattagacattcaaatttattaataaataatgctaaactaattttatctaatttgaatatttttttaattattaaacttaattactttttcgctcgaatgaaatcggttggccatgcaatgaaaacggcggcggaagatgagttacggtatgaaatcattcgatttgccgcccgaaccacagcacatggcattccgatggtaaaaatttattatttttagagaacagcaaaaaaaattaaaattttaaaattaaattttaaatttgaaataaataaaaacctgaaattctaaatttatcaaaatattatagaaaattaaagacaacgttcttaattttctggcaaatttgggcagtattttgaagcaaatttataaggacaaatcctagttctattaaatgcatacaatcaaagatttaaaagattaaaagatttattaacaaaattttaaggggttcctgaaaagccgagtttaaaatgaatttga

SEQ ID NO: 68205 - DNA, 554 bp, Heterodera glycines
  Genomic contig location: Contig_ID=SeqID_39695; Location=215..768; Strand=-
  SCN-specific regions: Sequence locations=1-141,166-244,266-270,293-533
atggtggcgggtgcggtgaagcaaatgctggaggaaaacaaccgccaaagagaagaagccgccatcgaggtaattaattaattattgtgccaaaaaaaacccgggttgatttaactaattagaatttacgaatttcaggaattagacaatttttgagggatgcaattatccataaaagcatacagaaaagttcataaagatttcagtatagcaggcgtcagtaaattattgcggatctaattagtattaattaattagtaattaattactaacaggaactggaacaaaatgcgggaaattctggcaccacaaaacccacggcacacattcgcttttccatcccggcactgtttgggataccgacacgccattttgtggccagtaagcgtgccgccgggggtgattggcaaatagtgccgccagcagcagcagcggcatctgatcagcagcagatgattaagcgtgggaagcagcagcaacagaagatgcgggtagaagcaggaggcgaacaacaacaaaagaaggtagcgaaaagcagtggatcaatgggctga

SEQ ID NO: 68206 - DNA, 949 bp, Heterodera glycines
  Genomic contig location: Contig_ID=SeqID_39698; Location=1..949; Strand=-
  SCN-specific regions: Sequence locations=1-31,53-249,273-292,322 -836,858-949
  Gene Ontology: Cellular component=nucleolus; Biological process =nucleobase, nucleoside, nucleotide and nucleic acid metabolism
agaagaagcagaaattcgcagccgttctttgccaaaataaacaaaataaaatgcatatttttgccattcttgggtcaattttcaaaaataaagttggggtcctgggcccgttctcctctccttggttatgggcctggttatcccattttttgccagtatgatccgccagatgagcctcgtgagtacattcaccgggtgggaaggacggcgcgcggtgacacgggcacaggacacgctctgctcattttgaggccggaagagcttggcttccttcgctttctcaaagttggcaatggaaaatttaaaaaacaaattttattgacaggcagcgaaagtgactcttaatgagtacgaattctcgtggaataaattggccaatattcaacctcaactggaggaagtgatatcgcgaaattattacttgaacaaatcggcccgagaggcgtacaagtgggctacaacgaatgccgtagcctggggaaaagccgccatcttttcgtttggacaaaaacggatagggatcgtgaaaataatagaaatccgagactacttttaaatttgtactcaaaaatcctagtacaactggtattttggcgaaatcttctcagtcaaacggttttcctttaactcccggtaaattttgcttttcctcccccccccccctaatttgaaaattgtgccctttggctacggattgtcgattcgtttttacagattgtttaaggggttacattcgggcgtatgactcacattcactgaaaaagatttacaatgtgaacacattggacctcgttcaggtgagttttcccgaaacattaaggaaatttacagaatcattttttgaaaggtctgcaaatcatttggcttcgaaacgcctcccttcgtcgatttgcctgtgtccaacaaaccgaagctgaagcaggacaaagcgaggcttatgggcgcgggg

SEQ ID NO: 68207 - DNA, 1220 bp, Heterodera glycines
  Genomic contig location: Contig_ID=SeqID_8476; Location=437..1656; Strand=+
  SCN-specific regions: Sequence locations=1-60,82-167,189-1220
  Gene Ontology: Mol. function=chaperone activity; Cellular component =integral to membrane; Biological process=fertilization (sensu Animalia)
ctgtccagcaaaaaatacgttccgccgacttatcagacgccaatcatcgaccaaaatgctttctttttcttggaattatttgaggaaacgcaaagcattggcaaaaaatggctgaaatcggagtccaaaaaggaaggcgctgaggaggcaatttccaaatacaacggttaatttttgcatcgttttgtttgtttcgttgttcgcgcaaatgtttatcactatcgaaattttgaccaacgattttcaaaaattggattggggtcgaaaattcagaattttctttacctcaaatttaaattactatcttaaaaaggcttatttttttacgttttgttaaggcgaatggcaaattgggtcgcccactgatgaaattttggccaatgattatggactcattgtacggactaaggctcgacaccacgccatttctgcgcgacttcgaaagcctttcaaattcgatgggagtgcattggtcgtccagtgagtggaagacttttgttttgttatcgcatgaacaatttgtttgacagatacgaagtgaaatatgagcagggtcaagaatgtggcggtggttatttgaaactgttgcgggacgacgcctcaaaggatttgaagcagttcaacgacaaaacaccctatgtgatcatgttcggtaggtcaaaataattttgttgcagcaaagcttaataaaaaaatcatgtttcaggaccagacaagtgcggtatgacaagcaaagtgagttggggaggggtaggggttgagtaaatccattacgtaaaagggaggaatatggttgtttatgcgattctcactcccgtgaaacatctcaaatttcacaacccgagaatatttttttgctcgctcttcacttaaatttccataggaaccttattcttaagaaatttaaaaaacagagaattagtggtcgatacgcaatgttgtacaaattatttcgttaaatcgaacaccactttcaggttcacctgattctgaagcacaaaaacccgaagaacggaacaatcagtgtatgctttttccatcgattgccttttcacaatttctgtttgaatgaatgtttttttttttgcctttttctcaggaacaccatgctatacagcctaacaaatcgctcaggaattactttgaggacaaaaataatcatctttaccctcttgagacccgacccgacaacgcattaaagcctgtctggagaccacacg

SEQ ID NO: 68208 - DNA, 1257 bp, Heterodera glycines
  Genomic contig location: Contig_ID=SeqID_8477; Location=2205..3461; Strand=-
  SCN-specific regions: Sequence locations=1-426,448-681,706-718,749 -1257
  Gene Ontology: Mol. function=chaperone activity; Cellular component =integral to membrane; Biological process=fertilization (sensu Animalia)
atgatcaaaaacccgaactacaagggcgtttggtcggctcgtctcattgacaatccggcctattttgaggcggacccctaccgacaactcgagccaatcggagctgtcggcattgagctttggaccatgaggttggtgggcatttgggatcatgtaaattcgacttttctcgtgcttttagcgaacaaattgtgttcgataacattgcgttggccaacgacgtggacagtgtccgcgagttggccacacagactttcgacctgaaacatgagcaggagaagctgttcctgagcagcacgggcgacgcgaagagtgcccttcgttcggcaatggacactttggaggaaaagccatggtcagaagcgggggtttaattaattgtaagataatgggatggaattagggcttattttctgtgggtgtgggattttttaaagtttggctttcgaattgcgagttaaaatatcgaccaaatttaatcctttcctccaggctttgggttgttgtcattttcgctgtgctggtcccaatcattctgatttgcatcttctgcttcaatcgaaaagcgcgtccaatgcatcgtaagaaaactgacgaaccaaccgaagatgacgagaaggtgatgacgttttttttgtaaaaattaaggtttttgacatcggaatgaaatgagaaatttcatcaatttccctttgttttcagtttgagggccttgaccaaggcgaggaagaagagggggaggaagagaggccaaccgaccttcgtccaggtaaagaatgagttactgtgctattcgaaagtatcggactctgacagtttttatcctctatggtacaatagttcatttgaatgcatttattttcattaggtataaattagagttatttcgtaaagtaattaattcaaaattgtctggtattttgagtttgatcaaacctcaaatataatcacagatgaggccaaaaatgatgtgcacgcttcggcttcccagtcgtcctcgtcgaagaagagtgagtcgccgtcccggtcgcgcagtccctcccgccgtgttcgtaaggcgtctcagcctgccacggacgatgtgcagcagcaggaggcggatgctgtcgaagttgatgatgaccatgaggagggcccgtcctcgtccatgcctaaggcctcgccgcagcagccggtccgtcgtagtcgccctcgtcgtcaggactgatgtggagaagggaacagggaatgaatgatgagcatttttgaagcaataaa

SEQ ID NO: 68209 - DNA, 2412 bp, Heterodera glycines
  Genomic contig location: Contig_ID=SeqID_8477; Location=1..2412; Strand=+
  SCN-specific regions: Sequence locations=1-6,28-33,55-428,476-573,605- 626,648-806,828-1031,1053-1053,1075-1155,1186-1310,1332-1347,1369 -1595,1618-1655,1677-1761,1783-2071,2095-2109,2131-2199,2221-2412
tgtggcaagaaaaatgtgccttttgttcaactgtttcccgccagcttcttttttccttaccacggttgcccgtttgacaaagtgcgactccatgttgaaggcgatgttttccgggcgaatggaggtaccgtggaatcatttttcgtcctaacgatgcaaattgtttttcgaaattgcctattttaaacatcgtccttgttcaattcaaccccaatttgatgtgatcgtccgtttttcaggttcgtcgtgacacggacggctatgtgctgatcgaccgatgtggcaaacattttgggctcattttgaactttttgcgcgaggggacgctgccgttgcccgactgtcggacggaagtgctcgaaattctcattgaggccaaatactatctgctgcaggtgttgtcgtacgaaagctaaaaaatgctcaagattaaaaaataaatttaaacaaaatattaaaaaaaataaaattttttgatgaaaaatctttactggtcggacagagtcagattgaatcttggaaaacgctacaatttaatggactttgatcctttttggtcataaaatactcgacatttctttcatagtttatttttaattagaatgaagcatttagttgcaaaattagcaccaaaaaataaattaaaacttttttgcatttaaacaacaggaattggtggacctttgctattcgtcccttaaagcccttcatcatgaccaactcgtgtccacgcttggcatttgccgtgtccctgtagttgtgtccaaaaagcaagttgaacaaattgtgcagagttgtgctggaaaggtgatgaattgaatgaaaaagccacatttatttatgcaatgcaacttttagccggtcatcgagctgttgatgaaccgtcaaaacaacaaatactcctacaatgcgtcgtccgacgagaacttcttgcgcaaccaggaactgttcgacaaactgatccttcgcttcaacaaccgcgtgctcttcatcaaaagtcactccattcacaatgccaagaagaacttatgttatcaaatccaaaaacttatttgcagatattggcattggcagttcggagatttgccaatggaccttctatgggaagacaaatcgtaaaatcgaagttggtgtcaaagacggggcacccttttgggaagcttcttttttgtgtgggtgggtgttccgggtttccgacttttgttcgtacttacgaatttgaactatttttttcttccttatattttttgttcagatttgttgcacttcgattgtgtacgccacggataaaaagcaaacaaaagtatgatactgtcttattgaggcactgagttaacgataaaaaaatattcaaaatctttattttttatttgatattccatcgctttgtgttcaggtggagtttccggaagcgcgtatttatgaggaagcactgaacgtactgctgacctttgatcagggcgaactgtctggtggtgccggagtttgcacgcgttgccggggtcaaaatgacgacaactttttggtcgaatttcccgccgagctcggccaaactggcgcaaaaacgctgtcctcggcccaacaacaggaaaacacagcacttggcggtggtgcagttggttcggtgatgtgcaacggacgaattgactggcgattggtgcccgccctcccccgcccatcttttatttatattttgttgaatttaaggaacaattggcactcaacagcaccctttttgcgacatcatccaccaccaccaacagtggcacttccgccgatgaaggggcatattctggccaccaaatgaggagaaaaggagcggcggcttccatggcaataggcgagacgacttcgacggcggcgagcagtgcaactgtgacgactactggaggcggtggtggtccttcctcaactgtgccgatgagccacaggggaacggcgggacaacggaaaatgagcgaatgcgacgattgacggaagaaaacccaaagacattccaattgcaattttttccaattattgtgtagctcccctttccctaagcttggcagtaactttattgtacagaaactccaaaaaagagaaaacaaaattttacttggactaattaaagaaaaaagggggtggggacaacacaatgacatgacggagtgacgatgaaagagttgcaacaacaacaatcagatgaatcgatcgtaaaagaatttattgcttcaaaaatgctcatcattcattccctgttcccttctccacatcagtcctgacgacgagggcgactacgacggaccggctgctgcggcgaggccttaggcatggacgaggacgggccctcctcatggtcatcatcaacttcgacagcatccgcctcctgctgctgcacatcgtccgtggcaggctgagacgccttacgaa

SEQ ID NO: 68210 - DNA, 537 bp, Heterodera glycines
  Genomic contig location: Contig_ID=SeqID_39708; Location=62..598; Strand=-
  SCN-specific regions: Sequence locations=1-537
ataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaaggacacttgaaaaaatcgattttttgttttcggggcattccccccgaaccgatgcgcccagatttatggggagaccgaatccctcgggaatagcttccctatagcctgtactttaattctgcgttggatttttgctccccataattgtttgagtaccccaaaggacacttgaaaaaatcgatttttt

SEQ ID NO: 68211 - DNA, 468 bp, Heterodera glycines
  Genomic contig location: Contig_ID=SeqID_39709; Location=388..855; Strand=+
  SCN-specific regions: Sequence locations=1-468
atgacaattacgatttacacagttagattaacaaaagaaatcataagttctatatgctcatcagcagaaaatctgcaaagccaaagctacaaccaaatcgatttaatcaatgactcatctgatatactgtatgatcatgtcaagaacaaatgtcgaagaagtctcacccattctactataagcgcatcatcatgcagaagacgaacaagacgtgatgacggtgggccatgcatgttccccttctgattcaagcagtgaataggtcacgttttacgcgctccaaaaattcccggtttttcagcccgaaaaggtcccggtcccgctcaactctaattttaagttgtaaacgcgttcaaagtttgaccttataatttcttaacggagcatataagtaggtagatttttttaaaaagtggcttttttatgattttgggaaattgtttcaaaagctcttttaaatttgtttga

SEQ ID NO: 68212 - DNA, 1589 bp, Heterodera glycines
  Genomic contig location: Contig_ID=SeqID_8479; Location=197..1785; Strand=+
  SCN-specific regions: Sequence locations=1-30,73-163,214-260,282 -326,399-405,427-481,503-507,613-682,772-940,991-1140,1163-1191,1248 -1475,1541-1589
  Gene Ontology: Mol. function=formate transporter activity; Cellular component=integral to plasma membrane; Biological process =reproduction
aaaacaatttattataaaatgattttttccataaaaatttgaaaaaatatttcttcagctttgtgcccattttgaattggctgccggcataccaatggcgtcaatgtttgctggccgatgccatcggcggtttgaccgttggcattatgcacgtgccgcagggtaattaattaattaaaaataataatttaaattaattaaaataaatttaaaggcattgcctatgcattgctcgcccgtcttcaccccgtggtcggtctttacacctcctttttccccccgttgttctacatgcttttcggcacttctcggcacaattcgattggtaaaattatttgtacattataatttaatttttaaaattaatttcgaattttctattttttaatttaatttttcgtattaattttcggctcttttgccgtcgtttctctgatggccggcatggcggtggaacagttctcttccaatgacactttcttcagtggcggtgacgaggacaaagtgaaaaataaatattttgaaattattttaattaataataattgtattatttaatgaattatttcacaataaaaaaatatttcaaaagatttaattttatttattaaagaaatttcagataaaattgaagtttaacatttttttatttcctgttttccctggccgattttttctaaggaatttattatattttcatataaaatttaaataaaatttctttttccattttttcaattttaattaaaattttaatttttttttaattttccgttcgatttgcgcctctccgacgcgtcgtcgcccgtccgcgtcgcctccaccctcgcgttcaccgtgggccttctccaattgctgatgggccttctccgactggaactgatcaccacttacttttctgatcaggtgcggccgatcacttctcttttttttgtcaaagttttaaattaatataattgtttattatttcattaataaaaaacaatttaagcaaaaataacatattatctttgaccaggagattttcaacacattgttttcaatcattttatcccccgcccctctccgaaatgcaaaattggattttttagtaaaaatcgacagttgaaaatttgtatcagtttgaactttttttcttaaactttaccaataattcttattaattttcggccattttttaaaacgctttacaattaattttgttattttaaatattttaaccttttctttttttttaattattttttggcataattactggctaattaattgcaactacatcttccaattacatttaattggtcccattttctctctaattggtcccatgttctcgctaattgtcaggtggtcgccggcttcaccaccggtgcctcaatgcacgtgttcgtggcccagctcagcgatttgtttggcctccgatccgtcggtttgccgcatcgcaacggagccgggtaccttttcatggggaaaagtttaaaaaaaacaaatttaaatataaaaacattttttatttatttaaatttttaaaaatttttttcagaagctttacgacaccgccagcaacattcacagggcaaatgccatca

SEQ ID NO: 68213 - DNA, 3066 bp, Heterodera glycines
  misc_feature (2301)..(2301): n is a, c, g, or t
  Genomic contig location: Contig_ID=SeqID_8480; Location=443..3508; Strand=+
  SCN-specific regions: Sequence locations=1-546,575-586,628-660,682 -741,917-1046,1069-1143,1165-1226,1261-1374,1411-1412,1451-1473,1496 -1527,1593-1606,1663-1812,2007-2093,2115-2209,2231-2447,2469 -2522,2545-2812,2834-2984,3008-3066
  Gene Ontology: Mol. function=formate transporter activity; Cellular component=integral to plasma membrane; Biological process =reproduction
aagcgatttccatctcagtctgcccaccccaattttgcccaatttgtcgctggtcccttcgctgctgcccgacgcacttggcatttccgcggttgttatcgctgtgcacatttcgttggccaaaatgttcgccaaaaagatggcctaccgagtggacgcgggacaggtgaaagagaatttagagaagaaaaactcaaaaaacaccccaaaaaatgtctccgagtgatcggatcaaattttgatcaaaattcatcgaccacaaaacatttgatcgattgtcaggaaatcaatagcgagtaaattttcgattgcctggccataaaatcgaaaatcaagttatttttggcaaatttatcgcaaaacctcttgtaaattttgaaatttgtgccaattaaaatttattggcggtgcctttaggaactgtacgcgttgggcttctgcgcatcgctttcctccttcttcccggtgtacccggtgtcctgctcactgggccgaacgctggtcaatgtggaggccggcaccaaaacgcaggcaaaaaattgggggaaataaaattaatataaattaattaaatggaggaaaagagtttaaaaaagtaattaaaacaatttttaattatttaaatatgttgtgccgtgtgttcagttctcaacattgttctcttctctgctgttgggtgcaattattctgtacattggccaatggcttcggacattgccaatggtttggccaacatttttcaatttaatttaaatttaaatattttattaatttaagtcattatacattattcattatttttaaatctttacttatttaaacatttcgatcatctaaactattcgattaataaaaattaatttaattttaaatattaattttgattaaattttaattattaatttttttattaattcattttctttttttccgccagtgcgttctgtccgccgttattatcgtcgcgctgaagggaatgttcaaaaaaatcaccgacctcaaaacgctgtggccattgtccaaaattgattttgtatgacgccactttaattaactaattaattgatttcaaattttaaatgccctcaggccatttggttggtcagcttttgtgccaccgtttgttgggatgtcaccgaaggcctcgcagtttccatcatttttgcgctgatgacaaccggtaataaatattccaatgtttgtgcccccccattttggcatttttgtaaatttatattttcattttttatttttttatttcgttagttttccgtacccaatggccccgctggcatttcttggccaatttgtcgggcaccaacgattttcgcgactcagaacgctaccagacagtctgcacatatccggtgtgagaaataaaacattttcaaaaatagtgattttttatttccattttaattaataataaaataattttaattcatttttagggcatttgcatttttcgcttcgattcgccgcttctcttcacaaatgtggacaattttaaagtgcattttgaataccaataaaataattaaaagaatattaaaaacatatttcttaattattttgcttatttattttaatttcaaagataaagctgattaatttaattttatttctcaatttttttcctataattaaaaattcatatattttccttccccaaggaatccattcacaaggcattccatcgttggaacaatgggcgccgtcggcacggtaaaacggatacattttcaaatcaaaaatgccataaattttaatgatacaaaaattgcataaatttaattaacttcattccatttcaaaatttaatattataattaaaatattaaacaatgattacatttttattaggaaatttcaaatgtcaattatttaattatccctaataagaattattattatttcattcttttttaattaatttgattataaactcatctcaattattgaattaaatcatttttatttattttttgtttttattaaatttaaatgccattaagagccaaaaatgaacgcggtcgaaaacggcactttgtcgctgggcatacaaattgggcattacgcggaacagcaacaaaagcttgcccagcaccagcagcattcattgccctctccgccaccgccgacaattgttgtgcacggcacgggcgacgacgccgaagggcaaaaatgggaggacgacgacgacggcacaattccgaccaaaatgggggttggcgatggtcccaaaatgccaattggtacaacgacgaagacagcattggcaccgcaagacaacaaaaatgngcacgacgaaaaggaagcggaagatgcagcagaaccttgaggatgaggaaggcaccaaaaggctcgacgatgccgagggcaataatgacaacgacaattaattggatgcacacaatggcattggcattgccggtgggcaaattaaattaaatggaccaaagcgaatgattaattagcaaattgatgaatcagactaattagtcagttggactaaatcagactaaaatattttattttaaaaatgttttaagttttcggagaaggcgtcgtccattttcttccgccatttcatcatcgactgttccggcttcaccttcgtcgactgtatgggcgtaaatgcactcaaagaggtgcatattttgttctattacaattacactaatggaccctaattaagctaattagggtaattattaaaaaagtgattaatagccgaaaaaacaacaacagattttcaccgaaatgcgagagcaaagagttcttgtgtattttgcagcagcgaaaggtgggcggcatttacttattaaaataaattgtcgaaacaaaatgccaaagtaattcagccccggtgcgcgacctgttcgaaaagtgcggctttttccgctacgtgcaaaagcacaacttttacccgacaattcgcgacgcggtggcaatcgcgcggaagcggcgaaatgcgtaagcggaaaaataaataaataattaaaatgtgaaataatggtaaaggagggagagggaagcttaaaaataatgaaacattccactaat

SEQ ID NO: 68214 - DNA, 196 bp, Heterodera glycines
  Genomic contig location: Contig_ID=SeqID_39717; Location=152..347; Strand=-
  SCN-specific regions: Sequence locations=1-41,63-196
atgccacgcggcagtccgcgtccaccagtgcgtgcagcgtcgcaacaacagcagcaacaaacgccgtacgcgaaggcaccggacggcactgaaagcagcgcaacggtgacgctgctgacgcgtccggagcgcctactgcagcaggagatgaatcgactgaagcgccaaaactcggacccgtcaccggcgttgaagc

SEQ ID NO: 68215 - DNA, 950 bp, Heterodera glycines
  misc_feature (848)..(848): n is a, c, g, or t
  Genomic contig location: Contig_ID=SeqID_39720; Location=416..1365; Strand=+
  SCN-specific regions: Sequence locations=1-198,224-412,434-641,667 -711,748-866,888-950
atgtatgcggatcctgccggatcccgcacaaaaatcaaatttgcggatcctgttgcaggattggaattaattttttgccggaccggatccggccggattaatcctgcattttccaaaaaatgcaggattgcggacttgggatcctgcctgcaaaatcctgcgcaggatccggtcctgctccgggctctagtgttaatgttatatatattttttttaaataatacaaaatgctcaaattctaagattttaacccaaaaagaaacattttacgatgatttttttttccaacattttttcccgtaagtgctttcaatttttgaatttggcaccaatcaacaaaaaaatcgatagaataacaaaagatacactgaccaacaatttcattatgttatagccaattgaatcatcaaaatttaaaacatttaaatttgatgtcatttttccattatttttttattagtattctcaaaattttccaattttttcggaaaatttttcagtctttaatgaaaaaagacccgcatttttaaaaaataatctagggttaactatttaacttacgttggttgacttctagcagttcgaggaaaaaatatgattttgatggttttcgtatttttcgcaaatcaaaaattttgatcaaaaaatattaattatttttaaattgcttaaaaacccagctaatgttctaccactaaaaatggattgatgaaattaaataaaattaatattatttcaaattttaatcattcacgaacaaagaaaaacaaggattaacaaaaaggcatttacatattattgaacaaaaataagtgctaacaaaaatggctgaaggcggtgccattttnggaattttggctacaaagttttttataaaaatttttttacagattttatagaaaattatgaaaaagaaccataaagaaaaaaacctaaaggcggtaaaccaa

SEQ ID NO: 68216 - DNA, 817 bp, Heterodera glycines
  Genomic contig location: Contig_ID=SeqID_1121; Location=572..1388; Strand=+
  SCN-specific regions: Sequence locations=1-597,621-751,773-817
atgtctgccgctgcttccggctcattgttcaactcaagtgcttcatgggttgcttcatgcatgtccgatggacgatatttgcttaatgatccgatttgtatgaacaaatgcgtcaaaattgaatataatggaaaaaggtaagatttgtgtggcttatcgtcccagggctttctcgataatccgccaaaattgaggatttttctaaaatgaatgaaatttcccagactaatcgggagaatagaacgttatcgaattattctattaatttattttcgaaattttaaaaagtttatagatatataccgtattctttggcctctgcccgacttggttacatttttttcatttctaagtttgactgtgccaatcaacaatcaatgcccggaatgtgaagtgaaccatgtggatttgtcaaccgaagcatttttatggttggaaccagccggtggaacggttggagtggcgactggtaataacaattttaatatttcaattgcaatattcatttcaggtgccaccattacatatttggaatgtgcctaaagaaattgggttagaggaagaaatgcacaggcgatggaacagatgaaaaccgagcaaaaaatattaaaatgttaatactccttaaatttatttaaatgatacggaatattgggctgcactttaagttttatgcatataaatttgctaattcggttcagctttttcagttttgtttgaatttgtacattttgtttcacgtttataaagattaaggcaattaaattgacaagaccaagctcttttcgtaaccaattccaaaaaagtttaaccagta

SEQ ID NO: 68217 - DNA, 990 bp, Heterodera glycines
  Genomic contig location: Contig_ID=SeqID_1122; Location=380..1369; Strand=-
  SCN-specific regions: Sequence locations=1-247,269-990
gcaatcagtgatctgatcaatgacaaatcgactgagaagagtccaaactatcatgcggaaaatgaacatttgaccaaagacaaagaggcaatctcgcaagaaattcgacggtatccgtagacataaatttataaaccttgcaattaaagcgaaaatttcgcaaattttatgatcttgcacaaaattataatttttcggatggattttctactgatttccactaaaaactttcaatcataatagttttattttcccgtttccggtcaccctatcgggatcggtacctgggatttttaaataccgggatctggaccaaacgataagaaaatggcgttgccgaaggagactgaaaataggtaaataaattgatggtttcaacaaatgtgcaaccgtcgcttacaaaatggcaaattcaaaataatttgcaacgaaacaatgttttagactgtattcaccatttttttatttcctatttttgttttttcttgataaggcacccatttggggacggaatttatctttttgtgtattttactgttgggttgtccctgtccgatcgtccacctctgcggattgtcctcaatgtggattgtccacttccaattttcagtcacgcctgaacctactgaagaccgggaattcctagcttggtcccggtcacgtgctacccaattcttccctcttaattctccgcctactaaatttatactaaagttttgttcttttggaattgcatatttttcaggattgatagtcaaattatggtgtataagcgagcctctttgtcactgaacgaggcgtgtgagctgcaagtggacagcgacaaattggagctttccaacccgctctattcaggcgctttcatccatttcatcagcgagggtgccgctttttgcacaaaaatcaaaatgggcaaaagtgtcaattatccggacctgaacgctaacaaagggtacaactttttcgaggaactcattgaggtaccgagat

SEQ ID NO: 68218 - DNA, 757 bp, Heterodera glycines
  Genomic contig location: Contig_ID=SeqID_1122; Location=2839..3595; Strand=-
  SCN-specific regions: Sequence locations=1-329,353-442,464-477,525 -615,637-653,688-710
atgtgctgtgccccgccaattgggttattagaaaagcggcacacattgtaccatgaacagagttctaaattcggagggatgaatccatcagtgaaggtaaatccgcttttgcctaaaaccgcctccccgaaatttgcggataatcccgacagttgaggactcgagatttgaattaagtgataatattttttgtcaccaaataaaagtgcctttttaatgggcgggatgattaattaattacggacactcaaaaagtcccaaatgcccctccctgttgatggatcacataaagcaactttatacttattccataagatttaatgcttttgtttattaaaaaatattttttattcctttttattacttttcaaaaacggaatagaataagcagttgaataaaattgatgaagaacaaataatgttagcagaacattcattgcgacaaattttgcaaactgaaaaattgcaaaacctatgaaataataataaaataatattaagcctaattaattattattttatatgagaaaaaaaagaaaaatgaatcaaaatcgatgaaaacattcatatgattttagcattttttaattaatatttccgggcatcgcattttgacaaaatgaaaatttaaaaagaaatggtaaatattgttgttaataaattaaaatacatttaatattaattaatgcctaaattacagaaaaaactggtattaaatattaattaatacataattataagttcaaatattattaaa

SEQ ID NO: 68219 - DNA, 256 bp, Heterodera glycines
  Genomic contig location: Contig_ID=SeqID_1123; Location=15..270; Strand=-
  SCN-specific regions: Sequence locations=1-148,170-256
atgcccccaaaacgtaaaaatatctatttggagagctacgaaaaagaattccggcacataaagaagagtcgaaaaggcgaagaatttgccctttgtgtcgtttgcaacgatgatattaacctcctttccattgggaaagctgccatttctcatcatcaaaaaactggaaaacaccagaaagcggcaaaagcagcaaaccgatcaattccattgcaggaatttttgccaaatacttcggctccatcaactgaagacc

SEQ ID NO: 68220 - DNA, 598 bp, Heterodera glycines
  Genomic contig location: Contig_ID=SeqID_1125; Location=173..770; Strand=-
  SCN-specific regions: Sequence locations=1-244,266-598
atgaaatacaatcgaaattgtccccatggcattctttttttgatggtattctgtgcctttttcactgtcattagtgcaaccattgccaaggaacatggtgacaaagttggcactgtgaattatatccgccttcaaacacaccattatgtcacacatccaaacaatggcaattctttgtcgccctcatacaccggctgggggtacgaaacgccaaaagacaaggaagcacgactgaaaaattatcgaaaattaatgggtaaggtttaaaaaacttccactaggatttggaaaaaaatcatgaaaacaaaaaaacggaaagaaaataagccttcttatctgtatctaatacaaaccgacgaaagaatgagtccgcctattcataacaaaagtgataaatcacctgttatttttttaaagctgtaagtgggggccctattgtttacacaaattttttgtaagacgatgtctgattgtgaaaagttgctcggtgttttcagggtcgctgacaacgaatctgaaaccaattttgactattgcctaattccgaatttgattttttcttaaatttgggttcagaattcagattggtgaaaataaa

SEQ ID NO: 68221 - DNA, 1374 bp, Heterodera glycines
  Genomic contig location: Contig_ID=SeqID_1126; Location=942..2315; Strand=-
  SCN-specific regions: Sequence locations=1-292,314-445,471-622,644 -905,927-1147,1177-1188,1210-1290,1345-1374
atgaaattcaataaaacttttaacattttcggcatcatttcaatggcattttcgacaatttttacgcgcactaatgcaggcaacattatcagcgacattatgaaaaaagccgattctggcaacgaggaagaaaatgccaatgcttcaacagtgccaccaaaattgacatcatcaaacccatcagcatcgtcatcatatgtgacgggttgggaatacgaaacgaagaaagacaaagcggcaagacaaaaatactacaaaaaactattgggtaaaaatgaaaaataacaaataattttattctttcaaagaaagttagttaagggtcggtcgattcttaggggtgtatttttcgtttttttcattcattttgttaataaatttgggcaaatgcattttaatcgcccagccagcttcttccacacaatattcagatcaaaaaaatctctttttttataaaatttatttaatttccacggtaaaatcaatttagaaaaatgtttagaatataaactaaaactaatttttttttggtaaaacaatgacgaatcataaagatatttagcagtaaaataatttagcagcaaaaaattacagcttatttatccgctaatttttatacacctttttagaggggaaaccaataatggaaatgccaaaattaaccaagccatacaaaatgctttctcttcccagcccatgcaaaatgccgcccattccgaaactatccaaaattccatctatgcccgacctatgcaactcaatggcacataaaatgctatgcaaacaaacgcattcaaatttgaatgaagaatatgacactgacaatgacagtacaaaagttgaactgtcacacaaaagtgatgaaagtgaaagtgacagtgaaaatgatttgtctattaaaacttggatggaaaatgagggcggaaatggcggcaaatcaaagggaatgtggactgaaaatgccaatggagatggcacttcgggggaaattgaggtcgacgatggcagcatttttggtggcataccatcggcctcctcttcacacattgatctgatcaataggtcagcccaaattgagcaaagaagattgatgcgtcgattaagcaaaaaggagcacaatttttcattgtatgtatctgctgcttacaaatttattttaaaatttaaatatttattgaaaaatggtttcatgaattttggtttttaaattgggtttcagtaaacaaccattttttcgcaaatacagggtcctacgtgacctttttttaactcaaaagctttcccaacccgttaatatatttttatatgtatacataaaatattttttaaatatatttaattattcagcaaaattgaagaaatcgattaaataaa

SEQ ID NO: 68222 - DNA, 183 bp, Heterodera glycines
  Genomic contig location: Contig_ID=SeqID_8481; Location=1740..1922; Strand=+
  SCN-specific regions: Sequence locations=1-183
atgacaaatatttggagaaatctaggacgaaatcataaaacagtcaatgcctcaatcttggcacagttttacagcagcggatgggtggacgtgttggccacggatattcgcttggtcttctccatgggcatgctccactcgggcgaacatcccagctgcgcatgttcagctgcacagcgaaca

SEQ ID NO: 68223 - DNA, 674 bp, Heterodera glycines
  Genomic contig location: Contig_ID=SeqID_39722; Location=1..674; Strand=-
  SCN-specific regions: Sequence locations=1-426,450-674
tcgggaatagtcagcgagtagcctgtattgtagttcttcgttgcatgaatgctccccataattgtttgagtaccccaaacggacacttgaaaaaatcgatttttttgttttcggggcagtccccccgaaccgatgcgcccagatttatggggagaccgaatcattcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatcgatttttttgtttcataaatatttttttcagaaagtgctctaaagcgcaccaaattttatttacaacttaattttagcactctgatgctttagtatcaaaaaggaagatggagaaaaaaattttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaaacgaaccagcactgcttaccccgcggcacccggcacggtcccccccgaaggaatggatttaattaaaattctcctccttccggggatttttttcc

SEQ ID NO: 68224 - DNA, 510 bp, Heterodera glycines
  Genomic contig location: Contig_ID=SeqID_39723; Location=125..634; Strand=-
  SCN-specific regions: Sequence locations=1-327,349-510
atgaaacgtcacataaagcaaagcaccaaaatagaagtaagcttataaaaattacacgccaatgtacaaaagtatttggatctatgtgtgatcgcaatattagtttaacattaaaaaatctttgttttatattttatatacttgccatcaactttccagcaacttgcggacttaagtttcggtttttttcataaaagaaccaattggattcaacttcaacaaaagatcagggatcatacagatgcattcatcaagaaattagttaaacgaggtgcttaaagaatttcagcgttggtaacatttctttgctgcttatgaaaaggcgccaccaaatggcattagagggaaagaccttaaattacccaaaatcaatttttatagaattttaaaccaattagtactttaaagataatttttattgaaattaagccaaaaatttttttaaatttagtttcagtgacgaatgatagggagcccctggaaatgtcgtccccctttgtagtaaataaa

SEQ ID NO: 68225 - DNA, 816 bp, Heterodera glycines
  Genomic contig location: Contig_ID=SeqID_39724; Location=29..844; Strand=+
  SCN-specific regions: Sequence locations=1-190,214-356,378-816
tttaatccattccttcgggggaccggtaccgggtaccgcggggtaagcagtgctggttcgtttcatcacggcgccgaaccttttggctagtcagcaatcgtggcttaacttgccagatcggacgggtgcgcatgattccactgttccaagccccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaa

SEQ ID NO: 68226 - DNA, 770 bp, Heterodera glycines
  Genomic contig location: Contig_ID=SeqID_39725; Location=59..828; Strand=-
  SCN-specific regions: Sequence locations=1-106,225-265,299-336,358 -362,384-677,699-770
atgagttattttgctgctacaatttcttcgataatcatttcttattctttattactacccatttcaagtggaaatccattgcctgtgagttttgtatttatgtgccaaatattattaaaatttaattctgtttaataaaattagtttttttcgggatttttaaacatcatataaatatttgatgtttttaattaaaagcaaaacttttttttatatattttatagcaaaatgaagacaaagcattcatcgaatttgtgaaaggcgagacattttttgatgaaatatatgaaacttataagaaagaaaaagaattggtcaatttttatccgaaaccgttgacaaatttccacaattttgatttgaaaaagcatttgatccaaaagtaccaagctcatcttggctttctgtttgcgctgcgaaatcattggaaatgtgaaaaaattggaaaagaatttgaccagaatgagcaaaaagaatgccacagatttcgacaatatgtggacattttatatgaatacttattccagacggcacagaagaaaaccgtagtgaagccggagtttcttgtcaatgaaaaggccgaaagtttaattggcgtgctgaaggcattaaaccaaatttcaactttttatttcgatgacgaattcaatgctaaatttgggaaaaatttagcaaaatttttcaaaatggatccatgtgagccgaaactgcagaatgagaaggaattggacgatttgaagaaagcgattgaagacaaacggcacgaaaa

SEQ ID NO: 68227 - DNA, 582 bp, Heterodera glycines
  Genomic contig location: Contig_ID=SeqID_39726; Location=612..1193; Strand=-
  SCN-specific regions: Sequence locations=34-34,68-81,110-126,175 -175,289-582
atgcagtgcatttcctctaccgtactcaacctggaagacgacagtagcggtcccatcgattcatcgtctccaactaacgttgctgattgtgcaactctgtcgaacactgctggtgatcaatctgatcaacagcagcagcaacaaattcaaccgaatgatgttgaaaatgatgcgacagcgttggcagctgaacagctccaaatccatgcacaacaatttgaagcggtccaagcattgaaacgtgaagcgaatgaacgagtgcaacagcttgagctagagctgaccacagtccgccaatcggtgcacaaatttgttgcttccatcattggccgtccaattccggcaccgttcaaccaaattttgttgtcctccaccaccaaagctgatgatggtatcgcttgtgccgatgtcgacgatttggacagtgtggagcgattgatagaggagctgttgcataattatggcacattgaccgaagttcgggcagaacttgagcgccaagtggaacagttgaacgagcaaattgagcgtgcggaagcggaccatgctgtgaaggaacacaaagtaggagcgaaaaattga

SEQ ID NO: 68228 - DNA, 115 bp, Heterodera glycines
  Genomic contig location: Contig_ID=SeqID_39726; Location=1..115; Strand=+
  SCN-specific regions: Sequence locations=1-115
agccccagggcattttcccggaattgcgcaaacaggaatgccaatgagtacgcgccgctgttggcacgggtcgatggcgctgtacaaacggtctgttgaaacatggcaacggcaa

SEQ ID NO: 68229 - DNA, 351 bp, Heterodera glycines; identical to SEQ ID NO: 53910
  Genomic contig location: Contig_ID=SeqID_39728; Location=1317..1667; Strand=+
  SCN-specific regions: Sequence locations=1-20,51-351

SEQ ID NO: 68230 - DNA, 688 bp, Heterodera glycines
  misc_feature (9)..(9): n is a, c, g, or t
  misc_feature (51)..(51): n is a, c, g, or t
  Genomic contig location: Contig_ID=SeqID_39729; Location=20..707; Strand=+
  SCN-specific regions: Sequence locations=1-52,76-99,123-183,205 -224,247-285,307-410,434-463,485-688
  Gene Ontology: Mol. function=DNA-directed RNA polymerase III activity; Cellular component=DNA-directed RNA polymerase III complex; Biological process=transcription from Pol III promoter
atgggatgnaatgacatgaaagtggacaattatgaggagttagaaacatgnaaggaagatgatgaaatggatgagagatagcatttactcttaaaccgatctttgttttttgttttgatattgatgataattaaaaacaaattagtttgtattatgttgcacagaatacacttatttatccaaatttttaaatctccattttgtcatttcatttttggatttagccttgccgtttcaatgttaacattctggtaatcattaatcaacctcttaattttaaagtggttaaatttagtcccacctgtggcacaattctgactctctcagacgggaaggattactgcaagcagttcagctgtggttcttgctcctatacattgccaatttccaagaaggttttggcttcatttattccttttatatatatttttagctgacaagcagaatatacagcaaaaagaaagaagatgagaagataattgggggcaccgaaatgtgggaaaacgcccaagtgacaaatggtctgttaggctcaaagctgagaaaatgcgcatttgtgtgttcagagcgatgcccaagttgttctcatgacaaggcctacttccagcagatacagacgaggagtgccgacgaaccgatgaccattttttatcgatgtgccaattgtggacaccgatggaaggagtaa

SEQ ID NO: 68231 - DNA, 680 bp, Heterodera glycines
  Genomic contig location: Contig_ID=SeqID_8483; Location=701..1380; Strand=+
  SCN-specific regions: Sequence locations=1-162,184-645,667-680
atgtctctttcttcgatccaccatatgtcacgtctgaaactttggatgaccccagtgcgcgacaatcactttgggttggatgacctcaaaattttcaacagcgatggttactctgaaaatgccccattttctcgtgagagcagccgaaactcttccgcggatggcagcatcgcatgcaacgcggatgctgctgatgcggtcattaacatgaaaattggcgtctggaaaccattggtccaattttttgaattttaatatgcggaatcttaggcataattttgaacgtccgggaatttatttttctgattaacaattttgtatttagcctcagaaaacttgtggcttctgctacatacaatacaagcgtcactgtcagcgactcggagttgcatttccgcgtgtcaccgataagggcttctgggtcggacacaccaccaaagacgagcacggggatgtcatgtaggagagaccgtattggaatttgattctatggtttaatacagtaacgctttatcattcaacattttgtttttcaaattttctttatttttcgtttgttttgcagctgtccggagttgcgcaagctgaagtgtccgttgtgttacgcttctggaaagaaggcgcacacattgaaattctgtccattgaacagcatcaaagggaggcgtgacgaagcataa

SEQ ID NO: 68232 - DNA, 2675 bp, Heterodera glycines
  Genomic contig location: Contig_ID=SeqID_8484; Location=1230..3904; Strand=+
  SCN-specific regions: Sequence locations=1-209,231-698,736-932,954 -1041,1063-1264,1286-1427,1454-1513,1535-1887,1909-2002,2024 -2522,2546-2675
atgacgcaccaaattatgacctactcgaaacggtgtgaattcggtcccaaaaatgagcattaattttaatcatttgacttttaacaacagaaggacattccggcggaattctattgggacgaaacgtggaaaaagttggaagaaacggaattggtcatgcagatgttcatccttccgaactacacatcagaacagtggagttttaaatgctttctgtaaaaactctgtttttcagacaccgcattaaattttcggatcccgagccgctctttcgcattctttacacggaaattcttatgggacgaattgaaatcactgaccttctgacagtggattattggattaaacagaccatttttgattttgtgcaaaggaattgcgccaatccaacggtggaaaagaaaatatgcaatgacttaaatggcgttttacgtaagttttttgactagaaagcttcaacaaatatatgcagttttgctcaattttttttaaagatagtcatgtcttttagggcgtcgtataatgctgcataagtcgcgttcaatcgaagtcgaaattcgtacgtcttccccagtgcgacatcgactgcacttctcctcaatatcgccctaattgataagtgacgccttggatcaactgattcaataataatatcactatttgactgactaataatttttgatagtaatttgggtcgtttttaacctttttgtatttttaaataaaataaccaaacagagccaatcataaagccccatgagggaattccgtaaagttaagctttatgcctttttccaaacattctgctaattgtaagttaaacattttcggtagattttcggatttatcacaaaggggtccttttcgggaaaatttattcgtgtagtttacaaggctaaaaacgactggcatcccttacatatattatatttcttaataatttgttttcattttacaattattgttatcaatttatttgaattgacgaaaaaaataatgatttgattgatcatttgcttttcgtgtcacatatttcatttgtatatttttatattacattttacaatatctgttgttatattcttatttttactttccaaaggtaacaaaactaattttgccgatgcaatccgattcggtccaattggtcgaatgttcttcgtcgtctcacaatcggccgccttcgcctgctgacattcgatggcccctttctgcaaaatcggctcagatgttcaaatggcattttctgttcctgtttttgactttctctgttgttttactctgctgggttttgtatgtcaatgcttgcgacgattttatgttccaatttaaaaatgattcgtcggagcattcttcaggtgaacacatcaattttgattatgcattgtttatttagggtatttatcgtttttataccaccctttcaccctcttcttttcctttaaattatgaacattttttttatctcagatgattatgccttcccgacaaaaccggtcattctgatgtggacttcggtgtttggacaaaattcgctcaaattaggcccggactgcccattctttgaccagtgctttttcacctatcaacgtcgcgcattggcccacgcggacgccgtcctctatcacgttccggacatcaaatggacttcagacgaacgcccggactttccggaacaaatgttgctgccggccaatgtgaggaacgtttttctcacccaagagaatccgagtgcgctaagagattatcaccacgcggaaaagctcagaaaggcaggtaaattacccggtttttaaaatcgtgttcattatttctcgcttcttttcaagctcccaactttttccattggacattgacttatttgcgttcctccgattttgtgatgccttacggtggcttttggatttctcccgaggaaacacttcgtctcggcttttcggtttttcattaaaaaaaattattttacaattcgaattatatttgcagcaaaaaattgttttactaaagtaaataaaattcatttgatgtcaaaactacacttttgcatttcggtttttcgcccgtccgtctgcccactgatcgcactaccattttgaaggacaaaattgtgaggggcgccgtttggtttgtgtccaattgtcgcaccgagtcaaaccgtgaattggcggtggacgcactttccaagtgacttaatcatactgattttttttattgtctatagtattcaaattcggaaaggatttgctatatttatacggttttctgaattgttctaggaaattcgaatttccttaatcatttttgggccgattccgcttattttgttgtacctaaatccaagccaaatttaggcatatgctcataaacattggcggcaaatgtgccaaaactgagcagggcaaaaaactttgtccacgcaatgcgacttcctgtgaccacgtgttttccgcccattactttttcatcgctgccgaaaatgacatttgcaagtgcgcaattggacaaacaaaaactaaaaacagaaaaattaaatttataaaaatttccagggattatgtgactgaaaagtattgggaccgttaccgtcttccctccgtgccgatgtatgagaaaacacatttatgaagggtttggtgagaattgcagacaaattatgccagatcagattataaaaa

SEQ ID NO: 68233 - DNA, 386 bp, Heterodera glycines
  Genomic contig location: Contig_ID=SeqID_39732; Location=98..483; Strand=+
  SCN-specific regions: Sequence locations=1-31,65-197,227-363
cttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttt

SEQ ID NO: 68234 - DNA, 361 bp, Heterodera glycines
  Genomic contig location: Contig_ID=SeqID_39732; Location=376..736; Strand=-
  SCN-specific regions: Sequence locations=1-79,113-248,278-361
tgtaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttgttaagccaaaaaaaatccaaacatttaaaaatctataaaaaatttaaaaatgagaattcatgcgagattttctggaaataagcttaattgggcctagttaagctgtaaaaaaaatttggggcgatttgaaagaga

SEQ ID NO: 68235 - DNA, 501 bp, Heterodera glycines
  Genomic contig location: Contig_ID=SeqID_39733; Location=31..531; Strand=+
  SCN-specific regions: Sequence locations=1-355,391-501
atgggaaaagtcgaaaagcttttgaaggggagggatggactcgtgcgcacggcacgagtacacacaaaaggaaaaactctggttcgagcgattaaccttttgtaccctctagaaattaacacttctgcggaggacgaagtcagtcaaattcaagtgactgccattatggattcaccaagtgctgtgatggaaggcggggacccgcaaactgtcacaacggagtcaagtctgcctccagggacagtgatgcaggattcacaaatcgtcacgacagaatcgagtttgtctcctatcagaggaaggaatgagcggcaagctgtgaaagagagaagaattcgaaagagacagccaacggaggaagtcagaggcaaaggcaaaccgaagaagaatgggccatatgatccactgcgaccgggcaactacagaattcctcgccgaaacccgttctttccgtcacaagtagcgtacaatgagcaaacacgcacgtatcgacgacgacgg

SEQ ID NO: 68236 - DNA, 713 bp, Heterodera glycines
  Genomic contig location: Contig_ID=SeqID_39735; Location=79..791; Strand=-
  SCN-specific regions: Sequence locations=1-713
atggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctgccaggactcagttagcaatcaaataatttggcaaaattatcttttggtttttcaggaccaaaaccgcagcatctccagcatctgcatccaaggggtcaaacaacaagcccaagcagcaaaagaattcggcctcggcatctgcttcaatgacatctgtgatgacgctgactcagttagcaatcaaataa

SEQ ID NO: 68237 - DNA, 760 bp, Heterodera glycines
  Genomic contig location: Contig_ID=SeqID_39736; Location=1..760; Strand=-
  SCN-specific regions: Sequence locations=1-45,67-290,312-403,428-760
agtggcagatgcattatcgagagttgcaattaaatgggaacaaatagaaggaaaaagcagagaggacattccttttgtattgaccgttgatgaagaaataggtttacatcgaaaaactatagaaaaagagacatttgaagatagtatactgtcccgagtactgtcacagataaaggcaagctgggtggaaccgatcgatgatgatgagttgatgccgtactttagagagagagataaattatacctcgatgggaaaataattcggaaaaagttgggaagacaaataataattccacagaaaatgagaaaaagggttttaaaaatgattcatcgggcacattttggcattgtgagatgcaaagcccgaaccagagacttagtgtggtggcctaattggtctgaggaagttgaaaattatgtgaaagagtgtcacatttgtcaacgaaatgcgtcaaatgaaccgcgtgtggaccccgaatataaatggcctgaggccaaatatccattcgaacgggtccacgcagacctcgcgggtccaatttgggggacgaattttcttataattgttgacgcatattctaagtatccatttgtgtgtcaaatgaactcaactcattcacctgccatcgtaaattatttacgagaagtattcgcattttttggatcaccacaatgtttggtaactgacaacggcccccaatttgtctcaagtgagacggagcaattttagaaaatgagggggtgcggcacttaaaacccc

SEQ ID NO: 68238 - DNA, 571 bp, Heterodera glycines
  Genomic contig location: Contig_ID=SeqID_39737; Location=63..633; Strand=-
  SCN-specific regions: Sequence locations=1-134,156-156,180-329,351 -354,381-571
atgttcgagcaaagcgcgcgctcaattggcgcccgactgatcaccgagctgacgcaacgcggacgcggctttgcgctgtcccatggcagcaacagtgccaaaatggaggacgaagaacagttggacatcaacatggacaacgaggacgacgacgatgacgtggaggaggaagaggaggcacaaaacggtgtacagtatgacggacaacagcaaagtgacgatgaggaagacggtggcagtacggtaataaatcaagggcatctaattgactcaatagtaaagctgctagagaaccaaactttctcgagaccgagttcggcatttaatccatgacataaaaagaaataaaactagaaaaatttttaattatttttttttttgctaaatcgtacccattttaaattttttcagggcccggaaaaatttttcggcctcagctaccgaggccaaacggaccgttcgaagcagcgcaaaaagcaaaaatcgggcaagaaaggcacttttggctgctcattgcaggccggccatttccgtgccatgcgccgtcatgcgcaacagcaaacaacaaatg

SEQ ID NO: 68239 - DNA, 305 bp, Heterodera glycines
  misc_feature (261)..(261): n is a, c, g, or t
  misc_feature (297)..(297): n is a, c, g, or t
  Genomic contig location: Contig_ID=SeqID_39738; Location=31..335; Strand=-
  SCN-specific regions: Sequence locations=1-129,168-305
gtaacttattgtctgattttccgacaacaacagctggggccaaccaatggtcttcaccacaatcagtgccaccacaacaacaacaaacgcattcaccaacaacacgaacaacacaccctcaagcaacaacatcgtcattatcatcatcatcatcatcatcatcatcagaattaagccaagaaaatgattttacagaggccatgactgatgaggagtttcaattaatgttggcattcaaggaaagcttgacaaatgtggaanatggagatttgcatttgttgagcggacttagctcanaaaaacga

SEQ ID NO: 68240 - DNA, 762 bp, Heterodera glycines
  Genomic contig location: Contig_ID=SeqID_39739; Location=335..1096; Strand=+
  SCN-specific regions: Sequence locations=1-762
atggcatttgtcagccgccgatttgacgctttggtggacgaacattttaaaacacgcaaatggacattgggctttctgaaaattgaatgccgtaaaattggagataacggcacaaccgaaatggaaattgtaaatctgcagcagcagaaaaaaatgccaatgccgcaaaaaccgttgccaaacaaaatcatcgctttcagaatgattattctcgagtaatatttgatggtagtaaaattggtgccggaacaagctcaatattttttatccggctcatagttctttttcaaaaattttccaatcggttcttaaagataagtcagaaatatctgtctattacgaaactttcagttgtttcgaccaaaatgtcatcgactttcttcaaaattttcgtcaaatttttgcctctggcacaaatttatgcattggttactatgatatcaaagatgacattgtggaatttgtcgtccgcaacatttggccaatgctcaaagacaatatccgcgggattcattaccacattgaaaacaaacagtcccatcagttacaacaatttgtcacttccattcttaacgagtgccaaactcttcgctttctattcctatcggcactttccctgtttttcgaccgatgaaagtgccaaaacttcgattgaacaagctctggtcagttggcttttgacgccacgttctgatggaattccaaagttgattgtgtgcagtcaaattcgagaacaccaatggaggccgaaaattataagca

SEQ ID NO: 68241 - DNA, 816 bp, Heterodera glycines
  Genomic contig location: Contig_ID=SeqID_39740; Location=64..879; Strand=+
  SCN-specific regions: Sequence locations=1-192,216-816
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaacaaaaaa

SEQ ID NO: 68242 - DNA, 2044 bp, Heterodera glycines
  Genomic contig location: Contig_ID=SeqID_8486; Location=203..2246; Strand=+
  SCN-specific regions: Sequence locations=1-707,729-860,955-1305,1327 -1501,1524-1578,1601-1861,1883-2044
tgtttttctgaggccgccgtttgtcagtcgcactctttggctatcgtcggtcgcctcttgcaaaagaagggtttgctcacgccgatggattggtccgtcttagacgttctgaatgaacaaattgcggctgtggaaacggtggacaatgtgacggaaaattcgacggttgatacttttcccaatcacgcgaactttggcattgtctgtccatttgctctccaattcgtcataatattcctcatttagtccgattttttgcgcagatttaaagaattgactcagaatttaatgttggccaagcgatacgaagccattgggcccatttgtcggttgatcattccattgttcgaacgcaacgccgactttaaggtagtgactgttgaagaactaacaaatgtccatttggttgacctccccattttcagtcgcttatcgcaattcactcgcaaatccaacaggcgtaccaatgtgtggaccaaataacgacgaatgtcatcagaaggcagcaattagccagctatttcagggtctctttccacggccgggctcaatttgggtaaccgtttccgtacttctaggttttgtcaccccttgaaatttcatataaccaaagacgacttttgggttgattaatagaaaaaaacaattcgagaggatgacatgccaaaccctagaagtattacctttccctctggtccatcatcctttcccctccatttcatccccagcgatgaccatggctctgaatggatttaccgtgagcgtccgttgacttcgttggccgaggcatgtgatcgtttgcgcgagtcggtgcagtcttcgctggccaattgccgtgttcagctgctgaacaccgccaacttcccgccctcccctcccccgcctcgtccgtcctcttcaaagtgttcttcgtcctcctccttctcttccgtttcgtctctgcttccgcttcctgtcgatgatccgtccgtcgcttacattggcgtggcccacgtggagccatgcaaaacggtgcggacgacgcattcttcggagaaagccaattgcgggggcaaattgggcggaagagcgatgtcgcgcagtcgttgcgaattgacatcaatgaatggcagcacttttgggttggcggaggaggacggcgaaggggcggcgatggaagtggcgcccgacccgaccaactattggctgcacaccaacgtacgaacttttgtgctaaacgaacgccaagcggactcaacggtgtcggacaacgcgcccgaattggcacggatgacattgcgacggacgacgctgaccggtgtgccgcggggcggcagagcggcttttaagtcgtcggtggttcttttgcagttgaaaatcccttcccgggcacacgccgtcggcaacgcgttgtgcacatggagcaaacggtgctcagtcccttggaattggcctgcgagagcattcttcaaaaggcggaccaaatccgacacattttgtcctccgccggactccgtcggtgtcgccaccatcacaaccaccaccgactgatcaactgcgggtacgacaaaagtgtgctgaagcgggtggatgtgaagcagttgcagctgtttctgcagggggccgtcatgccgacggtcagcggacgctgcccttttcattggcattgccttccctctatttgttaaggttaacgccggtcttttggcctacgcggagacattcaccgcaccggcgcagcagaaacggtacggcaacaaaggactgctccgcctttggaatgcactgaagtaacaaataaaaggataagcgaacttttattgtccatcgcttttccctttgggactttgctggacgaattggacgaggcgatgcgcgtcaacgaagcgacgatgggcaacgagcggcgcgagtatcagcaaatgctgcgcaacgcgtacgaaaacactgtggagaaactgaacagggcattcgcacgcggcagagagtcgccggcgatggacaaacggcggagtatgagcatcgacagggcgaagcggagcagcaagcagggcatgctgatcag

SEQ ID NO: 68243 - DNA, 874 bp, Heterodera glycines
  Genomic contig location: Contig_ID=SeqID_39742; Location=220..1093; Strand=+
  SCN-specific regions: Sequence locations=1-74,97-754,777-874
atgaattacagaattccacaattgggaactcctggttatcatttactgaaaaatattgaagttgtaaaaaattcaaaaattagtaattttttctaagaaatcatattaagcgaatgttgctaatgaaattttttgcacaatttttgatatttaatcaaaaaatttttgatttaagggacgtgttttccaaaaatttccaataattttccatgtgcaaaaaaatatgtaaatccataaaaatccgggccctcccggacttttcgatagctaaggacatttcgaagcaaaggactttatttatttattccaaaaaacgtttattaaataccgttttaaaaacggagcataattaggccattttgctggcaataatcacttaagagactttttgtgacatttttaatattgtagcatatttatttgttaattgttttgtcgaaatttttaagttttcatttcttaaatcatgttaatattgtaaatttggaattgctaatttgccccgaattcactatttattttcataatcacaattaatttaagaaaaaattgtcaaaaaaatcaaaaatcattaaatttccagcctagcgtttgtcatcatttgtagtaatcaagcatattaataaaaaattgcctaattcattcatcaaatatcagaaaaattaattttttggcaatttattctttttacatagctaatttccacaatttaaaaaaataagctttgatttaaataaagataaattcaaaaacgatttttataaaatttaattttagagaaatagtgaaggaaatgaaactgagcctattattcctttcaatcggttttttgactgctcaaattaatcaaattgaatttgaaatgaaaaatgaa

SEQ ID NO: 68244 - DNA, 854 bp, Heterodera glycines
  Genomic contig location: Contig_ID=SeqID_39746; Location=139..992; Strand=-
  SCN-specific regions: Sequence locations=1-463,485-776,800-854
atgtctgaaaattatttgaaaatggttgccatcggccaaattcgaatccaaaagccatgggccaaattcgaatccaaaagccatgggccaaattcgaatccaaaagccatgggccaaattcgaatccaaaagccatgggccaaattcgaatccaaaagccatgggccaaattcgaatccaaaagccatgggccaaattcgaatccaaaagccatgggccaaattcgaatccaaaagccatgggccaaattcgaatccaaaagccatgggccaaattcgaatccaaaagccatgggccaaattcgaatccaaaagccatgggccaaattcgaatcaaaaagccatgggccaaattcgaatccaaaagccatgggccaaattcgaatccaaaagccatgggccaaattcgaatccaaaagccatgggccaaattcgaatccaaaagctgtgcaaatcgattgccatttaaatcaaatgtttaaatacttttgttaaatttgatgggattccctcgacagatgttaaccaaattgcaaattaatggatttttagttgaaaaaaatttgaatgagattttttaaataagatttcgactcaaaattttggagtaaaattacaaatgcgaaaattggctaaattcttctttcgttattaagtagggctaactatttcaagcatggaacggaatcaaagcacttacttagaatccaagtgcagaaaaatgcaattgatgggatggaggaatggggggattcggggatgacaccactcggggaaggggaacttatccccgaaaaatgccaaaatgtcagccaatggagcaaacctaacatattttaaaattgcaataataaa

SEQ ID NO: 68245 - DNA, 824 bp, Heterodera glycines
  Genomic contig location: Contig_ID=SeqID_39747; Location=261..1084; Strand=-
  SCN-specific regions: Sequence locations=1-379,424-466,488-494,517 -603,629-824
atgaatagcaacgggagatttaaaatgtttgtgggaggagagcggccgatcagggcaatgcttggatcacatggcggcatgggcgaatttgacacgccgataagcggcaatccagaaaacttgtacatttgggtgcgagaggaaaaggtcatgtcttgaggggcaaaattttgcaaaatttcttttttaaattcgtttaattaaatttaaatacttgaaaatagctaaatatgacaaagcaaatcattatagaagaaaaaatacaaaacaaagttaaaaatatattaattttgatgaatatattttggacacttatttttggcatagttttccaattagaaagtcacattaattattatcgagaaaatacacaaaaaactaaattttctgaaaatttttatgtcctttgagtaaaacaaatattataattaatttagtcaggaaaaattcaaagatttgtgataaaaaatccaaattttttcaaaaattatgcacttgattttcgagatggcgaagtgattgagtacgatcgtgtaaatgctgtgcttgaaaaactccaacaaaagtcattatatttcaatgtcaaagacatgttggagaaacaaattgaaacaaattttaaaaaattgaagaacaatttatttgatgaaatggacgaaattattgacgaaaaattcagcaaattttccaatgggctaaggaaatctgagcaaaatttgagaaaattgaagagttacgtcattgacgaaattcgagaaaaacttgcgcatgaaatttccatttttaagcggaaaaaatggacttttcgattggcggacggttaa

SEQ ID NO: 68246 - DNA, 946 bp, Heterodera glycines
  misc_feature (11)..(11): n is a, c, g, or t
  Genomic contig location: Contig_ID=SeqID_39749; Location=290..1235; Strand=-
  SCN-specific regions: Sequence locations=1-67,142-471,494-758,785 -897,941-946
attcgagtganccgtcattagcggattatgacgattcacataaaaaagagatacttcaaattgagggtaatatattaaaaattttcaaataaaattataatgtaaaagaataattttcaataaaatatttaaaaaaaattagaagctttaacacctatttcatctgtccaagccgaagcaggagcaattgaaaagggtaaatttgattttctattaagtgaaacgtagaaatcgtctggacctggacccagtaatccgtttcaggttttgcacgaaaacaaggacttattgaacaacattttagaatttattatttcagattgaccaatgttttatttcagttatctgaaaaagattaaatagattaaaaacacattattattcaagtagataaaaacaggtgttcctaacaattaattgattttttcaaacagttttatccaagtcatggcctgagaacaaggccatgacaagcctgggtttttcctggacctagatttttgaccaggaaatccaggcttttttcaaaaataggactctagtgaaaagaattgcaatttttattttgtagtgctcgaaaccggtgtggttcaagggaaacgactttttggaagttttgtctcgacactaatgggccaagtgaataaagcagtttttgctgaaccaagtaaaaaggctgctgatgaatatcaagcttctacatcaagcagtaataaaaaaaacctaacaaattgaaaatcatgcttaaggctgctaattaatttgatttaaaaaacaaagatatgtcttaaaaccgccgaaatatagacataaaattacaaaatatgggcacatttaaaaaaaacatttttttactgaatacttattcaagtttaaaaattctgatttaactgatcgtggccattccaacagaaattttaaacaaataccaaaatatataaataaa

SEQ ID NO: 68247 - DNA, 198 bp, Heterodera glycines
  misc_feature (175)..(175): n is a, c, g, or t
  Genomic contig location: Contig_ID=SeqID_39750; Location=637..834; Strand=+
  SCN-specific regions: Sequence locations=1-58,80-198
atggaagttgatgaagccgaatatgaagccaaaaaacgcgagcaccgttcctttgttgaaaatgatggtttttcatttgttttgcattataatgtagcttttataattaaggtagtcattattacgatgaggaggatgattctgaggacgaatttgaagaggaggagcgttctanaaaattgaaaaaaagcaaaaagg

SEQ ID NO: 68248 - DNA, 123 bp, Heterodera glycines
  Genomic contig location: Contig_ID=SeqID_39751; Location=58..180; Strand=-
  SCN-specific regions: Sequence locations=1-123
atggaacttcagagggaatacggacagaatgctttcgatatagccaaagtcgacgcggagtcattgcccgaagtttcaatggcacaaaaagtctgtgccgttccgtctgtcatcattttcaag

SEQ ID NO: 68249 - DNA, 1701 bp, Heterodera glycines
  Genomic contig location: Contig_ID=SeqID_8487; Location=855..2555; Strand=-
  SCN-specific regions: Sequence locations=1-155,180-406,441-523,559 -604,626-806,829-833,875-1503,1548-1557,1591-1701
atgaccgaccaaatggtcgaatttgggcatttaaagccgacaaaggaaatggccaacggtcagcagaacgaatgtccggcaaccctcaacctgaccgacttcacccgaaggtcaattccgtgggatgaacagcgaaaatgccattaatcggagacattttaaattaattaaataattaacccgttgcttaagtgccccgctttgcaaaatttggctaattggccttcaattaaacgatgcaattaaaaatataaacgaagaaaatgaagaaaaaataaacgaaaaattgagcaaagaattggacgcaaaaatatacaaagaatatgaaagtgaagtgttgaagggattgttccaacatgtcaggctaaaatcaacatttgttaccagtgaacaattggcacaatggtaaaatttaaaaataaaatttaaatttataaattcactttaggaatattgacaaacaataaataatggagaaacgagaacaaactgttgattacacagcatttacgattaaatacacattttttaattatttataaaatttaagaataaaatgtcattcgttgattaatgaattacaaagaatttataattacataaaatacagtatcttttttaaaatcttcagatatattacagctaatacttgagctcggtgcgggacggatcacgcacgggattttgcgggatcccagtccgcaatcccgcatttttaggaaaatgcggatttgcaggttttatacctgcgggatcccgtcccgcaaaatttggagttccaatgccgcagcgggatccgcatttcatttttgaaatttcaaagacagaatgccaaatatttttgaatatttataaataaaatcaataaaataaagccatttttttctcaagtttcatctaggatttgtaaaaaatttcccggcagcgcctatcggcacagccggaccccctgttcaaaaaagtttttgataaagcgcgccgcaaaaatgacttcaagaccagggatgaagcgaaattccgatttttgcatttcgtaattgccgtattttcaattttgcaaatttgaatttcgaattttggcaccgtaaaatgtggaatatacatacgccgccttgagtttatattaactagtgacgagaattcaacgcgagattttgcgggatcccagtccgcaatcccgcattttttggaaaatgcgggattacggggttaatcccgcggggtccctgccgcaaaaaattttgcattcaaatcccgcagcgggatccgcaaatttgaaatttccagtctctactatcgaccctatttgctcgataatatcacctcaattgatccattaatattcctctcggggaagcttcaccttctctgtcccaaggccaaaatgttgactttgaaatcgctccctgacttatcctcttttaaaattaacaagcagatgtacaaggataaaattgaatcttacaaaacataatcccttatacaaaatggtgaatttttgtgttatttttttaagttcatatttaaatattaatctattattaattcattggcacctatttatataattaattaaattattttattattccttgagttttttcgcatcaaatttactttaaattcttcatatcaatatgaaattatatatattactcaacaattaaaaggaaatttaattcatttttatcggccaataaa

SEQ ID NO: 68250 - DNA, 2346 bp, Heterodera glycines
  Genomic contig location: Contig_ID=SeqID_8488; Location=1663..4008; Strand=-
  SCN-specific regions: Sequence locations=1-269,291-411,433-448,470 -504,609-621,661-796,818-876,899-1392,1426-1619,1642-2320
atgctgaacattggagcatttatcaacgaaattcagcacagaattgaaacaattgagaagataagcaaaagcaatggcatggaaaattcacaacgaaaaattggaggggaaaaggaaaatttaaaaaaattaatggaaaagcacaaaaatgaaaacggaggaattggcactttggagataaaacaaaaattgtgtggaattttgaagcgaattgccacagaaaaagacacaaattgtggtgatgagagtacggtaggcgatggaggaaggagtacggtggaaaaggaaattaaactggtacaaatgcaattgcacaagaacaaaatggccaaaacgatcattggagagggcgagaatgggacagacatttggccaaaaatgacaaaaagtgacattttgaacgacctttttgagacaaagcagacaaaagcaaactcaatggacagatttaatgaacacattgaaaattggagaaatttattgagacaacaaaatttaggtggaaaataattaattaataaataaattattacattaattaaccgagtaattaaaaaaaacattataataattaaccgaataattttattttatttttttataattttgaaggctaaaagcatatataaataacaaatagtttaaaaattaaattatttagacaaaaaattatctgaacgtttttccggtcgctctgaaacggagagagaaaatttagaaaatttatgtgaaatgcacgagaatttgcaacagatttattttcagggcagagaatacaaaacaaaggacgaaatggttaattaataaattaaatgatattagcctatctacttagggtgtaacataagttttgtcccccgaaaattttaaatcggccattctgagtccgaatatggccttagatttgacctgtgggttctcactgtacctgtacagctccaacttcatgcatggagttgaagcatatacaagctcatgtagcaaagatagataaaatttaaggccatattgagattctactgctctaaattatgcagaaaaacttcgtttttgttattccaggtttacgtttttaacgttaaaaaactcgagtaaaattagtgggccaatttccaattttggcatggtcatggaaaaaaagctgaagcaattgacagagaatagaaaaggtttaatgaccgagccgagatgaaattaagaatagacaacaaaagatacaataaaaaaagagtatttaaatatatgaaaaaataagggagttatgaatttttaaaaacgaaaaaattttctatttaattcagcttcatcaaattttggaggaaaatgggtacggaagaaaagaaacgccgaaagatttgatggagggaataaaaaggaccatttcgaaatgggtaatttaattttctaatttaaaaattaatttttgtatgattttctaaatcattaaaatcaaaaaaatcgactttcgaatgcgaaaatattcagtcaaatggcgatgctcgactgattgtgacgggttcgcatttgttggacacccaaacgcccggctcggacatcgacacaatttgcataatgccacaaaaattgtcgtatttggaggagaaaaacaaattctttggcaattacatttttaattgtcatcatttaaatgacggaaatttggaggagagaaaatgcggcgacgattctttgttctgccaattttgcaaagtgaactaataatattgactaataatagcatatttaaatttgcttcgggattactcaattccatcactttttttaaaatgaatcggagttttgctttttcctatttaaaattggccaattaaattttccctttgaatttgtccgatcaccggccaaatttgatcatctttataatttgtttaaattttcagaacccaaaattggatgaaatcaccaaaatttcgagtgcctacattcaaatgctgcaactgaaaatgtccggcgtcaaattcgacatttcgctggtgctgatccccggcatggaatatttgccggacgaaccattggacggcgacgacatcgaatggatgatggaagtgttggccaatcagcagaggccgcagcgggcgatgctccgaacactttccagtagaactcgagattttgaaaaaaggctggacttggacatggattccatggtggatctggacctggatttcatggataaaaatccaggaaaaatccaggctcctcgagacctggatccaggcctggacctggaatttttgaaactcattttaaaaatcaaaaacaaatgtttgaaaaaatcaattaattgcttaggaacatctaaaaatattaatttataataataaa

SEQ ID NO: 68251 - DNA, 909 bp, Heterodera glycines
  Genomic contig location: Contig_ID=SeqID_39752; Location=239..1147; Strand=-
  SCN-specific regions: Sequence locations=1-119,141-147,169-193,239 -304,342-875,901-909
atggcgctttttggcaaaaaaaaggtgattgtgaacattgacaaataaatgccagtgaaatttaaaaaaaagaattccttaatttttgtataaaaaccagcatataataatgaattctatttatgattaattaggactgggaattttatatgtaagaaaaatcgcaaaatatgatgatttaagaattatctacaaaatatttaaaaaattttatgagttttttaaacaaaaaaaaaaaccttagaaaaaggtgaataagaaaaaatgccgtaaaatactgttaggcctagataatgtttaaagcattttaaaaatcttcttttttaaaaaattaaatttaaggggtacattttcaaaaaaaatttaaccttttcttaagaaatttatgtcttctaaaaaaatctcaaaatatgttaaaataaaaagtgatgcgaaaaattgcaaaattttggtatagccctaaattttccttatttaagccgcttttagcgatttatgaaacgcaacagcacggcaataatatgtgccaattccgacccaaatttctgatcatcatttacgctttgcttgctctgctgagcaattttggcattgtttggccatttgaagtgattgtcgaagacggcacggaaccggagacagccgacatggaaaagacgttggcattgagcaaaacgcactttttgcgccatatggtggaggattggcattgtgagagcggacaaatgaaaacgccaaaagaactgggctatgaaaaaatgccagaaagatttggttgagttctgtaaaatttggcaaatgatggcattggcatcccatggctacgtgtcgggttcgcggcgcatgacgccacgttttcgtgtggcacaaggccggctccaattaagctcagcaatggaaataattaaa

SEQ ID NO: 68252 - DNA, 104 bp, Heterodera glycines
  Genomic contig location: Contig_ID=SeqID_39753; Location=426..529; Strand=+
  SCN-specific regions: Sequence locations=1-104
tgtccgtttggggtactcaaacaattatgggagcaaaaatccaacgcagaattaaagtacaggctatagggaagctattcccgaaggattcggtctccccataa

SEQ ID NO: 68253 - DNA, 652 bp, Heterodera glycines
  Genomic contig location: Contig_ID=SeqID_39753; Location=243..894; Strand=-
  SCN-specific regions: Sequence locations=1-652
gttttcggggcagtccccccgaaccgatgcgcccagatttaggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaagcgatgcgcccagatttatggggagaccgaatccttcgggaatagcttccctatagcctgtactttaattctgcgttggatttttgctcccataattgtttgagtaccccaaacggacacttgaaaaaatagatttttttgttttcggggcagtccccccgaagcgatgcgccagatttatggggagaccgaatccttcgggaatagcttccctatagcctgtactttaattctgcgttgaatttttgctccccataattgtttgagtaccccaaacggatacttgaaaaaatcgatttttt

SEQ ID NO: 68254 - DNA, 375 bp, Heterodera glycines
  Genomic contig location: Contig_ID=SeqID_39757; Location=244..618; Strand=-
  SCN-specific regions: Sequence locations=1-375
atgcacacgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaa

SEQ ID NO: 68255 - DNA, 195 bp, Heterodera glycines
  Genomic contig location: Contig_ID=SeqID_39758; Location=209..403; Strand=-
  SCN-specific regions: Sequence locations=1-9,31-33,55-59,81-195
ggaattttaaagaaaataaaaagcgaaaattaatggccaccaccagcggagaaggaggtaatgaaatagaaattaattaatgagaggagcaacatttgttaagcttgccaagaatgcccgtgtagtgcttaccgcgaggatggcattgcggacgaaaatgaccgatgctggtactgttggtgtggccatctgttg

SEQ ID NO: 68256 - DNA, 647 bp, Heterodera glycines
  Genomic contig location: Contig_ID=SeqID_39759; Location=18..664; Strand=-
  SCN-specific regions: Sequence locations=1-87,109-128,151-226,270 -298,323-473,496-647
atgaatgccaatttgaagcaacagaatcatttggtgggtgtaatttgaaaaaaatattttgtaaaaaaatctatttgtgcgtattccttaataatttatatattttaacaacgttttgctgtgttgctttttaatacagttctttatgttcatttaatttgaatgcttttcataagctaaggtctttctgtggtgagttctttctcattgcaaagggaaaaaagagttaaaattaattaaattattatttataaatttaaataattttagtggatggaaggaggaaaaaagtaaggaagaggcagagagcaaaagaagaagcaaattgcgaagtaacagtgcatttttcacctgaaaatgctaaaaaagagcaaaatagattagtcacagcatttggtattgaagggacaagtcgcattgaagaacatttaaaggaattaacaatcgaaaattttgcatatgaaaaagtatgcaaaagacaaaaagaggaaagagaaagcggaaatgatgagaacgaagaacaaatagcaatgaaggagaccaaaatggccaaaaaagagtcggaagaaaagggcaaaaaggagttaaagcagaaaggaaagaaaacccctaaagaggaggaagacgaagataaaacaaagaaggag

SEQ ID NO: 68257 - DNA, 325 bp, Heterodera glycines
  misc_feature (59)..(60): n is a, c, g, or t
  misc_feature (104)..(104): n is a, c, g, or t
  Genomic contig location: Contig_ID=SeqID_39761; Location=647..971; Strand=-
  SCN-specific regions: Sequence locations=1-325
atgagacaaaagctccaggcaacaataatgcgaatcaatcacttaaacgacatgtttgnntaattccagaattactaggttgtctcataattacttggaccctntaaaaattagcataacatcgattcgcacacttttcttcaggtccgtagccaggcccccgccccctcccgaaataaaaaacaaaaatttttccaggattcaacatgacagaatgaaggaaaaaagaaaaaccggattgtcattcttgggcttggttgtcggtgttgagggcattggacaaaacatgcaaatgaaaagaattaaataaatttgtgggattaaa

SEQ ID NO: 68258 - DNA, 3895 bp, Heterodera glycines
  Genomic contig location: Contig_ID=SeqID_8489; Location=3173..7067; Strand=+
  SCN-specific regions: Sequence locations=1-267,290-1422,1444 -2583,2605-3340,3362-3863,3885-3895
ttgaagaaagagcaattttatgcattaatgctcttaacggcacttaaatcgccgagcgacgcagcactgaggcagcgaatattggctaaattggcaacggatggacaaaacgtgtcgtatgatggaattgtggaagacctcatcaacttccaatcaacgattgcggaggctcgagcgatcgaaacgccgatcagctctcgaaatgttaatgctgtccaccaaaagggcaagcaaaacttcctgccgaagaacaaattccccaaaagtggacaaaccacaacggcgaacaaaagttgttggcgatgcggagaatgtgaccatcagccattcgactgccgattcaagttgacaaaatgtcacaaatgtggtaccacgggtcacttgggaaagaaatgtgaaagtgttcaggcatggaggaaagaaaaaagtgcaaagatgttgggaaacaagaaaatcggacatttgaggatcggtatgacctcctgttcgatcaatgcactttcgttgatgcagatcaaaattctgctgaaccaacaaattgtcaaattctacctcgacacgggatcggacatcgacgtgattgatgagctgacttatgccgacattggcgagccaccgatcgaaccgtgcaatgaaattgggaagacctttgatggaaaagaagtcccattcattggaaaaggaattggcatattcaaattcggcgagattaaagtgaagcgaccatttttcgtggcaaaagctggctcacttaatctgctgagttgccaaaccatggacaaatttggtttgttggatgaaatgaagcagaagatcagcaacgttgcagtaaatttgtgcaaagccggccgcccaaagggagagaaaattattcccagtggcaccaaacaaatggccggaacagaagccaaaattgaggcattgaaaagggcctttcccgaagtcgtaaaagacgggttaggactctgcacaaaagagaaggcacatctgtcattaaaaaaagacgccacacccatttttcgaaaggcacgtcctgtgccatacaactctttagaagttgtcgaaaaagaattgggccgattggaaaagatggacgtcatcagcaaagtcgatcatctgaactgggcagcgccgattctaattgtgaaaaaggccgacggctcagcgcgactttgcatcgactattcgacaggtctaaatgatgcgcttctcgactgccagcacccgctcccagttccagaggatatttttgccaccctgaatggaggtaaaattttttcccaaatcgatctgagggatgcgtatttgcaaatcgaattggacgaagaatccaaagatttgtgcggattggccacacataaagggaattaccgaatggaacggttgcccttcggtgtaaagtcggcaccaagcatattccaatcaattatggataaaatgctggccggactaaattttgccgccaccgcttacttggacgacataatcgttgtcagcggaacaactgaacaacacgtccgacatttggaagaagtgttttctcgaatccaaacttacggattccgagtcaaattggaaaaatcaaccttcttccgagaccaaatcaaatatttgggtcaaataatcgatcggaatggacgccgaccggacccagaaaaattcatgcaattgtccaaatgccgtctccaaaagacatttcgtcacttcgatcattcctcggcatggtaaaccattaccaacagtttgtcaaggacatgcgcttcactcggaagcctttggacgacatgctgaaggatgagatcgaatggaagtggacggaaaaacgacaaaaagcattccaaaaattgaaggaagtgcttacatcgaaactgctactcacccattatgatcctaaattggacataattgtggcagccgatgcgtcggaactcggaattggggccgtcatctcccacaaattcctgaacggtcaaagtaaagcaattgcacatgcctcaaggtcgctcactccagcagagaaaaattactctcaaattgaaaaggagggcctggttcatggatgcatttaagtgcaaaagttccacaaaatgatctacggcagacacttcacattacaaactgatcacaaaccgctgatcagtatcttcggaagcaaaaaaggcatacggcagtgcagcgcaaatcggctgcttcgctggtcacttactttgctggcctacgacttcgacattgagtatgtcaataccaacgagtttggtcaagccgacgcactgtctcgcctgattgccaaagaatttgaatgtgatgatgaacgagtgatcgccgcgtgtaacatcgacgaggatcttggaactgttttggatatggcaaaacaaattctgccaatcaaatttgaaaatttggtctcagaatccaaaaaggataaaacaatgcaaattgttatgaaattcgtcagagacggttggcctgatgaacgcaaattgacgccacaatcagaagaaattgagcttttcggcagacgaaaagccgatctgacaattctgaaagactgtctgatgtatggcgaacgaattgtgatccctaaaaaattccggaccaaaattttgacactgctacacaagggccatcctggaattaaaaggatgaaacaactcgcccggcagtatgtcttctggccaaaattggatcaacaaatcgaagaatttgtcaaaaattgtgaccgtgtcaattggccgctaaggcaccgacgaaaacggatttgcactcatggccaaaatcaacgcggccatggcaacgaattcatgccgattatgcgggccctttcttcggaaaagaatttctgattgttgtggactcatattcgaagtacccggaggtattcgaaatggccactaaatcagcggccgcaacaatcgaacgactgcgttatctcttcacacgtcacggtataccggaaacattggtaaccgacaacggaacgcagttcgccgctagtgaattcgcaaaattcacagaagcaaatggaattgcacatctcttttccgctccgtacaacccaatgtccaatggacaagcggaacggttcgtggacacatttaaaagggcttttcgaaaaataaaaggggagggagtgccaaataaggaaatcatcaacactttcctggtcacttaccgcacgacaccgaacgattcgctgccggatgcaaaaacccctgccgaaatgctccttggccgaaaaccgcgcacaacgattgatctcctaatgccgcctcttccacagccaacggagagagacacaaaaatggagcaccatttcaatcgccggtttggcgctcgaccacagaaatttgtgtcaaataagccagtttgggctcgacaccgactctcgcagaattggagagctgggacaatttgtgaatgctcgggagtcatctacacggtaaaattccccgacggttcgacaaatcgctttcatgcgaatcaattgagaaaccgggaaaacaccgaaaatggccacgaaccattggcaattttaaatgaggcattccatctgccgatcaccgcaccgaacgttggaattgtagggcaggaccttgagccaaggcctgacccgatcaacgatgagcaccaggacgagatcgaaccggagcaggcccgtcgaagcccgacaccgcagcaacaacaagtgccgcgccggagtggacgaaaccgccgagcccctgatcggtactcgcccggatgagccaatcaaaaggggaggtgttcgggtgatgaccccgagagagacattaattaattttattatgtaattccctctctctgtctccccactatttctctcatttattgtgtctgcactccctttggaaaaggtcagacacatcatccctccccc

SEQ ID NO: 68259 - DNA, 371 bp, Heterodera glycines
  Genomic contig location: Contig_ID=SeqID_39763; Location=786..1156; Strand=+
  SCN-specific regions: Sequence locations=1-60,82-371
aaaacaagtaaatgtctaacaacaaaaacactctgtcgcttcaaaactccgaaacttcctcgtccgcttcttcttcctccccccgtccaacgtcgccgaacggaattatgaacgaatacgtcaagtgagttgggcatgaataaaacaaacattgcccattccaacggatgaatgaatgcctttcagaagtgctactgagcggatgatccatctgagtgtgttggaggtcggccgcgtgggcaacgacggcgttggcattgtgcaactgcacaacactttcgacttcggcgcgtcggacgcgcggcggacctgcgcttgttgtgccgttctgtgtgcttccgggtgcgggtgcggccgtttgctggcggaag

SEQ ID NO: 68260 - DNA, 84 bp, Heterodera glycines
  Genomic contig location: Contig_ID=SeqID_39765; Location=245..328; Strand=+
  SCN-specific regions: Sequence locations=1-84
gttttttaatcagatttgaaaatgtctaaagaatcgacgaaaaccggtaaacaacaactgagcggagggaccgattttaaaatg

SEQ ID NO: 68261 - DNA, 624 bp, Heterodera glycines
  Genomic contig location: Contig_ID=SeqID_39768; Location=1..624; Strand=+
  SCN-specific regions: Sequence locations=1-235,268-276,320-624
agacagtcggatttccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 68262 - DNA, 1356 bp, Heterodera glycines; identical to SEQ ID NO: 39769
  misc_feature (1079)..(1079): n is a, c, g, or t
  misc_feature (1096)..(1096): n is a, c, g, or t
  Genomic contig location: Contig_ID=SeqID_39769; Location=1..1356; Strand=+
  SCN-specific regions: Sequence locations=1-418,441-481,504-798,837 -1110,1144-1356

SEQ ID NO: 68263 - DNA, 304 bp, Heterodera glycines; identical to SEQ ID NO: 51570
  Genomic contig location: Contig_ID=SeqID_39770; Location=77..380; Strand=+
  SCN-specific regions: Sequence locations=1-304

SEQ ID NO: 68264 - DNA, 304 bp, Heterodera glycines
  Genomic contig location: Contig_ID=SeqID_39770; Location=711..1014; Strand=+
  SCN-specific regions: Sequence locations=1-304
aaaattccctcaaaaataaaaggtcaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaatgtctattgcgcaccgccctccctatcatg

SEQ ID NO: 68265 - DNA, 836 bp, Heterodera glycines
  Genomic contig location: Contig_ID=SeqID_39771; Location=490..1325; Strand=+
  SCN-specific regions: Sequence locations=1-245,280-360,382-591,619 -744,789-836
atgtttgtgaccgcatgtcttaccaacgtggtgcgttccgtgctccgtgtggtcggcttccatatgatttgttggggcccattttggtgggttcgcttaaacccgaaggaggggtggcattgtctttgattttgatttttgggaaacaataaattctggcgttctgtcagaaattattaacactttttggtgaaaattcttaaatttttttagaaaattttatgagttgtccatagaatccgaaagggagtggggggtgggggggggagaggggaggggtgaaaaacaatcaacaaggatttctattttgggaaatacattaaaccaatttttcagggtcttcgtcctcatcccaatcattgaatacttccaattgtctcaactgccgagggcattggactccgaattttcacgaaatattcgaatggtttcgaggcgagaattttttaaaatgaattttcaaaaaccatttaacacttttttaatttacagtttcttgccttatttgaacagtgctggcaattggatattttatgcagcaatgaacagagaaatgaggtgggaaaactgtgcacacccaaaaacacgaagaaatttaaaaaaatatataattaaaatcctttaaatttttgtttgagaaaaaatagcaacatgaaatgcaactaacaaaaagaccaacttattgatgaaattagtgatattccggaaaatcaagcaggggaataatttaaaaaaaattgcaccaattttacaataaacaaataattaattaaaatttaattatttttctattttgagaatttaagaagaagggggggggggttgtgctttaagaa

SEQ ID NO: 68266 - DNA, 977 bp, Heterodera glycines
  Genomic contig location: Contig_ID=SeqID_8490; Location=3332..4308; Strand=+
  SCN-specific regions: Sequence locations=1-18,41-52,95-147,169 -529,551-635,657-708,730-751,773-836,858-908,933-977
atgaaagtaaaaaaaaggaataaaatattgactctgagttaaaaaataaaccataaataatatgataaattattttatataattaaaaaataaactttcaaaatttagtaaatgcgattattaattttcttatttagcatttcaaagtaatatttattaattttaattgggtgaatattaattaatgttttaagttctatgattttaaatgtatattatataagaatctaatagggttcgagccccgctcccgcccccgtccccggggcgggacaggtttttggggctcacccccgtcgctgccctcgtgactctgaccccagcatcccccgcccccgcgacctttttttaaaatatttgtggtttagtggttagtgttctggttttggggtactaccttattttcatctaaaaaagggaaatttctaaaaaatttggctaatttctaacaaaattcaaataaagtcttaaaaattttccgcttgcggcgcaaatcggcaccaccggacctctcccctcgcacattcaccaagttttttggaaatgtgccgcaaaaaatgttaaaaatctgctttagtgatcccgaatgcactgaaatttatgaaaaatataataatagaatacattttggatcgaataaaatgtaaaaatatttgaagcaattttgcaaaatgttcttatttttgaccctaaaatcttattttttggcctttattcttattttgaaaattttgaaatagaaaccctggatttagacaaaaacacccataaaaattgactattctggcataatttataatccttaaatttggtcatttttagacaatatctgtgcaattataccaaaaaagaattgaatcgaagcgatacatcgataaaggaatgtggagccaaacaacacatcattcataaaaattaattttttgtgagattttttggagctaattaaaaacaatccccgcccttaattgaaaata

SEQ ID NO: 68267 - DNA, 464 bp, Heterodera glycines
  misc_feature (267)..(267): n is a, c, g, or t
  Genomic contig location: Contig_ID=SeqID_8490; Location=4409..4872; Strand=-
  SCN-specific regions: Sequence locations=1-35,59-159,194-388,448-464
atgtttaatttctggcgttttggaaaaattaagcgaaatttttggaaaatgtgggtgatggaggtctgtaccaccccgggaccgtccctagtcagtttagaactgtttaaggactgtctctaacttaattttttttcaaagtcagttaaatttttcaagaattaaaaattttaaagatataaaaaattaaattcacaaatttcttttttaagtgataggaatttaaatttttgttttaatgaactttaattaaattttctttcttanatttaagatttattcaattgatgcgcaagaacgggtggatgatggcaaaatgcatttgatggaggtgaacagagagggcaatctgatcaagttgaaggtggacgacggaaaatgtaaaaacaataaatcaatttaattttttataaataattataaattttaattattatttgaatatttgtttaatctcaaataaa

SEQ ID NO: 68268 - DNA, 516 bp, Heterodera glycines
  Genomic contig location: Contig_ID=SeqID_39772; Location=54..569; Strand=+
  SCN-specific regions: Sequence locations=1-109,245-282,304-467,489-516
atgaaactgtgcatattattcttttcaattgcattatttttaattgctctaattgaaattggagcggaaaagaaaaaatttgagcaaaaaacatttgacgaaatatttggagaaaaatgggaagaaaaagaaaatgaacagaaaaagaaagaaattattcacaaattctacaaaattaaagaaaaaatcaaacaaaaaggaagaaaatattcaacaaaagaatggaataaaattgaacagaaaatagcgaaaaaattgggaacaaatcgaaccaaaatttataaatggatcaaagaattaaatcttccagaaataaaatcatataaatcaaaaacggatgaacaaaaaattgaaattgtgcaaaaatttatggcaatgaaaaatgagtacaaacaaaatggaagaaaatattcgagaaaagaatggaagagaaattatgccgaaatttgtcataaacttggagttggctaaggagtaattaggaaatggaagaaacaatttggaatgggtgaaaga

SEQ ID NO: 68269 - DNA, 72 bp, Heterodera glycines
  Genomic contig location: Contig_ID=SeqID_39773; Location=199..270; Strand=-
  SCN-specific regions: Sequence locations=1-72
atgccaaaattctggtttccaagtacaatcttggaaataaatacagttaaaatttccaagcataaaagccaa

SEQ ID NO: 68270 - DNA, 384 bp, Heterodera glycines
  Genomic contig location: Contig_ID=SeqID_39780; Location=279..662; Strand=-
  SCN-specific regions: Sequence locations=1-94,141-384
atgagacgtggtttgcagaaatttgtgttgttcgctttggcttcgtatatgctaatacagctgtggggctgctacataaatattgctgacaaagtaattttaaattaaatttttgattttttttattatttaattttttagagatttttctctgccggcgcctcattttttgcatttgatcaatcacacatttattctatgttgcattggcactgttcaagcaatggatgcacaaatggacaatgccgtttcaagattcactgggccatctgtaattaatttaaaaagaatttttcatgtaaatttaaacaagggctatcaagtgtcattctttcccaaattttatgaatgtgttgttaaatagctttaaaatgagctattaaa

SEQ ID NO: 68271 - DNA, 886 bp, Heterodera glycines
  Genomic contig location: Contig_ID=SeqID_8491; Location=11..896; Strand=-
  SCN-specific regions: Sequence locations=1-2,29-34,66-255,277-886
atgggcagcagcggtggcggcagcggaaggcgtcgctccaccgccggcagcggcggcgtccaccgctctatcgcttcgctgcttttcaagcctctgatcggtgccaagtcgtcccctcgcggcaatgatcatcacgagtcggaagttgccgctggcgtggcgagtggcggcataaccatggcctggtgcttccacccgcaccatggcaccggcgtcgtccatttgtgtgcgctgagttccgcgtttgtgcccgaattccaacttggcctggcccctggccaactgagcaccaggccaattgagtacgagcaaattaaggtcggctgatcagtctgtgttccgatcagttcagatttgtcaacgaaagcccctcgtcagcttctgctggacgtgttacagcacagcgaaatttgcagcacaacacaaagtgagcgaagcgaagtgttgggcaatttgcggtgattacaaccgaaaaaggaccgatcagattgattgatccacagctatttttgatcaattgattgataatttaattctttgcccaaacatcgatcggaaatggttgttcaggttcatcaaacgtgccgactatccggagaatcaggcacggcaacgacaccgaaccgaatcggcagcgactgcggcgatgcaatcggcaaatcgaaggactcatctcaacccggtcaacaatgggccgaaatatttgacaacggagcaggggagacagagaagggtttcatcctcacttatggacacagtgatcgaaatgcacaaatgcgctcctccatcaaacgcatttggaggaggtccaatcaatattcactgtgggaagcgatcgatcagcatccttatagcatggtttattgatcgggtcgatcaatgcgca

SEQ ID NO: 68272 - DNA, 2210 bp, Heterodera glycines
  Genomic contig location: Contig_ID=SeqID_8492; Location=236..2445; Strand=-
  SCN-specific regions: Sequence locations=1-2,30-860,886-2175,2197-2210
atgccattattttatttgccttgccattcagcgcccgatttggaggcggtcattcgctgggcgtgtttcataaaagtcgggcggccacttccgttgcccgacgatgtgccggacgcactgcgacagattttcgatggatgttggcaatggaaaaaggacgaaaggccgagcattgtggaggtgaaaacgcagctggacaaggcggaacagagcgtggacagaagctacaaatgggcaagcatttgaaagagaaaaaagaaaaagcgggcgaaagatttacaaaaaagcgggggatcgatcggaattcggggtatttttctgatcgttggtcattcattttctctgcaattgacaaagggaatgtcctccctccattaattaattctcctaaagcaattagccaattcctcccttgccaaatttgagttttatttcatcttttttaattaccttcacaaagcgccgcttcagaaattggcgacggaaacgcagcaaaaggaggcgccggctgaagtcgttttggaacagatgcagcagcagcagcagcaacagaagatgttcagcatttcggaacaaaaagtgcagttgtacttggaaagggtgtacaaaaaaagttacaaaaaaccgacaaaaatggagcgaattttggccgcgtggttccaaccgccggacccaaagcggcaaaagcgaacggcgaagttggaaaagcgaagcattggcacgccaagcggtgggagggggagagggcagtgccaacttcaaaccgttttttttaccttttaagggtttcggcacattgtgtcggcacaggtcgagcgagcggataattccggggaccaaccgacggtcaaactttgtgagttgattttttcttaatggttatggccattagttttgccgtttgtccctccgtttctctttttttgtcactttcatctctctatacagcataccttttcgttcctccgtctctcttttcgtcattttgtccctcttcgtccttttgtctgcttttcgtctgtggttggtgatcatttgttgctcgtctcttttcgcagatgcaaatgccgagttggcaccgctgcaacggcaacagtcgcaccgctcgcacgactcgctgttggagtgcggcagggagcggggcggcgacagaggcggcaaaaacggggcgccggcggtgggatacgcgacattgccacgcacattccgagtgcagcagcctcaacagaaggtgaccgaaaagaataaaataattatggagaggggaggagttattaaccgtgtccaaaagaatagtgatgattcaccaacatttaaaaaagtatcggcactcactgatcagctccagtttctgctgatcactttttgccatgccttctattcttctcacctccctttttcagtcacctctttctcacaatttgcttccgcctgctttgcccccaaaatcgtcctgctgccgtgcccatccgtgctgtgccaaaaaactcggcggattggtgaaaaccaaaacggcgaaaagcaacccggaactgaacattttgggcacgaaaagcggcggagggaaagtgtttcccatgggaatgagcggcgcacaaaacgccggcggggtaagtcatcttccaatctgttgaccaatcccaaaaagcattagccaaacagtttccacctccattccccccacccctccggcaaaatttatttgtccctttagaaacagcaaaaaattcggcaccgatcaccgcaaccgattagtcgaccccacgattacttgtcgctgttgccgagcagttgcccctcaggccatcagcagcagatgaacgcatgccaaaaactcaagcgtccgactccgccaatcacgacttactcatccgtcgggccggagagggactgtccgctgcgcaaagaccgcgctgaaccgaactggaccgagacggatgaggcgatttgcgacgatagcgacctcattggcattatgcagcgccagtatgtcaatttgccgcacagcacacaaaaggcggcacgtcgcacgaacgcagttcgccagcgaatggttgcggacgcgacggagtcgtccgactgctcctccgacgtcacaacacccaacggtgccattatggaggaattggcatcgctggcgacggagggcgacggcgcggcgatggcacgcgaaaatggcagtgagaaaagcacaagcagcagcagaacag

SEQ ID NO: 68273 - DNA, 425 bp, Heterodera glycines
  Genomic contig location: Contig_ID=SeqID_8492; Location=235..659; Strand=+
  SCN-specific regions: Sequence locations=1-15,37-425
cctgttctgctgctgcttgtgcttttctcactgccattttcgcgtgccatcgccgcgccgtcgccctccgtcgccagcgatgccaattcctccataatggcaccgttgggtgttgtgacgtcggaggagcagtcggacgactccgtcgcgtccgcaaccattcgctggcgaactgcgttcgtgcgacgtgccgccttttgtgtgctgtgcggcaaattgacatactggcgctgcataatgccaatgaggtcgctatcgtcgcaaatcgcctcatccgtctcggtccagttcggttcagcgcggtctttgcgcagcggacagtccctctccggcccgacggatgagtaagtcgtgattggcggagtcggacgcttgagtttttggcatgcgttcatctgctgctgatggcctgaggggcaactgct

SEQ ID NO: 68274 - DNA, 577 bp, Heterodera glycines
  Genomic contig location: Contig_ID=SeqID_39786; Location=513..1089; Strand=+
  SCN-specific regions: Sequence locations=1-243,266-306,347-395,417 -424,446-498,553-577
atgaaattaagtggaattcggttagaatacatatgctataatgttagaaaattaaagatagaaatccacttgaggcaataaattactcgggttttttaaggtctcgtttcaagtttcatgaaatccgagagacaaataccgtaaaactcgaacaccgatattcacgaacgcgagcatccgattggcaattttaaacatattttatgtgtttttttgacaatttttctttacttaacattcgtgttgatgtaaaaacattttaatttaatgagaaaatatgagtgaactgaatttttaattggagagataaatattttttttcaattaaatttttaatgaattttatgcagaaatcactagagatcgacattttgaaaaatgcctggacctggattccatgttggacctggacctggatttcctggacaaaaatccaggaaaatccaggtccaggaaaaatccaggctcctcgagacctggatccaggcctggacctggattttttgaaatttattttaaaaatcaaaaaaatgttgaaaaaattatttatttgagtagaagcatctaaaaatatcta

SEQ ID NO: 68275 - DNA, 365 bp, Heterodera glycines
  Genomic contig location: Contig_ID=SeqID_39789; Location=6..370; Strand=-
  SCN-specific regions: Sequence locations=1-24,47-222,256-365
aaattgtccgaagtcctgccaaaacaccacctccaccaccagtagcagcagcatcaacttttacaacttttacaccgccgacaccaccaccatttcctactccatttcacaaacacttctcatttttaacaccgtcaccaccaccacctgcaacagttgatttggatcagattccacttcccccaacaccaccagcaacattttcattggatttttggctaccacccgcaccacctccaccaccagcagcaacagttcatttggatatgaatcccacatcatcatcaaaggcggcagcagcagacgaaattgaacgtgaaaaaaagaggaaaaagcggctaggcaatcggtggagcagcacacag

SEQ ID NO: 68276 - DNA, 1086 bp, Heterodera glycines
  misc_feature (16)..(16): n is a, c, g, or t
  Genomic contig location: Contig_ID=SeqID_39790; Location=86..1171; Strand=+
  SCN-specific regions: Sequence locations=1-88,120-132,158-485,507 -603,625-773,825-915,965-1086
atgcacattggcatgnatcagatcgccaggtgtttggcgtgagaagattgctcgcaaaacgaaaatttaaaaagcttatgggtgtgctacgtgccccgcccctcccgcccttttttccatatcgttccactctcccaaaaatttttaaaatttcttatagaccaaaaagtttatttatttttttaaactcggattttttgaaaagacaaatttttttttgaaaaaagcctggtaataattttcttagggtctcgagaatttttatgattcgtctctcttctcttctgtattatgtagtattgcgaccgatatcggcaaattaataacaatcctcgagataatttagataagtctcgagtagagttgtgctcataatcagattcaagagaaattatgaattttgactcattaggaataaaaattttgtgtattttcaaaggaataaaaaaaattttcttttgaaataattaacattgtagattgacaaaaaaaaatttatttaatttcccaatttgtcttttaggctagcagcagaagaagcgcgaaaggaacagcaacgacaagcccaggaggggcttatcgggcggaaaaccacccttggtggggctgtcagggaaaaggtggaaaaaattgtaattttttttttaaatgaaaataagttaggtcaaaaaatcgagattccgatcgtaaataattcgggaattctcgtctactaaacttcacttttaaaattataaattgaccattttgggtaaaatttattattttgcacgattttttaaaaaaaacaatttttaaaaaattatttattaatttttaatttacctattatggttcttttgttattgacatataattcagggcccttcctcgttatacatattcagtgaagacaatgtgatacggaaaaatgcgtaatttaataataataaatatattattttaatttaaaaaataaatatttgcagtcgtgccatcattgaatggggaccttttgaatttttcattttgctcacaatcattttgaactgtgtggtgcttgccatggaacaacatttaccaaggctggaaacaaaaagaaaaaaa

SEQ ID NO: 68277 - DNA, 86 bp, Heterodera glycines
  misc_feature (41)..(41): n is a, c, g, or t
  misc_feature (84)..(84): n is a, c, g, or t
  Genomic contig location: Contig_ID=SeqID_39791; Location=93..178; Strand=-
  SCN-specific regions: Sequence locations=1-86
gtgtgttcggctggagatggacttgtttcgggaacactttnggattatgtgcgaatggttggcattgactctaacaaatgcctntg

SEQ ID NO: 68278 - DNA, 192 bp, Heterodera glycines
  Genomic contig location: Contig_ID=SeqID_8493; Location=106..297; Strand=-
  SCN-specific regions: Sequence locations=1-192
atgttggaatcggacactttggcccaaaatcagtcggcaagcgtttcgcccggatggaatgacccgccgccgttggccaacccggcgacaacgacagctgcggcacatgccggcctcaccaacggagtggcgaacggcgccggtcggctgcatttgcagcgacagcgaaggcccgtggacccgtccgtccag

SEQ ID NO: 68279 - DNA, 1420 bp, Heterodera glycines
  Genomic contig location: Contig_ID=SeqID_8493; Location=864..2283; Strand=-
  SCN-specific regions: Sequence locations=1-2,25-469,491-510,671 -673,697-838,861-928,974-1096,1118-1128,1150-1281,1303-1379
atgccttggcccccgtcgcccttttggtgtgccatcgtcgccgccgcatatgccccggtggatgtgtatttattggcagcagcagcgacatttggtatggcactgttacacgtcggctttttgtccccccccccccttagcccccactaaatcgctgataaaattcaagtggcccagcaaaatggagagagaggtcgcgccatgccgtcatcgctgtcgcccaaattgccttggaaacggaaatgtttgtccgtattcttgcgcccccgccgcaacccttatttattgtatttatacattatgcatttgtgccaatgccaatgccaatccattgcgccacacattgaggagggggggggcttagttaggagaattcattaaaaaaaagaaaattggctgcctgccgcccgccggctgacgccattaatggaatcgaaaataaaggaagtaaaatgcggattcggaagtgataaaaacttaaatgacaaaatgtacttggaaaaggtacacaaaatattgtttaattatgtaaaaaaaaattatgattttaggcaaaaaaattttttttttaatttcgaaaatttaatttaaaaaaaaaatattttacattaattttcgaaaaaaactaagattaacaaaaaatatttttctttaattttttgaaaaattagactttagaagcaaaatatctttttagttttcgaaaaaaataagtagaataggcctaataactacaagcctatgctatgcttaggctaagcctgtgcctaagcttcgtatatcccctgattaaaagtcaatgtgtaagaaatgattgaaaattttatgggattagactcgagatggaaatcccgaggctggccgaataaaattaggtatagtaatcagtaatatttaacattaggttggtaattaaaattagggatggtaattaaaatatttttaaataaataaaacaaatgtttatatttatcgcaaattcttctgtttctttaaaagacttaattaatttaaaccaaaacacattcatccattaaattgatttacaattaacggttcccctcttaaaagaacaatggcattttactgagggtttagaatttttacgaaaattaaacttttcagtgttatttaaaaatttaacattgccaaaattgatcggcaaaaactgaatattttcagtatttgttgcattatttgatatcttgaaataggtacataaacattggtcacttaaaaacaacaaattttaagggatcaaagatctgtcacaattggcctggatttcctggacaaaagcccaggaaaatccaagaaaaatggccttgacttaggtccaggaaaaatccaggcctagagatccaggctcaattgaaccctaataataatttaaaattaatttaatttttaatcaaataaa

SEQ ID NO: 68280 - DNA, 81 bp, Heterodera glycines; identical to SEQ ID NO: 58971
  Genomic contig location: Contig_ID=SeqID_39798; Location=820..900; Strand=-
  SCN-specific regions: Sequence locations=1-13,47-81

SEQ ID NO: 68281 - DNA, 634 bp, Heterodera glycines
  Genomic contig location: Contig_ID=SeqID_39798; Location=988..1621; Strand=+
  SCN-specific regions: Sequence locations=1-28,54-57,93-142,164 -176,207-336,381-447,478-634
atgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaaaaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagagtgcgcatgggcggcgaaggcgaccgagcaagtg

SEQ ID NO: 68282 - DNA, 116 bp, Heterodera glycines
  Genomic contig location: Contig_ID=SeqID_39799; Location=798..913; Strand=-
  SCN-specific regions: Sequence locations=1-116
gttgtacctcttctaatcacagttgtacctcttctaatcactttgtacctcttctaatcactgttgtacctcttttaatcacagttgtacctcttctaatcactgttgtacctctt

SEQ ID NO: 68283 - DNA, 770 bp, Heterodera glycines
  Genomic contig location: Contig_ID=SeqID_39800; Location=1..770; Strand=+
  SCN-specific regions: Sequence locations=1-12,37-49,230-246,271 -298,483-521
  Gene Ontology: Mol. function=myosin light chain kinase activity; Biological process=mitotic chromosome condensation
aagaggaagataaagtggaagataaagtggaagaggaacagaaagtggaagaggaacagaaagtggaagaggaacagaaagtggaagaggagcagaaagtggaagaggaacagaaagtggaagaggaacagaaagtggaagagaaagtggaagaggcacagaaagtggaagagaaacagaaagtggaagagaaacagaaagtggaagaggaacagaaagtggaagagaaagtggaaggggaacagaaagtggaagataaagtggaagaggaacagaaagtggaagaggaacagcaagtggaagagaaacagaaagtggaagaggaacagaaagtggaagaggaacagaaagtggaagaggaacagcaagtggaagataaagtggaacagaaagaggaacagaaagaggaagataaagtggaagataaagtggaagaggaacagaaagtggaagaggaacagaaagtggaagaggaacagaaagtggaagaggagcagaaagtggaagaggaacagaaagtggaagaggaacagaaagtggaagaggagcagaaagtggaagaggaacagaaagtggaagaggaacagaaagtggaagataaagtggaaggggaacagaaagtggaagataaagtggaacagaaagaggaacagaaagaggaagataaagtggaagaagaacagaaagtggaagaagaacagaaagtggaagagaaagtggaaaaggcacagaaagtggaagagaaaacagaagtggaagagaaacagaaa

SEQ ID NO: 68284 - DNA, 1012 bp, Heterodera glycines
  Genomic contig location: Contig_ID=SeqID_8495; Location=722..1733; Strand=-
  SCN-specific regions: Sequence locations=1-102,148-252,279-402,426 -526,548-589,611-716,738-1012
  Gene Ontology: Mol. function=structural constituent of cuticle; Cellular component=extracellular; Biological process=positive regulation of body size
tctccgatgtgcgcattgtcggaggagacggacctgaaagcattgctgcgtgaagcagaaaatttccgaagggttgccttcttcggcgtggttagtaaagttcggagagagggggagggggaattgtaaaaaatattttaaaaatcaaccaaagtttattgacgaaggaattgaacccgatttttggtttataaatcccgaatctggtccaaatcgaatcattttctcgaaatttcaaattttaaatcgaccaaactaaataaataatgaaaatggcaacagacgacagcagtggttgccacgctgatggcggtgatgtcagtgccgatgatgtacaattatgtgcagcaaatgcactcccaaatgcgtgacgaagttggacatttagggggggggggggagtttaaatttttaaatttataaatcagtgatttttcgttgcataaaacattcccaaaattatgcaggcagatttttgcaagctgaggtctaccagcatttggaaggaagtggccagggcacaggtcagctaaaacaaaatgggaaaattttgaaaattttcttttgaacttttcagtttgttgcaggaactctttcagtttctgaaagccaacaacagattcaacaacaaaggcacaagcgccaactgcagcagggagcttatggggcaagtgccattgggggaggggggctgttcaagtttaaaaattaaattctatttttatggtaaaatatgttgagttttactgtcgaattcaaacactgtcgattttttgctttcttgcataatcgtactcaccaatttgttgaacaaatgatcccgttaagtcatcgccaattggcgctgcggtgaccgacggtgcttatgtgaccgctgccgcggcggcagcgcaacagagcacgtgctgtggctgcggacagagcccgcaaggcgtgccgggactgccggggatgccgggcagcgacggagccccggggcagcaggggccgcccggcaaagacgggcccgatg

SEQ ID NO: 68285 - DNA, 563 bp, Heterodera glycines
  Genomic contig location: Contig_ID=SeqID_39802; Location=15..577; Strand=+
  SCN-specific regions: Sequence locations=1-563
cacatgggcgtgaatcagatgctaccctccgtctcccgttcacttacaatgtcacgaccgttgccatttatggctatgccgccgctttgaagcggtaatttgtttgctgaacagcagcgacaatgcaattgtttgttgcttttagtttcgcgccgaacatcaaaataatccattttcttggcaagcaaaagccttgggctctgctctacggggacggcgctgcggggatggcattcgtttcggactatcacaaggtgaaggggatgccttatattgaacgcattcttttcaaaaagggtgcacttcacttacaccccgccggttccccaccttcccgaaatttgaaaaaaggttatacaaaaaggtttagattttttcttgaaaaatttctgtttgaatattttttcaaaattttcggccgggtaacgacgtgtaagactccgtttcaaaaatacgacatatttggtgtttgttcgcatgcttttcaatgttttaacccatttcagcaatggtaccaactctacgcaaacattgtccagcaacttctgcctccgtcctcttcg

SEQ ID NO: 68286 - DNA, 411 bp, Heterodera glycines
  Genomic contig location: Contig_ID=SeqID_39803; Location=77..487; Strand=+
  SCN-specific regions: Sequence locations=1-210,232-411
atgaccaactccaatttggactcaattatggcatcttcgacgccaattgaatttgcggtaaatggacgtggcgaaggagcggcgaaggtgccatttggaaaagggacaacggacggaatggcaaaaataattacagacggaaagggacacttttgtgggggcggacgaatggacgacggaggacgacgcggaaaagcgggggacgacgggcagaaggaacagaaacaaattggagttggacagaacgtcacgaccctcctcagtgcacacgttcgatgggaagggaatggcaaacgaaacaatttgcgaagctttttcagttacaattccatcgtaatcatcgaatattcggacagcccaagtggcgaccagcaaaaatgccaacgcccttcagtcagactttcgtcgtaa

SEQ ID NO: 68287 - DNA, 762 bp, Heterodera glycines
  Genomic contig location: Contig_ID=SeqID_39809; Location=362..1123; Strand=+
  SCN-specific regions: Sequence locations=1-358,380-428,460-460,532 -590,624-762
atggctgaagcatcttcaaacggcaccgaaatccacggcactatcattttcgctgcttatgccatggcatttttggaacttggcacatttattccgacaattccaattgtggcattctgcgcttcaattttgtacaaaacttccattcttcaccgaaaccttaagggcattctgttggcccaactgtttagcataatgatgaatttgtggccacgtgcctttatgttaattgcccaaattttcgtgacgaaaaatatttttttgttgccaccaaattttatttctggcgcagcgactgcggcattgacattcaacaacatggcaggccatgtgctgattgtggagcgaatatgtgcaactgtttatgtgggcacttatgagagctaccgtagttggacatttacggcactttggctgtcaattacggtaaaatttcattttcatttatttatttctgtagtattattttattcattaatattcttaataattttttaataaataaattcacctaaaattttttaaaaatatctcttgtttcatcatcattgagtaattaactttgatattaattaattagaaatatttcaaattaattaattattaattaaattaattaattattatccgtatttaaagatcatcctttgtttggcattaacaatttatcaattgcttgttttggattcatcgtttgcatttacaaatatttttgtgggtctgtacatcggagcaatgatcgccagtttaatcgaaattttt

SEQ ID NO: 68288 - DNA, 827 bp, Heterodera glycines
  Genomic contig location: Contig_ID=SeqID_8497; Location=156..982; Strand=-
  SCN-specific regions: Sequence locations=1-153,187-743,767-827
atggagccaatcgaacaacaacaaatacaacaacaacagattcacactcagcagcagcaacaaccgccgcaccaaacggtgccgaaaattgtcggcgccaccgtttttcaaccggacgaagcagcgccgccgccggtggtggtcagtccgacggcaccaccagaagaggaggaggaggagggcacgacagagccaatgggaggcggaagtcgaaaaggcagtcaaaatgtaaggaaaaggaataattaactaattaataaggcaattaagagtaattaattgctaatatattgtgaggatgcgacagcatttgctgtttgtttgaaattccaattataattaggaactgaacggcgaagacgacccctccggcgccgatcggctgactccgtcgcaggatgaaagcaacgaagcattgacggaggagcgaattcgagaattggaggagcaaatgcaacagatggagctaaggtgggcactcaaaatggaaaggaatcaataggacccgcattttagtgatgaaaacaacaacccggaccaacacgtttacagtcggaagttcctctatttcattcgcaaagtgactatggtaagcaaagcgaaagtcccgtggcattacggtcatttacagtgttcttctttatgtacagtatgccactaaaaacaaaaatcatttaattaaactcctgacaaattgttaatttgtattcttttaggcactcaaaacggtgaactgtccaaaatcggaggaagatttggaggagttgggactgagccgacgaggaatgccaattgtccagtctttctcagtgggaggaaagacaaag

SEQ ID NO: 68289 - DNA, 1223 bp, Heterodera glycines
  Genomic contig location: Contig_ID=SeqID_8498; Location=16..1238; Strand=-
  SCN-specific regions: Sequence locations=1-47,70-193,230-1223
atgccacaggcattgctgataactccgcagcaacaacatcaagcatatcaccaacagcaacatcagcaggtgatggccagcggaccgaataattaatcgatttccaatttcgaaatttcccaattgatttttcggttttcttattgtccatttccattttgtagttgctcgctgcccagcaaattgccgttgctcaacaacaacagcagcaacagtcccaccctcagggctccatgcccatgccggcccaccatggtaccgccggcatgccaatgccgtcggtgaccagtgtggcgcaaatgccgcccgtttctgtgatgagcggtgccggcaccgtttctgtcgccgccgctgcccaacagtcggccgccgtttcggttgcgcatggcatagtgccgcaagggacaacgcatttgcaaacggtgggctattttcgtttattgcccccccccattttgttttttgacgttttcctgtaccacagtcattaatcacttaattacttacaccttcctttttccctccagacaaatgtcgtggtcacttccactggtcctggccaaccaattccgccgcagcagcaattgcagcgcgagaaaaagttactgaagttcactcacccggagactaaagaggtcatttcttgggcaagagaatgccttttagccattaaaaaaatgccatggcttttcccttggcttatttttgttggcacacacaaaaaagtgaccaattttccaggaattggatttgtccacgggaataacgaacgattcgaagagaaaaacgaagccaacaacggacggaaaggacagagaggcggaggaaacggacaaatccaaccacgcgaaggagttccaaaagaaaatcgcagaacggctgaagtacggggctgacagcgacgattttaaagcggaagggaacggcacagtgccgacgatcactccgccgccggcagtgccggtgggtgaaaaagtgccgaaataaaatgccaaaaacatagtgcaaaactgtgataattctttcagatcgccagggaaggaaatgatgatcagacgaaacaaaacgatgggccaacggcggagagatggacacaaaaagtgccgccgccttctcaacgccaatatggccaaggtgagctgggcatgttcattgtcaatttggtaaagagaaacggagagaccgaaactggtaaaacccatggaaattcggtcaaccgatga

SEQ ID NO: 68290 - DNA, 924 bp, Heterodera glycines
  Genomic contig location: Contig_ID=SeqID_39814; Location=529..1452; Strand=-
  SCN-specific regions: Sequence locations=1-298,320-413,436-550,574 -591,617-632,654-671,693-879,902-924
atggttctcgtcagcgaattttgtgctcaatttctctcctgcccgacaaagtcacttcgcgatcgactgaaccatccagaggaccgagtccgagttttgcagcaattgattgggaaaaaggtccagacaacatacaaggatcggaatggaatgcgcaaatctttcctcgttggtggaatgactgaacgaggcgcggcatttgaacccgcatatggacgtctgcgtaagccgttcaacattaacgtggcagcgcatttttatactcgtcaccgtgtcaaattgcactacccctatgtgccatgcatcattgaaggctttacgcgtggtgaggaccgttattatccgatggaactgcttgaaattgtcgacgacaaaaagggagggcgattatttggtcgattgttcactgaaattgaggagcaggaggaggaggacaccaaaagtgaagcttcacattcttccaactcttcctatttacaatttaacggtaaaggctgcaaatggtatgaaagcattgacgaaattaccaacactgggcgtggtgagtgcagccaaccatcatcatcatcagcacacacgtactggtgaacacaaacacacaccacatacacccaaatttgccacaaaattcatattttttgttaattatatcttccttttcttaactatgcattttttcacctaaaaacaaatactcccaacgcttaattatgttttggcttaaaaacttgtatcttctaatccttaatttttttaaattgtatcttccaatccttaattatgcactttttctacctaaaagttacatcttccaacgcttaattattttcaaatttcatcttccattcgttaattatgcatacatttttactaaaaacatgaataaaataacaaaaaagagataaaattgcagaaatcaagtaa

SEQ ID NO: 68291 - DNA, 202 bp, Heterodera glycines
  Genomic contig location: Contig_ID=SeqID_39815; Location=459..660; Strand=+
  SCN-specific regions: Sequence locations=1-70,92-202
atggtccggacgcattatgtgatggtgagagacgagcagcagatggggacttacagtaccactcttacaataaaatgaaattacagtatgacaacgaccgactgctgagaagcaccgattgtcacgagcttttcgggagggtggcagacgaatcatgcgaaaatgagaaggaaacggacggaaaaggaagaacggaccaccg

SEQ ID NO: 68292 - DNA, 555 bp, Heterodera glycines
  Genomic contig location: Contig_ID=SeqID_39816; Location=319..873; Strand=+
  SCN-specific regions: Sequence locations=1-104,134-247,270-555
tctcttgccttcgacagtctttcaattgattcttctgaaatcgacattgacaatggaattcgtttgccaaattgtgatacgctaattaaacccgcaattgtaagtttttttaaaattttatttattttaattagtgtaatttcagcgtcaaaatccaactttactcggaaaaaaacttccaaaaataaaagaagggattacaacggatttttatcgcattataaagcgcgccttatatttgaaaaaagtcagtgccgaaaaccaacaaattccctcgttgttggtctcgcgccttttgcttaccgattcgatgctgtcttcattggaaggcgacctttttcgaaacatggatctgatgaagcttgactatcctcggatgccaatgtgagttttgtttcgaacattcgccgaagaattaccgggcgaagacatatccattcaaattcaggtggtttttggagacattggaccattggtttgatgacaatgaattaacttttgtcaatggaggagtttttctctattcaaaggcaagatttactagcaatttctctg

SEQ ID NO: 68293 - DNA, 636 bp, Heterodera glycines
  Genomic contig location: Contig_ID=SeqID_39821; Location=1..636; Strand=-
  SCN-specific regions: Sequence locations=1-192,216-358,380-636
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaagattcggtctccccataaatctgggcgcatcggttcggggggactgccccgaaaaaaaaaaatcgatttttcaagtgtccgtttgaggtactcaaacaaatatggggagcaaaatccaacgcagaataaaagtacggctatagggaagctattcggaaggattcggtctcccctaaatctggggggatcggttcggggggactgccccg

SEQ ID NO: 68294 - DNA, 1894 bp, Heterodera glycines
  misc_feature (53)..(53): n is a, c, g, or t
  Genomic contig location: Contig_ID=SeqID_101; Location=29..1922; Strand=+
  SCN-specific regions: Sequence locations=1-436,461-621,645-770,792 -902,924-1894
  Gene Ontology: Mol. function=ubiquitin-protein ligase activity; Cellular component=proteasome complex (sensu Eukarya); Biological process=ubiquitin-dependent protein catabolism
atggaaggtgcctccttcgtacggcgactcgggcggtccttgatgggaggccncccaatggtacaagtctctgccgtcatccatcggtgccgcggtgtaacccgtcgtgaccagttcctgatgcagctccgccagttcctgcaaattggtcaaaacatttaaagcattggctgatcagtgttgtaatttcgttccaccttttggatgcgtcgacgtgccattgcgaaaacggcgagcgaattgatgtgaaggacggacggacgaatgaacgatgagaaacggcgatgaggtcgcttttgaagtgttgttgttattgcacaatgaagggatgatgatgataaacgcaaatagttctgttctaaaaaaggaaaaaacataaaaacaatacataatgaaatgaattataaatttaaaaatagggaaattgcagtttttgtaaaaaaaaatttttataaatttaggttcaaatttggtagtataggccagggaaactctgataaactttcaggtcgatgtcgataatttttggaattcgggttgggtatttactggttaagataagaaatatgtctttttgaaacagtgaagtttatgaaattcacaaaaaacagagtaaaacactcataaaagaaaaatgagtgaatgaaaagggaggaaaagggggcacaatatttatagtacgacgcaacaagggagggcaaaagttaggtaggaacgtaggtaggtaccattgcccaaattccaaggttttctctctatataaggaggtgtttttctcactggactgacattttttgcattacgcctatatgcttttcttacttgttccctcctctattcagtccttaatgttctgatttaattttttgtgttacagagtacgcaaaatataattaacccgaatttttccaattgttttttcaatcaaaattgactgtttctcacagaattttcctgctggacaatctaaacttggaatttaatcaaaaaaccccaaaaaaatgcttttccctatttgtaaaatttataattcatttcattatttatgtttttatgctttttcattttttagaacacaactatttgcgtttatcatcatcatcccttcattgtgcaacaacaacaacacttcaaaagcgacctcatcgccgtttctcatcgttcgttcgtccgtccgtccttcacatcaattcgctcgccgttttcgcaatggcacttcgacgcatcaaacaggtggcgaaatgacaactctgatcagccaatgctttcaatgttttgatccatttgcaggaattggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccatcgcgactacccattcactccgccagttgtcaaattcgaaacgcccgtttaccatccgaacgtcaacaagcagggtggcatttgtctggacgtcctgaagatgtcgcattgggcgccgtcgttgaccatttcgaaaggtgaaagcgacgcgggaaagagcagacaaaatatcgacaagacaaaacgatccaattcaaaacgaccaccaaaaccggactttttggaaaagtgtcgatattttgtcgtgtaaaatgggatttttcaaattcggaaatgccgttttaattcattgtctcccctccatttcagtgctgctctccatctcttcgcttctctgcgacccgaatccggacagtgcgctggagatggacatcgcgattatctaccgcaacgaccgcgagcagtacaaccgaaatgcccgtgaatggacgcagaagcacgcgatgaaatga

SEQ ID NO: 68295 - DNA, 146 bp, Heterodera glycines
  Genomic contig location: Contig_ID=SeqID_101; Location=242..387; Strand=-
  SCN-specific regions: Sequence locations=1-146
gaacagaactatttgcgtttatcatcatcatcccttcattgtgcaataacaacaacacttcaaaagcgacctcatcgccgtttctcatcgttcattcgtccgtccgtccttcacatcaattcgctcgccgttttcgcaatggcacg

SEQ ID NO: 68296 - DNA, 888 bp, Heterodera glycines
  Genomic contig location: Contig_ID=SeqID_101; Location=5644..6531; Strand=+
  SCN-specific regions: Sequence locations=1-35,60-332,355-357,531 -743,765-888
  Gene Ontology: Mol. function=structural constituent of cytoskeleton
gtataaaaggggtcgtctttccctccgcttcacatttcttcttcttcttcttcttcttcaccacactccaaccaacgaaccgcttcagtgcgcaacgcaacgcaatggccacttacctattcatcgctgctgctgccttcggagcaggaattgtaatgctgcgctttcttcattttttcaatttgcatttcattacatttttgtccttttcagtactgttggaaggcgtacctcggcccgatgctcgaccaaacgaagagcgacgacgaggagaagcccaagccggaaggaggcgaagaagcgacgaccgccggcgacaaggaggagaagaaggctggcagcaagggcgacaagcacaagaagaaggacaagaagggcgaaggcgcagcagcagcagcaccagcggcggacaaaaaggaggagaagcgcaaagacaaacaccgatcgaaggaggcggggaagagcgacgacagcaaagcgggcaagaaggacaagcacgggaagaaggacaagaagggcaagaagaaggacaccgccgatgcatccaccgtggacgaagcgctgggagaacagagcacagcggagacgagccaagcagaggaatagccaggccctgctgcgtgcaaatgacagtgttcgacgacgacgtctcgcgacaccaacacacccgtcccttgctttcgaccattcccttcccatccgattgctgtgttttgtctgttccaatgcttcttaaatgttccccttgtgaacagtgatccttccttatgtggcctgaatatgtatatattgtatacccattaatatattgtgcttcgcttgttcgatatttgtgaaatctcattcatattcatcgtcattgtatttatatgcacatttgatatatta

SEQ ID NO: 68297 - DNA, 944 bp, Heterodera glycines
  Genomic contig location: Contig_ID=SeqID_101; Location=6925..7868; Strand=-
  SCN-specific regions: Sequence locations=1-323,345-642,665-714,747-944
  Gene Ontology: Mol. function=ubiquitin conjugating enzyme activity; Cellular component=proteasome complex (sensu Eukarya); Biological process=chromosome organization and biogenesis (sensu Eukarya)
atggcggagctgcatcaggaactggtcacgacgggttacaccgcggcaccgatggatgacggcagagacttgtaccattggaaggcctccatcaaaggaccgcccgagtcgccgtacgaaggaggcaccttccatttggacatcgttttccgtcgcgactacccattcactccgccaaatgtgaaattcgacacgatcatttaccatccgaacgttggagaaaggggcgacatttgtttggacattctgaagcagatgtgggcgccgtcgttgaccatttcgaaaggtgaaagagcagacaaaacgccgacaaaatatcgacaagacaaaatggtccaattcaaaacgacagccaaaactgtactttttggaagtgtgatattttgtcgtttgaaaatgggatttttcaaattcggaaatgccgttttaatccttatcccctctccatttcagtgctgctctccatctcttcgcttctctgtgacccgaatccgaacagtgcgctgcggcaggacattgcgactatgtaccgcgacaaccgcgaggagtacaaccgaattgcccgtgaatggacgaagaaccacgcgatgagatgacacgacaaacgaccgatggatgggagagatgcagaagacaaccgccgaagagggaggaggaggaggatacattcaactgaccctattcccacatatgatcccaactgtaaagattgtattattgtatctcactgtatgtacagtattatgtcgcctggttactgtttaagcgaccataattgtctgttgttggttgatcaccattatcaatgtgttgtatctctgtgttatcatttcaaatgacttgtgatcaattgtttcgcctaatatgtattaactgtgatgaaacgtgaattttattaaagacctatagacctttttgattgcaaaaaatgtttccataataaa

SEQ ID NO: 68298 - DNA, 146 bp, Heterodera glycines; identical to SEQ ID NO: 68295
  Genomic contig location: Contig_ID=SeqID_101; Location=7946..8091; Strand=-
  SCN-specific regions: Sequence locations=1-146

SEQ ID NO: 68299 - DNA, 688 bp, Heterodera glycines
  Genomic contig location: Contig_ID=SeqID_101; Location=8941..9628; Strand=+
  SCN-specific regions: Sequence locations=1-688
  Gene Ontology: Mol. function=ubiquitin-protein ligase activity; Cellular component=proteasome complex (sensu Eukarya); Biological process=ubiquitin-dependent protein catabolism
atggcacttcgacgcatcaaacaggtggcgaaatgacaactctctgatcagccaatgctttaaatgttttgatccatttgcaggaactggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaaggtgaaagcgacgcgggaaagagcagacaaaatatcgacaagacaaaacgatccaattcaaaacgaccgccaaaactgtactttttagaaaaatgtcgatattttgtcgtgtgaaaatgggatttttcaaattcggaaatgccgttttaattcattgtctcccctccatttcagtgctgctctccatctcttcgcttctctgcgacccgaatccggacagtgcgctggagatggacatcgcgattatctaccgcaacgaccgcgagcagtacaaccgaaatgcccgtgaatggacgcagaagcacgcgatgaaatga

SEQ ID NO: 68300 - DNA, 926 bp, Heterodera glycines
  Genomic contig location: Contig_ID=SeqID_102; Location=397..1322; Strand=+
  SCN-specific regions: Sequence locations=1-363,385-479,502-891,913-926
atgcgaaaaggcccaaatgattggtctccaaatcgaaaaggcaaatggcaaaatctgcggggacaaaaagtaaaaaatggttataaaatccggaaaattggcacaaagggaggggagagattccatttggcaaaagtggaggaaatgagcgacttaatcgaaccggacaaagtgagggcattttggccgcaaattctttgactaaatctgtgcaatttatgccaaaaaggaatttaaattgaggcgatacatcgactaaaagaatttggagccaaacacatcattcataaaaattagttttttttttgtgagatatttagaagctcgcacctttgttttatggctttctcgccgccattgaatggccagacccaggggcagtggaagagacccattcaaagcacgcagtgccagggaaagacgtcgcatgggcaacaaaagaaaggcggccgcagggactgctgcaaacgtgggttttattctgctcctgtgctattcggccttcaattgttttttcttttcactttttggcacttttccagcagacagagcgaaggtcgaaatttcatttctccctttttcaggtgcaagctgccaacaggcgccccatttgtctgatctgcttgaagaaaatgacccaagtccgtcaggtgcgcaccatctgtgaccacgtgttccactacgtctgcttccaccgttggctcaaatatcgtctgttttgccccgtctgtctgctcaactttcgcacggaattgtatcattcgggaaacgccgtgtttgagggcgcgtacaacgatggacacgttgtgctcatacctgatggtgaacaaagcaacagtggataagtgatcggcactcatctccaattgtgatcggacaaaagcgatatctaattttgtattgtacataaataggttattcggaca

SEQ ID NO: 68301 - DNA, 1218 bp, Heterodera glycines
  Genomic contig location: Contig_ID=SeqID_102; Location=727..1944; Strand=-
  SCN-specific regions: Sequence locations=1-18,41-90,123-311,333 -447,469-636,658-1047,1070-1164,1186-1218
atgcagaagacaaccgccgaagagggaggaggaggaggatacattcaactgaccctattcccacatatgatcccaactgtaaagattgtattattgtatctcactgtatgtacagtattatgtcgcctggttactgtttaagcgaccataatgtctgttgttggttgatcaccattatcaatgtgttatgtctctgtgttatcatttcaaatgacttgtgatcaattgttgcgcctaatatgtattaactgtgatgaaacgtgaattttattaaagacctatagacagacctttttgattgcaaaaaatgtttccataataaatcatgaaaattcattcatggattttcggggttgctcgcatcagcaactggcaattgtctaaatttgttgtcccgataaaaaatagccagaattttcggctttcctttgcagcgattttagggaaaaagttctgattaagaatattgcgttaaatgatttatcgaatccaaatttttcacattcattttttcaatggcggcgagaaagccgatgaaacaaaggtgcggcgagttgggcggtgccctccacaaaatttagaaaaccacgagccaatttaaaaatgcacattacagttttattgtccgaataacctatttatgtacaatacaaaattagatatcgcttttgtccgatcacaattggagatgagtgccgatcacttatccactgttgctttgttcaccatcaggtatgagcacaacgtgtccatcgttgtacgcgccctcaaacacggcgtttcccgaatgatacaattccgtgcgaaagttgagcagacagacggggcaaaacagacgatatttgagccaacggtggaagcagacgtagtggaacacgtggtcacagatggtgcgcacctgacggacttgggtcattttcttcaagcagatcagacaaatggggcgcctgttggcagcttgcacctgaaaaagggagaaatgaaatttcgaccttcgctctgtctgctggaaaagtgccaaaaagtgaaaagaaaaaacaattgaaggccgaatagcacaggagcagaataaaacccacgtttgcagcagtccctgcggccgcctttcttttgttgcccatgcgacgtctttccctggcactgcgtgctttgaatgggtctcttccactgcccctgggtctggccattcaatggcggcgagaaagccataaaacaaag

SEQ ID NO: 68302 - DNA, 697 bp, Heterodera glycines
  Genomic contig location: Contig_ID=SeqID_102; Location=3658..4354; Strand=+
  SCN-specific regions: Sequence locations=1-697
  Gene Ontology: Mol. function=ubiquitin-protein ligase activity; Cellular component=proteasome complex (sensu Eukarya); Biological process=ubiquitin-dependent protein catabolism
atggcacttcgacgcatcaaacaggtggcgaaatgacaactctctgatcaaccaatgctttaaatgttttgatccatttgcaggaattggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaaggtgaaagcgacgcgggaaagagcagacaaaacgccgacaaaatattgagacgacaaaacgatccaattcgaaacgaccaccaaaaccggactttttggaaaagtgtcgatattttgtcgtgtgaatgggatttttcaaattcggaaatgccgttttaattcattgtctcccctccatttcagtgctgctctccatctcttcgcttctctgcgacccgaatccggacagtgcgctggagatggacatcgcgattatctaccgcaacgaccgcgagcagtacaaccgaaatgcccgtgaatggacgcagaagcacgcgatgaaatga

SEQ ID NO: 68303 - DNA, 2871 bp, Heterodera glycines
  Genomic contig location: Contig_ID=SeqID_1128; Location=140..3010; Strand=-
  SCN-specific regions: Sequence locations=1-232,306-672,694-765,797 -1068,1090-1186,1341-1582,1604-1626,1648-1752,1792-1987,2025 -2351,2389-2415,2439-2534,2560-2641,2663-2737,2869-2871
atgatgagccggtctgctcaaatttgcagccaaaatcgctcggcacatccaagcaatttgctggtgtctcaatgcttgcaacggtcgcggaggtcaaaaaatgggtccacgcgctgtccaacgaactgtcaaagcgtttggtggccgacgatgataaggcaggcgaagcgaattttttttttgttttttcattttttgaaaaaaaatcttgtactataatttacagtacaagatttttttcaaaaaataaaatattttaaattttaatcaaataattaacaaacaaaaatattttaattttaaatctatatgtcttgaaatttcgagaattaattttttgagtgttttacataaattttcattggaataataattatcattttttaaaatttccaccctcaatttttttttgtctcttgaattttaaattgattggaattatttttttttttttttgatttttctaccccatttttgttttgcagtatggtcgcattgctcaaacattggtggtcggcttctccgccgggctaagcgatcacaatgtccgcacaatgcacttgcccaactacacaacggcgggcatccaacaggcatgctggaacttcatgcgcccattcaatcgtgagaaggacggccattcgtggtacgggtacaggtcgaacaacaggaggagggggcggggtgaagacgacaagggcagtcctacgaacacgtaccaggcttcgtaagaacagaaaaaaatttctggactggaaatccgcgaatattaaattatttatttatttatttttttgctttttggcccactcgaaaaaaatttatggggtctctggcacccctagcaaaattttgggcaatttttttttgattgcaataattgaaaaaacaacaacaaattcgtcaggtatccgcatgtcagttgcatttacatgtccgcgagtcgttttgaacttgttgatcgccggctgcccaccagacgcatcaccgaattcttccacaaaaaagccttgggtgttgaatgtgatggccaacaacaatgttcaggttggttttggcaaaattagtacaattaaaaacaaataataaatacctaatcataataaaatgaacgctttcaacagttcccccacccccctcccacccgaaataaataattaaaaactgatttggtttttcgcatctgaaaaaattaaaaacttttaattttttaaatttatggggtttttttaataaatttttaaatcttttttcttgtttaaatgttctttttttcgaattgtcaaagaaaaagtttttttttaatcttaattttttaaacaaatttaaaaaattattttgcacaaatttctcgaggtatcgtctcaattttttcaaaaatattccacattaaaatttcggtacaccccaaaacacagccgccgaaaacacagccgagacataacacagccgggaataaacttttaaaaaaattttcaaatagaaatttttcaagaaaaaaatcttagaaaaagttttctttgaaaattctatgagaaaaaaaaaatttcaagaaatcttcggcgatttttttttgaaaatttattcccggctgtgttttgggcggctgtgttttgtcctgttccgttaaaatttttaaatccctccaggcaatggcgatgatgaagacgatgacgttatctttttggctgaaatgaatttgccaaaggaatgcgacggcggtggcaatgcccaacggcgggaggacgacaatgttgagcagcagcaggaggcggcggcatgcagcaacagtgaggcgcaacagcccgctaatgatggtaaacatttgggatgcttttttggacaattttttggttgctgcatcatatatatgaaaaagggggggggtcgacccgccaacccttcctcgcttgggaaaatttgtttttactaaaaaaaaaaatttcaagaacaaaaatcatagttttttttgtaagaaattccaatacaaaaattttccaaaattttttgtttgaattacttttcaaaaatgttccaacaaatatttttggcactttgagtcggaaaatgcatataaatgataatataccattgaatagagcaggttcgatatgttcccttgttagaaatttgaaaaatttgtaaatattttgttccttttttttcttttaaattaaaagtactatattagtatactgtaattatctgactgttcggcaatgatagtcactatttcggctgtgggtagggggtactgacaaactttttttttttttgctttaaccactgcgccttcaccattttttcgctctgtttttaaacaagaatttcggtgaagagaagaggggaagatttatttttgtaaataaatttttttttttaaatttacattttcccctattttcaggcaccgacggggatgatgaaattgtatttttgggcaaacagaaggatgaacgtcacaatggacggcggcggcggcggcggcaatcgttgacacggctcattacggaattttaccgcccacggcagcagaggatgaggacgatgatgatgatggccaaaccaattttgtgtgcaaccggcaataatgccgtcgatgtaacatgatggattgtttaaatgcattaacttttgaagtaaataccgcatgaattaaaaatttttttaacttaggaattaatgttttttatgcattatgaaaatgattattcaattatccaaaagatcaatcccaaaagaggaagagaagcagaagtggaacaaaagcaaagagaaaaagaacatgagggggatagaaggggaaaagaggaaggggaagagaaagggggagaggaacaggaggagaagacagaagacgaagaggaatag

SEQ ID NO: 68304 - DNA, 1428 bp, Heterodera glycines
  Genomic contig location: Contig_ID=SeqID_1129; Location=1567..2994; Strand=-
  SCN-specific regions: Sequence locations=1-102,128-222,250-338,360 -456,485-1103,1151-1170,1192-1195,1226-1353,1402-1428
atgcgccatctttgtccgatcatccatttgtgccgtgtgcctgcaattgaaggcgtggagaagggagacatcagcaaataccggtgagaattttttttttgatgggggtagaaaatttcattcccttgtaaatttccgccatttacgaatcaatttggtattttttaagtgcaaaatactagataaagcaaccgctctcaaatccgagctaaattactcaaaaatagttgggaaaaaatttttgcaatcaaatttgattcccaaaatggacgttttctaagaattttttcaaaaattaatgaaaatttatcaaaaattcgcgaaaaataatcaaattctgtaatttatgtaattttacagggacgcaagtggtgaaatcttcaaagtgctggtcgatttttcggatcaaattgtggtggaaaaggcgtcagttgacgaggtcggaccatttttggcaaaaaaatttttcttttatttttttaaaggcatttttggatttgactgcgcactgtgagatggaattaaacagccaaccaatggaggaattggttcaaaaggtactcattgttaatatctttttttagctgaaatttctatgttttttgcaaaaaagtggatttgacaaaaatttatgaccgaaaaactcaaaaaatgaaccaaaaaattcaaaagtagtctttttgagatttacgggtattgtgtcgagggacggtcccaatgggttccccaaaaaatgtcgtaaatcgcaattcttacaccaaaaatactggaaatttttttgtacaatttttaccaacaaaaaaaaaaaaaaatcattttagctgaacgatgacattgcgcagctgttcccgaacacttttttggtcaacgaaagcgacaaacaacagacagtgatcgcggaggaacggttgaacagcttgaaggagtggttgagcaacgactgtcgcgtctccaggcaacaggtagggcgggtgcataacatgaaaaatgggtgggtgcgtttttttgcaaaagaaaaaaaaagattgggtaacatgacgggacccgtattgtcatttgtccggaaaattttaattttagggccaggctccaattgacgaaacaaatttttaaatttgttaacaataaatttaaaaaaaaaaatttttttctgaattgtggttggggaccctgtgaaaatttttggtttttgctgataaattttcaaaaaaaaaaaaaattatttcattttgttgtatttttttaacagttggccattgccatcggtgcgacggttgttgaacggattcgcaaacgcgtcaaggaggtcacccaattccgatgttcggccggcatttcacacaacaaagtgccaaatttttctaattttttcataattttttttttgtattaatttttttagattcttgccaagcttgtttgtgcaag

SEQ ID NO: 68305 - DNA, 1151 bp, Heterodera glycines
  Genomic contig location: Contig_ID=SeqID_1130; Location=344..1494; Strand=-
  SCN-specific regions: Sequence locations=1-153,175-442,464-544,579 -625,655-1124,1146-1151
atgggggagtcaattcgggtgatcgctttgattgatatgggtaaggaagggaaagcatttttttggcttttttccaatttatgcattcaatcactgtttacgcgtcctcaatttccttttggccataatattcctgcttggtcaatcaatgtctaaaaaacaaacacaaaatttggtgtttttccggtatattcattgaataattttttttgtcaattgcatttaacaaagaatttaattatatagaaaaaaaaatctatagactttaagccttcgattgacaccaagaattttttttttttaaaaagggcggggtttccacgtttgagaaattttgctaattttaatgaaattaaaccatttttttttttgatttttcatttcataggcatacatacccctgccgaatttgaggaaattttttgccaaactttgtagatgccttttacacccaagtggaggagcgtgaacagccccatctccgcggccgagcgttggccgtcgttccgttcagtcgcggtacaaccatcacgggacagtaagcaaatatttctagtttttgaattattattttgtttttctaaatccgtccttttgcacctagcgctcacaacatcgtctctcgaattttttgattttttttttaaaatttaagcctccattgtttttcagggccattgccgtcaactatccagcccgagccttcggaatcaaacggggaatggacagcaacgaggtttgagtttcaacaatcaccaaattcaatttaatggtggcaatcctgcagtttactggtcccgtttttttttttttgtaaaattctgggaaaacttttctagggctattttattgtactgagcacgaatccgaccttatttttgacaaattctgaaccccgaacccggaatcgaacatttttcacaacaaaaactttttttttgcattaacgcagccaacaaaagtgatttatatgaatggtccgctccatgctctaatctcaatgtcactcctgaatcaccaattctctagtaatcgcgaaactatcatattattacatgattgccctatttcgtttaaatatgcaaaaataccaatatttctcgttcgtcttacacaataactgataaactgaatttttcccccttaataaa

SEQ ID NO: 68306 - DNA, 205 bp, Heterodera glycines
  Genomic contig location: Contig_ID=SeqID_1131; Location=3896..4100; Strand=+
  SCN-specific regions: Sequence locations=1-67,164-205
atgagagcatatgatttcatcaccgaggctcgacataaagttgtggtacaagcgctacggcaagcagtaattaatatttagttattcacaaaaataatgataacataattaagaaataaaataaacgattcaaaaattaaatttaaagatttaaaattaaattgaaatttgtcttggattattaatgcaacaatttccaaaagaa

SEQ ID NO: 68307 - DNA, 1166 bp, Heterodera glycines
  Genomic contig location: Contig_ID=SeqID_8499; Location=451..1616; Strand=+
  SCN-specific regions: Sequence locations=1-159,181-543,565-645,667 -703,725-955,979-1019,1041-1166
caattatcgtgcgaaattgccgaattggagaagttacgccaacaatcacaactcccaaatgttcaaaaggctatcgatgagctaattggaagatggaaagtgaaaaaggaagaacagaaaatggttatcggattgctggactttatttaatcgacagaattgcatttttaattcaaaaattaatcagaaaacggacaaagggacagcggagacactttcagccccgacagaagcaccgaaactgatcagcggaagtgtccacgttcgtccgacaaagaaactgaccacttacggtatggaaccactgacttagcggaccgacgaccactttcagaccaaaccaaatcaaatattcttggtatatttcgataaccctaacataagtgttctctattagcatgccaaattaaaaaataatatttgttgagtttgagttcaagaaagcttgtttttttgggcccattggtcgcgaaatatccaattagctttgaaaaaggcagagaaatcgaaagataccaacaatatttaatttggctgactatgaaaaaagaaaatattttttggtccattaaaggcctttccgctaattacccattccgattttattctactaattggctcttgcttttgggcttttcctccttaaacccaaaaattttgggttttgaggcgaaagaggtttcccttcccgcttttccattgtcatcgtttagcgtttgatgagagtgacaagttcgtgaagctgtactattccctgcccggtatttccgactccgtccccggcacaatttcgaccgatttccgtgaaaagttaaaaaaatattatatgagaagaaaattaataaagcatatgctaattgcagctctttttccattgtttgctccgacgtcaaagggattgactacgaaattcgagtgcaaggactttgtcagggtgagttggcattttgtcaagaaatgttttatttaaataaatttcccattttttgagctgttgagccggaaaagtgtgtggtgaaggtgcttatttttatgctgcttttttgaagtaaatcgaaatttaagcaaaaaagcggtgaccaattgttaattatgctgaagaaggcgaaagaacgacaaaattggggatcccttctgaaattggaaaaggaagtgggcaaaagcaa

SEQ ID NO: 68308 - DNA, 1214 bp, Heterodera glycines
  Genomic contig location: Contig_ID=SeqID_8500; Location=210..1423; Strand=+
  SCN-specific regions: Sequence locations=1-226,250-256,278-649,687 -1013,1037-1075,1105-1117,1139-1192
atgacaattttgaatggcttttcgcagattggcaccgccgtcgaagcggcggtcgaacgttttgtggccgttggggagacaatcgcagatgaaaaccccgacattcagccggagctgtacgacgcgtgcaacgaggcgcgaatggcgggttagcgatgggatgtaaccccaaaatttcataaataactgaaatttgccatttttagcgatgcgatgggttttttgcataaaataaaacccaaaaaatttcataaatattctgatatttccaattctgaggttcttccattgccaatttgcacaattcgctgctggcggaggagcgcagcgccgaccatccgccggaatttccctctgcgccggctgtcgtcgtcgattccgcccaattggtccgtgccgctcgccaactcctctcatccgtcaccaggtttaaacccaacaaatgggcaaaatgtccacaacatgcaatgaatgcgtcaaaatatgtcatcgtttaattatgaattgtttttgaaattccccctttttttctcaaataattttccgtatttttatgctgtcaaattccttttcacagagttttgctattggccgacagagtgttggtgaagcatattttgagagcggaggacaaagttcgtcagcagcgattaattaattaattactattaattattagttttatactattcatttgcaattcctttaatctaattattaaattttctttaagattgcctattccttgacaaaattggaacacacggccaatttctcagaatttgttcaaattttcaccgaatttggcaaccaaatggtcgatttggcccatcggtcgggcgacagacaagaggatttgaagagtgagaagaggagggcacaaatgcaggtgatgggacttctctgctggtcactgtgtttatttgttgggctgtccccccagggaatttattttttttaattttcaattccggaatcaaggcccaaaaagctccgaaattcgaaaattacccaaaattttaaattttataaaaatgccacttttgaagaatggagaattagtcagcaccttaagaaattttttatttgttaaattttatttatgaagtacaataatatttcagaatattctcattttttgatttcgattaaaaataatcggattttcttttagataaagatttttggagccaagaaaattttttgttaaaaaa

SEQ ID NO: 68309 - DNA, 2197 bp, Heterodera glycines; identical to SEQ ID NO: 8501
  Genomic contig location: Contig_ID=SeqID_8501; Location=1..2197; Strand=+
  SCN-specific regions: Sequence locations=1-204,229-1347,1375 -1540,1564-1932,1956-2048,2074-2197
  Gene Ontology: Biological process=apoptosis

SEQ ID NO: 68310 - DNA, 903 bp, Heterodera glycines
  misc_feature (874)..(874): n is a, c, g, or t
  Genomic contig location: Contig_ID=SeqID_39825; Location=373..1275; Strand=-
  SCN-specific regions: Sequence locations=1-46,68-139,161-182,204-903
atggtggaagtcaaaccaagtgaaagcatcactcaaatggtcacggaagcaaaaatcatttttgaatctgccggaatacggatccgcgaatttttcggaagtcacatcgacgagctaaaagagcttgactcatccgaattggccaaagacctcgaaaacacaaaggtgttaggcatcgaatggaagccaagacacgatcagctgatcttcaaaatgccagtcttcagcagtccaaccacaaaacggaagatcctgtcacacatcgcaaaagtgtatgacccacttggacttatttcaccggcactgttgcccgccaagcattttttgcaaatcgtccaaaatttgaatttcaaatgggacgatcctctgccggaaaagatggcaattgactggatcaaactaatgcatgcgtgggacggattcggcttcaacttcagggtggaattccctcgtcacatcgcgacaagttccagcgaagaatttcattgcttctgcgatgccagcaaatcgggactcggtgtcgcgctttatcagcttgcggacacttcctacggaaaaaaggaaagcaacttgatttttggcaaaagccatatcaaaccgctcaaagtggccgaccacgattcaacaattcctaaattggaactgcaagcgttaactttggaagtcaaagtgacaaagttcgtacaaactcaactcaatttcaccgacgaacaagtcatactttggacggacagccaatgctcaatcgaacggctcaaagaggaacggaaatacgacagattcgtcaacaataggctgaagaaaatcagagaagcttgtttcaaagtcagacacattcgcacggatgaaaatccggctgacatcgcttcacggngaacagacccacagagtctccaatcgtga

SEQ ID NO: 68311 - DNA, 596 bp, Heterodera glycines
  Genomic contig location: Contig_ID=SeqID_39826; Location=191..786; Strand=-
  SCN-specific regions: Sequence locations=1-239,263-596
  Gene Ontology: Mol. function=ATP binding; Biological process=protein amino acid phosphorylation
gacacattgaccaccatttaatcaatcagtcgaattgccattttttgaatttgccatccatttaccccaaaaattatgccattttgttccctatctttttcccccttaagcgtacattttgatgtccggcattatgcccttcgacgacgactgccgttctcggctgtacacacacatcatcacggccaattatgtgggagagagattttaatgaaatttgaaaccacaaattgggccgcaaaacaaatttaaactggaaaaataggaaaatttgggtgaatgggtcacattttgcaccactttttattttttcacctttgattttttaaaagaatttcgattggatttcacaaatttttagacggttttaaattaaatttaaattgttaattctctcgtgccaatttgctcatgaaatggggggaatggtgctgaatatgccccttgctcaggtgtattatccgcagttttggtccggctcggagcaggccaaacactttgtggacacacttttggacacttcgcccgaccatcgtccgtccgccagcgacgcgttgcaccaccattgggtgaccggcgatcggccgcattcgaag

SEQ ID NO: 68312 - DNA, 955 bp, Heterodera glycines
  Genomic contig location: Contig_ID=SeqID_39827; Location=346..1300; Strand=-
  SCN-specific regions: Sequence locations=1-61,83-955
atgaagcgtcttatcctcacccaaggccagttgaaacgccttcaactgctggacattgaacagtaccggcaggcggtgatcggcttttatgtccgggtcaactaccctgggctgccgtccaaattctcgacgacaatttttgtgcgtttttttgggtagtattttgctaggattttcctggattttttttttttgtaaaattctggaactttcacacgaactccctaaatttagtccaatttttttgttgtacagatcgaccaaattggtgacgtgatggaggccgagtcttttcaacatttgtggctgaagcggcggctgcgcctccgtcggctcggcgattattctattgacaaaattttgccgacacaaaatgtgaagaacgaccaggacattgtcagctggttcagctacatcgaagccaaggttttgtgaagtgtgcatttttcaaaaaaaaattgattcggttttttttgtttgaaaaattacaaaaatgtcgtttccatttttttattgagtgtccaacaatttttttttcaggaagaggagtcaccaacacttggctttgtccatcagaaacaaaatgatttggcacaggcaataaagacgcttgaactggacgattccatcaaaaaggaggaacgtggtaaggaattttgaaattttttttttgaaatttgtcattttgttttgccagtttcgccaccgatcaaaaaggataatttgattcaaattgcgctcagtccgtcaatgctccgtctgttggccaagctggagtttgagcgcttccgtgacactgtcactggctgcttcgtgttcatgccgtgtatcagcaaagaaaaggttgttggtggtggggtttagtattcttggtgtaccggcctatacgctacctatttgggtccaaccttgacaaaacattgttacatgcatttatttcctatgccttattaaa

SEQ ID NO: 68313 - DNA, 428 bp, Heterodera glycines
  Genomic contig location: Contig_ID=SeqID_39830; Location=411..838; Strand=-
  SCN-specific regions: Sequence locations=1-124,222-295,368-428
atgcaactctttagaacgtaagtaaatttgtgaaaaattggaggcaagaacaaaaatcttaattttttatgagatcactttttttatttgatcgttcctaattaaaatttacctttataagatgatataaaaattttatataaaattgaacaaaattttgataaataaaattttaaattaatttcttctgtaatttacgatttaaatattttattttaattcaacatttcatgcgttttcttttattattgaattcatccaattatcattttaaaatttatagccacttttctacaatttattaattttcataaactttttttcatgaatttattaaatctttcatgattatttattattatttttagagttttaattttcgcactcttcgcgacactcccgactgcgggtgatgttgaataattaaa

SEQ ID NO: 68314 - DNA, 4250 bp, Heterodera glycines
  Genomic contig location: Contig_ID=SeqID_8502; Location=183..4432; Strand=+
  SCN-specific regions: Sequence locations=1-293,315-531,553-810,833 -1077,1100-1210,1232-1829,1851-1880,1903-2065,2087-2431,2453 -2469,2498-2771,2793-3275,3297-3300,3322-3341,3364-3485,3507 -3539,3561-4250
atgaaactatcccaagaaatattgtcaaatatttacgttgataaccttttgttatgttgtgatgacccattggttggtaaaaataagatttcgaatgttatttccctttttgaaactgtgtcattaccaataagggaatttgccagcaattcgtccgaagcaatttctgatctccctaatgaccgtatgctcagtggtacgatacataaatttcttggtgtatcatggaacactctaaatgacaatttgttgttaaccgtatcaccaccccctgaaaatttatgtactaaaaggtcaattttgtcttttattgcttctaattttgacccccttggactcatttcccccgtaattcttcccctaaaaatttttatgcaaactctttgcgtggaatctgtcgaatgggaccaaccaattacactaaattcacaaaataaatggaatcatctttttaaaaattgggtacccgctgagaaaattgaaatcccccgaaatcccctcactctcccccttcaaaatcgatcatatgaattacattgtttttccgatgcttcaaatctcgccatgtgtgccgctgttttcctatgtgtttccaatcccaattccgagttttctgattgttttttaattttttccaaaaaaaagttaaaaccaaacataaaggaacaaatttgactattcccaaaatggaactcattgctgcagaaatgggctccaaaatgcttaatttactaattcgcttttaacaaatatttcactaaatccatccttaacctctcagcaacaatttggaaatttcgtacacccgcagccccctggaagggtggccattatgaacgttttgtagccctcgttaaattccatatccgaaaagttttaattggtccccgtccacgtgtttagataatgaccaaataaatcactacattgctttgtgaagttgaaactactgtaaatactcgcccaataacattcgattccgctaatcctggtgacctcagaccccttcgtcccattgattttatacggccattgggctttaatgagcctctattttcttccattgttgagaataccaaaaaataccatatagaaaattttgacagtactaattcatctctaaaagacttatggcatacaattaccaaattatccgaagcctttaaatcaaaatggacaagagattatcttctttcgctaagggagcgccacaaaaaattgggatgccattcaaattgtgtaccaaaaattggggaactcgttctggtacataatgaaaatactccccgctcattatggcacctcgcaattatattggacatattcaaaacagaaacaaagttgcctaatacggcaaaaataaaaacaataacgggtcacattaccacccgttcagtcgcccatttatatccccttgaaacggaaaatgaattttgtaatcgaacatgtgaaccacaaaagcccccaatccaaaaaattaaatggacaccataccccccaaattataaagcaaattctaaaaccatcatccctcacacttccgttccaagggcgtttgtcgataaaaaatggacttgggcccttcagccaccgacagtaccccacataacaacataatcacatttccgtgcccgggagcgcgctgatcgcgttcaatgattcaatgaattttcccacagcccgctccttacgatcacatattaaaatttacacttttccatgtttatcaacttttgccccccccctttttttcctttctgccgctaacatccggcgggccagcgaatgggttttcgccttttcacacgttttcccttcccatcccgtattgtaaattaaaatttcattgaatctcggcactccatttccttataaaatggactttaattaaaaaatattcatattcttcactgtttctcactaatgggaaatattctctcgcttgagtttgcgttccatcacaacccagccccacagcaatcccaatccaacccaatcccacttttggccatcctaatccctatttttttgatttttgcagcggtaatttcatttgtctgcgtccgatttacaactcattccttgtccgttttggcctctgctcaaattcggcacatgtaaatcggcaaatctcaccgccaccgctccaacccactgaacttccgatcaccgccaccgctccaacccactgaacttccgactactcatccgctcccatcgtccctatccccctcaattattccgacggtcgtgttcctttttgtaatttttgtgctgcttccccccattcaagcgcatcccaaaattaaattatccccaaaaggaattgctaaaaataccctcccaatccttgcttcatccgccctgtatctttgccttgattccctagcctctgaacctgaaaataaaccccaatttcccatttcgcttgtgttggctatttttcctgtttggcaggaatcctccttcttatttttattaaaatcttttttattttgcgcaatcgtctttttggaaatattgccaattcccctaattccatttcctcccccgaatccatcgaacttggagaagttcgacatgccattcaagagttggttctgcgaaccaaccccccgctccgctaaataaatttgaatggaagcacgaaaggtgccaaaattgtccccaatttcgatccaaaatatccataaacacttaaagcttagtccttttaaccctcccaatttctctgacgccaatatgccgactgaaaccgatccatcccaaatcgacattacccagaattcactattgtccgttgtacccagccttgagtcatccctcccccctgaaattgccgacattgaattgaacccccgaactccggacactatctattcttcatgccctcccaacacgagaccaacttctccgacaaacatccccaccgaattcgttgttacaattccttcggatgaggtaagttcgactcgtgaacgaatccgaggaccatcaccgccgaccggccaatccatcacaaaatccaagtggtcacaggggtcacgggtccacaaaattcaaatttcattcaccccctttcattctcccacaattgctcgccgtgctcgtcctcgcatcatctctcgtaccagagtcggaccgcatggccaattgcagcactttccgatgagcactcagcgaataccagtccggtccggtccggcatttttgaaaattccgatctctaataaaaaatgcttttttatgcgttttactcaggagaaattaatttgaaacgcaatttaagtatttttggagatacatttttggtcaaaatatgccagattttttgaaaaaagtatttgttaacacttgttttttatgcagatttatgttttataagcagtattcggatttatatgtgctaaaaacgatatattttagcaaaaaaccaccaaaatatttgctaaaaactcgaaaaggctaaaatatgtgtctacaattgaaaacaaattgcaatttttcaaaaaatcgtatgccttatccattccactagcataatttaaaaatccaaattatattgaaacttttcaaggacgaagagcaacaacatttatgtggtcaacgtgggttgacgacaaattttacgaaggggtccttagttggtcgcaatgctcgaccctttccttgacttcgccgcttcctttgattttctaaaattttttcaagaaaaaattgtcaaaaattttttataagaaaatttctcgaatttgaccgggatggacggatgccagattatctgccgctgagtgaaattaatattatattcgtgatcagcaaccccgaaaaccccagaaaaaaacaaaaaaaaattttttttttgtgtggcgtaaagagaaacagtaccgatttgaaaactttttatttttttcggcggagttttgtcccgctccgaattctttaccattgacgaaaaaaatcattacgccatcccatggaaaagtttctaatgaaaattgccgatttctttctgttcagcttggtgctgatcaacgcgctgtacttcaaaggcacatgggtggacaaattcaactcaaaatgcctgggattgcttttagtttgtctgctactattaaatttctggacgagtgactgtactgttttctcaagtaagctttacctaagcccaaatacttttcgaaaaaaatgtttttttgttttctgaagtcgtgaaaaaatatttccgagggttttctgggtctctgatc

SEQ ID NO: 68315 - DNA, 57 bp, Heterodera glycines
  Genomic contig location: Contig_ID=SeqID_39834; Location=754..810; Strand=+
  SCN-specific regions: Sequence locations=1-57
gctatagggaagctattccggaaggattcgggtctccccataaatctgggcgcatcg

SEQ ID NO: 68316 - DNA, 669 bp, Heterodera glycines
  Genomic contig location: Contig_ID=SeqID_39834; Location=1..669; Strand=+
  SCN-specific regions: Sequence locations=1-669
tatttatgaaacaaaaaaatcgattttttcaagtgtccgtttggggtactcaaacaattatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctaggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctaggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctaggcgcatcggttcggggggactgccccgaaaac

SEQ ID NO: 68317 - DNA, 237 bp, Heterodera glycines
  Genomic contig location: Contig_ID=SeqID_39834; Location=917..1153; Strand=+
  SCN-specific regions: Sequence locations=1-237
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttacgtaacttgccagatcggacgggtgcgcatgattccacggggagaagcaccccaccaaaagcaaaacgatataaccaaa

SEQ ID NO: 68318 - DNA, 651 bp, Heterodera glycines
  Genomic contig location: Contig_ID=SeqID_39835; Location=201..851; Strand=+
  SCN-specific regions: Sequence locations=1-27,50-79,130-159,182 -239,262-300,324-651
atgaacttttggtattttaccattgcattattaaccaaaatcagaaaaattttaatttgtgatcaaagtaaacaaaaagtttaataataataataatatttattttcaaatatgtaattttaaatattaggccttgtaggacaactttacagtgatgggatggcatataaatattttacttgacactgaaattttttatttaaattaccaggaatttgggttttacctatgagttttattttcgaatttaagcatttttataaatccacagttatttttattaaattttcgattctcgggaaatttacatttataaaataatatgtatatacgtatttttgctttatttcagcaaagaaatcggtgttctttccttcaattgaattgatcgagtttacgatcaatttgctcgggttcagtcccgagaatgttcaaagcgaatggaaccctttgatttatgaattcttagacaaatatatcaaaggtagatgtacaaaaatcaaatattgacccaactatttaaacaacattcaggtctaattgttcaaactatgcatctagaaaaaagacaggtgtgttgtgtgaaatctgaataacagcccagggcataattacggattacagaaattacagcgtttttcagctcccata

SEQ ID NO: 68319 - DNA, 343 bp, Heterodera glycines
  Genomic contig location: Contig_ID=SeqID_39836; Location=53..395; Strand=+
  SCN-specific regions: Sequence locations=1-96,223-343
atggacccggttcctttccaattcgggcggttacagtgcaatgagcagcttattccaaacggattattcacagcaccgatttttgggtgaaaaatgataataatattaatgctaatataatcaacatttattattacattaaactttaaaaaaattattttgcttaaattatttttgaataatttttgaaactgttacatttaaataaaaattaatttttttcagggcttatatactaactttaattaaattaattgacttttaatgctttaattttaatatttttcacagaattatttggaaaaattaaaaaaaaatcaaacaaaatttatgcaattaaaaa

SEQ ID NO: 68320 - DNA, 668 bp, Heterodera glycines
  Genomic contig location: Contig_ID=SeqID_39838; Location=458..1125; Strand=+
  SCN-specific regions: Sequence locations=1-96,129-255,277-288,310 -599,621-668
atgcatgggtttggcctttttctgtcgctactggcggcaataaatttgtcgagaggtcaaattggtccaaaggatgaaagcaaaaaaggtttgaacaatattttcaataaaattttaaatattattttgttttgttttaggtctttttttgatggccaacgaatttctcgagacagggaaaatgcttctcgacgaattcccaggaaacaaacaggcggagaataaatctgatgatggactcaattcacaaaaagcgaatggaaaggcattggaagagaaaagtgacaatttccagcaaaaagcctttgagtttttgtgtggaatcgaaatgaaagcaaaaaatgatgagaaaggaaatgacaaaacaaagaaagatgacaatttgttagcttttaaagaattagaagaaaagcgactcaatttttgtcaaaattggaaaaatggcaaaagcatttggaaagggttgaaagaggcagggatttcaatagtaacatcagtgaataatttgaaactgaatcagcaaatatacggagaaagtgaacaatggcgaaaatggaaattttgaacagcaaaaacaaaaaagaatttgaaaattttgcgaaattaagtattgatttggtaaagaaagtaactgaaattcttaaaggtaaccaattaagttattctaa

SEQ ID NO: 68321 - DNA, 409 bp, Heterodera glycines
  Genomic contig location: Contig_ID=SeqID_39839; Location=474..882; Strand=+
  SCN-specific regions: Sequence locations=1-213,244-409
atggaagttttatccgacgaagaagaaggaatggcattgtccgatttgaaagagacagcaaagaaaaacaacgaagaagccaaacgccgagaatttgaccggcgactgccaatcattcactcatatttgggcgatgtcaaccaaggggaattgtctggtcaagaaattaaacaaaggcaatttgaggaacctgggaatacaatcaaaatttcgggtaagaaaaaattaattattgggcaattggtaaaaaagataattttgtttttttagtttttgttataaacgaagtttgtctgtttccgggccagaaaatgccaatccaattccaccaaaggtcgggcatccaatttgtgcacaatgcacaccgtcagcaaaatatccttgcccttttcactgcggaagaccctaa

SEQ ID NO: 68322 - DNA, 56 bp, Heterodera glycines
  Genomic contig location: Contig_ID=SeqID_39839; Location=144..199; Strand=+
  SCN-specific regions: Sequence locations=1-56
atcattggagattgggggattaatggagattgggggataattagagcaaatacggt

SEQ ID NO: 68323 - DNA, 2531 bp, Heterodera glycines
  Genomic contig location: Contig_ID=SeqID_8504; Location=1497..4027; Strand=-
  SCN-specific regions: Sequence locations=1-59,84-230,252-696,718 -724,760-780,811-846,872-1018,1048-1083,1105-1239,1301-1386,1408 -1463,1486-1515,1537-1542,1564-1656,1678-1701,1723-1725,1747 -2005,2027-2201,2223-2262,...
  SCN-specific regions: Sequence locations=...2297-2307,2330-2386,2408 -2531
atgtctcttttaaagaaaaatattcttcacagaggtaagtgttacacacttttactgagttaaaaattaattataaaattaaagaatgataaaagcaaaactttgacaaaataggatttttcgagtgatcgttttagggttttaagggccgcagaatccgaatctgcacccatttcgacccagttctaaccccctaagctagactcgaacaagtcgaaaattaattgtttttaaaacaaattttgccataaagtggggcggaaccgacttatccagcaccagaagcggattggattcccagactctgaaaatctcttcaacaattttatcttgtctcggaaaagctaccatcggcagaactagcaaagtttcgatgcgcgctttggtgtaaatccataaaaataccgggccccattaattaattactgatttgtagggctgggaattttatgtaaatacatattttttcctggcttctccatgctctaaatagtaggaaaaacacttgcttttttttgtgttttgctaacaaatgttgggaatttacatatttagggattttatacatatttggtacaaattttggactttttttcttagatattttcattttttttttttacatattttgaggatttactacggaaatttttcgaaatcctcaaaaatccaaaaattcggcaaatttttcgtaaatattttctttattttttgaaatgtacccataaaaataaaaaattaatttataaatattaaaatgtgattctaagactgtttagcttatttttattgcattttgtgcctatttcacccattaagaagaatttttttgcaaaaaaaaaaccattttaaaaattttatttacatatttggtagatattttggtttttttttttgtacatatttcgggattattcttacatatttatgtacatattttgaccaccttttgtacagaaacatataaccttgtgactaaacctccagtctttcttttattttacgaaaattacctaccattaaaaattaaaaacaattaaatattatcttctattctaaaatatagactaaaaagttaaaaatgttttccttttaggtgcaaaatcgtttaaaattgtaacaaaatttctgaaatttgccggccgcgcctgttgacaccgttgacacaaaaattaaatattaccaagatttaattggataagtgaaaagacagtcacaaaatctagaccatggaattggcattatgccaatttttgcctttttgcttcttctcaaatctaacattatttaatggcattaagccaacgcattaatgtgcctgtaaatgggcatgaattataaagaaatgcctccaatattattagaaaaatggcatgcttatatgctaaaattataaattgaatttgatcaataaaagtaataaatggcaaaaaatgaaaataataataattgaccagaaaatgaaattattttataaaaaaatatcataatcacttgggaacaaggctgggcgaaactttaggttttagaaatgcaatttgttaagaaaatcacttgaatttttgaacaaaaatgagcatgtactataattgctagggctaccaattttatgtaaatacattttttttttcctggcttctccatgctctgaatagtaggaaaaacactttcttttttgtgtttgtgaacaaaagctgggacttttatttacatatttttacatatttcagggtttttctacatatatattacatagtacttatttttatacatatttctgactttttcgcattttttcatacatattttgcaattgccaattcactataattatgtcaaattaaagtgatcattcaattgccaattcactataattatgtcaaattaaagtgatcattcaattgccaattcactataattttgccaaattaaagtgatcactagagatgggaatttaagtcaactgactttttttttgctgatcttaaatggcctaaaaatgactttaaaatgttccacactttgtttgaagcttctaacatgcattttttgtgactttttggcgattttttatggcttttttagtccactttttggagatttttcgtgacttaaattcccagccctatacctatcacgaagcaacagatcccacattcattcactcattaattaacattcttattgtcaccaaatttgcccaaatgaagaacaatcattttggcttttcactgctctccgccgttggcatcgcttctgcttggctaataatggcaatgcttttgatgatgccctcttcatccatcgctgatgatgatgatgaagtatttcaaatattcgcaagatatggttacaaatcatataccgttgaagtgaagggcacggacactgtggcaacactgaggcaaaagatcggacaaaagattggcattgtgcccggacaaattagacgcgtcccatacggtgtaattaaggacggagaaacattgaatagatatggcattgaaaaagatacaaccattttcttgtga

SEQ ID NO: 68324 - DNA, 330 bp, Heterodera glycines
  Genomic contig location: Contig_ID=SeqID_8505; Location=351..680; Strand=-
  SCN-specific regions: Sequence locations=1-61,96-106,129-185,207-330
atgaagaacaatcattttggcttttcactgctctccgccgttggcatcgctgctgctgcttggctaataatggcaatgcttttgatgatgccctcttcatccatcgctgatgatgatgatgaagtatttcaaatattcgcaagatatggttacaaatcatataccgttgaagtgaagggcacggacactgtggcaacactgaggcaaaagatcggacaaaagattggcattgtgcccggacaaattagacgcttcccatacggtgtaattaaggacggagaaacattgaatagatatggcattgaaaaagaaacaaccatttttttgtga

SEQ ID NO: 68325 - DNA, 184 bp, Heterodera glycines
  Genomic contig location: Contig_ID=SeqID_39842; Location=39..222; Strand=+
  SCN-specific regions: Sequence locations=24-157,182-184
aatatctataaaaaatttaaaaatgagaattcatgcgagattttctggaaataagcttaatagggcctagttaagctgtaaacaaaatttggggcgatttgaaagagaatagaaagaaccaggttcgatgaagttttggtaagccaaaaaaaaaaatccaaacatttaaaaatctattaaaaaa

SEQ ID NO: 68326 - DNA, 349 bp, Heterodera glycines
  Genomic contig location: Contig_ID=SeqID_39842; Location=537..885; Strand=+
  SCN-specific regions: Sequence locations=1-1,24-160,190-320,342-349
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctattaaaaaaat

SEQ ID NO: 68327 - DNA, 244 bp, Heterodera glycines
  misc_feature (150)..(150): n is a, c, g, or t
  misc_feature (162)..(163): n is a, c, g, or t
  misc_feature (199)..(199): n is a, c, g, or t
  Genomic contig location: Contig_ID=SeqID_39845; Location=1..244; Strand=-
  SCN-specific regions: Sequence locations=1-191,215-244
taattaaatccattccttcgggggaccgtgccgggtgccgcggggtaagcagtggctggttcgtttcatcacggcaccgaaccttttggctagtcagcaatcgttgcttacttgccagatcggacgggtgcgcatgattccactggtccnagcaccccaccnnaaagcaaacgatataacaaaatataaggaaaaattnttttaaaaaatttttctccatcttcctttttgatactaaagcatc

SEQ ID NO: 68328 - DNA, 986 bp, Heterodera glycines
  misc_feature (517)..(517): n is a, c, g, or t
  Genomic contig location: Contig_ID=SeqID_39845; Location=636..1621; Strand=+
  SCN-specific regions: Sequence locations=1-23,46-135,161-292,314 -365,388-454,493-986
agtctttcgtttttatttgttttttgcataattaattcataaatatttttttcacaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaagagaaataacctattttaaatattatctagtcagttcatttaaataatttttatccaaaaaatttttttttgggttttcggggcagtccccctgaaccgatgttaggcttaacgttttttcagaaactgatcagaagcgcagcaaactttgcagggatactgaaaggaagagaaataacctattttaaatattatctagtctgtttttttaaataatttttatccaaaaaaatttttttttggcttctcgggccgtcccccctacncgatgcgctcagatttatggggagaccgaatccttcgggaatagcttccctatagcctgtactttaattctgcgttggaatttgctccccataattgtttgagtaccccaaacggacacttgaaaaatcgatttttttgttttcggggcagtccccccgaaccgatgcgcccagatttatggggagaccgaatccttcgggattagcttccctatagtctgtactttaattctgcgttggatttttgctctccataattgtttgagtaccccaaacggacacttgaataaatcgatttttttgttttcggggctgtccccccgaaccgatgcgcccagatttatggggagaccgaatccttcgggattagcttccctatagtctgtactttaattctgcgttggatttttgctccccataattgtttgagtaccccaaacggacacttgaaaaatcgatttttttgttt

SEQ ID NO: 68329 - DNA, 403 bp, Heterodera glycines
  Genomic contig location: Contig_ID=SeqID_39847; Location=452..854; Strand=+
  SCN-specific regions: Sequence locations=1-29,70-71,106-113,187 -272,294-403
atggcgatttttactgaaattttctttaacactttaccagcattgggcgcacttttattcaactgggtcagttttataaataattaattatattttttattatatgacaagtgttttttttcaatttttatattattgtatttaaatttgtttttatttttttaactagttttgttgttactttcagagcactgggctggtgatggcaaattacgttggtgaactgagcatttcggcatgccccgtggacgcgttcatttgtgccgtaatttattggagaaatttggtgaaaagaggtggcgttgcccaacagcagcagaacaacattaatttgatgacggtggccaaaccgatgacgacgatggccaacagaaatgtggacagaagactgaccatccgatga

SEQ ID NO: 68330 - DNA, 89 bp, Heterodera glycines
  Genomic contig location: Contig_ID=SeqID_39848; Location=147..235; Strand=-
  SCN-specific regions: Sequence locations=1-89
atgaaaaagtttagtaaatttccggaaaaaaacggatttgcgaccaaatcagagccaaaaagggatattttccgtaaactgctgaaatg

SEQ ID NO: 68331 - DNA, 94 bp, Heterodera glycines
  Genomic contig location: Contig_ID=SeqID_39848; Location=728..821; Strand=+
  SCN-specific regions: Sequence locations=1-94
ggattatttttcaaaacacctcgtagactgggggataattgaagactgcgggattaatagagactgggctataattagagcatatacggtaatt

SEQ ID NO: 68332 - DNA, 2615 bp, Heterodera glycines
  Genomic contig location: Contig_ID=SeqID_8506; Location=284..2898; Strand=-
  SCN-specific regions: Sequence locations=1-557,581-653,675-724,777 -1420,1442-1809,1831-1891,1913-2139,2161-2301,2323-2615
  Gene Ontology: Mol. function=protein serine/threonine kinase activity; Cellular component=cytoplasm; Biological process =regulation of cell cycle
cccccggcaaaatgctattttaactttgcggcagcaacgggcgccaatcggagtcggacgatgcaccaaatgcaccaaagttgctacgcgggggtcgccgggcccaacggaggaccgctccgaccgtccgtctctctctgtaaggcttttcgccggggggggggcggcaaatggcgaatgattggcacggcaaacggacggacggaacagcggaagaataagcctttgtttagccgttgtccacgagagcagtgcgctcggctcggacggcgaaagcatcgaagtgtcgccgtgtacgagcgatcagtcggcgggtggcggagacggaaatttgggggaggggcgacagacgacgaagacggaatacattccgaaggtcaaacttcgccaaaagccgaaccgacgctggagcgaagtgagcagcgaattggaaatcattggccaatttgggggattattaacaaattcatctgtcactaattaatttcgcgttgcaatgaatgacgtcatttctacacacttttggtccggggttttcccccccccccattagtttcctccccattatccccctttttttccaattccccccccccccaattaaaacattttcgatttaatttagtgccactcaattaaatgggacgtggaaagaatattttttacataataatctccgagagagaatgcgattcttgtttatcatcatcagaaaataattggtgaaagaaggaaaaaaggaaagaaaatgaggaaaaaatgaaaagtgaaaagaatggcatcatttgaaacttcgtaaaatgccaacaatttgtgttggacagtgctcgagagtctcgtcctttcaactgatcgtggcctttccgtgaatgtgaagctgtacttcccccctttagcaagacatccaaaagcgactgtcacttccgccggacattcgtctgccccaaaatgtgatcgacaaattgaatagaacgccaactctggacaatccgttgacgcggaagagcaaaagggcgtcgctgaacgaaatcggattcggcaaattggagacgtacaaaaaaatattcgatttgggcgagggaacgtacgcgacggtttatctgggcaagagtttgttgactggcaaaaacgtggcactgaaggaaatacgattggaacacgaagagggcgcgccgtgcacagcgtaagggaccgccgatggcacacgttgaaaggggaaaaagggggggggaggaggaaaagccaattggaggggataaatgggggaaatgatggggagattagtgaaatggacgaaaatgaaaagaatccctattattcagaataagggaagtgtcactgctcagaaacttacgacacgcgaacattgtgacgctgcacgacattgtgtacacggacaggtgacacggcacacttttaggatggcattttgccatttaaacccacgaaaagcaatggggccaaagggggggggggggtgaggcgcagaatgaccaactaatcccttcttatctctcattgccctcacccaaaagtccatccgttaggattctcacgttggtcttcgaatttgtggagcgcgacttgagggagtacatggaggagttggacgggattatcagcatcgccaatgtcaagctgttccttgtgcagcttttgcgcgggttggcctattgccattgccggcggattttgcaccgcgacttgaagccgcagaatttgctgatcaatcggacgggcgaactcaaattggccgactttggcttagcccgggctcagtcggtgcccaccaaaacgtactctaacgaagtggtcactctgtggtacagaccgcccgatgtgctgctcggtaagcctggccaatgggtttcccccgcggcgttggcatttcatttgccatttcccaggctccacggactattccacgcacattgacttgtggggcgtcggatgcattctctacgaaatgcttctccacaaagtgccgtttccgtcgccatcgctttttctttttttgttaattcgatttgcccatttgttcagccaatgttccccggcagcacaactgatgaacaattgaatctgatcttccaaaagctcggcacgccctctcccgcggtccatgccgacatttgcgccctccaggccttcaaaaatggccaatttcgacaacacaatgccaaaccgttgcttaaccctccccgaatttcgcccgaacgtgccgacctgttgagcaaactcttgaaggttaacttttggggatatttttattagtattgccccaggggatgattcattagtcatttaattggccgtcgttttgcagtacgaagggaaatacagaatttctgccatcgatgcaatgcgccatccgatgctgaactgttttcccgcacaattgttctccctcccagacacagtatgaaacaattgctcattttctcagtacagtacccccccccccttccatttggcaattgtaggaatctgtgctgagtttgcccggggtgcattatactcgagacagtaaagacgaagcgtacattgagacgaggaaaagcagtgaaaggacagagaagccgactgggcagagaatgaggacaacgatacagtga

SEQ ID NO: 68333 - DNA, 99 bp, Heterodera glycines
  Genomic contig location: Contig_ID=SeqID_8507; Location=189..287; Strand=-
  SCN-specific regions: Sequence locations=1-36
atgggccagctgaagctgtcatcgagaggacgaattgaggaggaagaagaagaggaggaagagatggacgaagaggagcagcagggggaggaggaggag

SEQ ID NO: 68334 - DNA, 119 bp, Heterodera glycines
  Genomic contig location: Contig_ID=SeqID_39853; Location=38..156; Strand=+
  SCN-specific regions: Sequence locations=1-119
agtaattagtcaaaatacatgtcagattcgtgattagcgacctttaaaaccccggataaaaaattatcatggttttttatcttaaaaaaattttgcaaaacaaaagggtcccccctttt

SEQ ID NO: 68335 - DNA, 321 bp, Heterodera glycines
  Genomic contig location: Contig_ID=SeqID_39856; Location=437..757; Strand=-
  SCN-specific regions: Sequence locations=1-33,55-217,251-321
atgggaagtcatggagtggactgtgcagtgacagtccgcggcaacagctgcggctgtgtcacaatctgtgacacatgctgcgagaacggctggtggcagcgctatgtggacgcagcgcgggaccaggctgcgcggcaggtcgaggacagcatcgacccgtggacaggaatagtgcggggagatgaggacagccaaaggctttgggtacgcaaaactcttttttttttttgaataaattaaatttaattatgttttcaggtcgaggggcacgatgtgcgccccaaatgccttggatgccaggccgtccgcgtcgactatctg

SEQ ID NO: 68336 - DNA, 989 bp, Heterodera glycines
  Genomic contig location: Contig_ID=SeqID_39859; Location=19..1007; Strand=-
  SCN-specific regions: Sequence locations=1-300,339-455,477-585,607 -666,717-989
atgacaaatgaatataagcaaaaaagaaaatattcattaaaagaatggcaccaaaattatgaagaaatttgtaagaaaattggagttggttatggaacaattaagagatggaagaaacaatttggcattagctgtaaaataacggagaaagaaaaaatggaaaaaatgaaaaaatattggaaaataaaaagtgaaaacccaaaaatgagtgacaaagaaactgctaaaatattgcaaattgatagaaggaccatttcaaaatggaagaaacagtttggaggagagattttggaggatttaaatggatgattataagaaaaattggataaattttcaaacaagaaaattatttacgacataaaaactgattaattcttatattttatcgaaccattgtcaaaataactggcataaaatccgtttatttttctcaattggatacgctgaatttgcttctattgtaaataattttttcttagtaacgaaccatcattgttatgatttccgaccagggctgcacgcaattacggattgcggattacggaaattacggggttttgggagttacggattacggattacgggttacggatttttgggatttttccgtaattttgatccgtaatttgacttttggattattttttcgagacgatttcttgtaagattatttttataaaaaacaaatttttctattttttatttaaagaaaatatgttcatttctttaaattcttatttctttagcaatttaaaaatgtcaaacttaaatcctggtaattggtggtattattttgagcgtcaaggcaaatcaactgctaaatgtaaagccgatggatgttcctactcaaagacattaaatgcttctctcagtacaacagtgcttgcttgtcatctcaaaaatcaccacccacaactttacaaacagcgtgaagattttgttcaagcagagaagcaaaaaacagaaaaaaagggacaaagtggaataaa

SEQ ID NO: 68337 - DNA, 823 bp, Heterodera glycines
  misc_feature (47)..(47): n is a, c, g, or t
  Genomic contig location: Contig_ID=SeqID_39861; Location=1..823; Strand=-
  SCN-specific regions: Sequence locations=1-267,295-466,493-498,521 -531,558-674
catatgactttcaacatacattcgaccataaatacagatttggaacncgcgggtttttctcggcgattgtccacggcggtgtcgtgccaatgggcgttgaatgagttgtgccttcggcacgtgtcgtgccgcgagctgtggacattgttccgacgcaattgtgcggtcgatgcgcagaatcaatgcaaaatggccaataagtgggcgtagggggggacaacataaaataatgtatcaaaatcatgtcgattattttaaatttaaggcattaaaataaaaataaatttaaaaattgtcaggaacgactgctggcagtcatttgagggcatcagttggaccggactcggctcctgcacctgcgcagggaacaattctgattgccattggattcgtctgcagacaaattacaacaaatgcatttgtgtgttggcacttttgaaaaactgatcaaaaacgaataattgatcaatcaatacaaagaaatctcaaaatcgatcgaatcattaaaaatgataatttgatcaaaatttatcaaaattattttcttttcttcagatgagcttaactacgacgccgattggcatgctcacaatcagctttcaactgcagcacaattttcctcgagaacgacaacaaaaacatttcaacaagagggaaatttgcacgaaagtgttggggtggaaaagtggagggacgagagacaacgggaccagtggagagaacaggatgggaaagagacgattagagaccatggggaagaggagaaaaggaaaaaaggcacatagagaagcagtggaggaagaggaggagaagaaggagagga

SEQ ID NO: 68338 - DNA, 1605 bp, Heterodera glycines
  Genomic contig location: Contig_ID=SeqID_8509; Location=1610..3214; Strand=-
  SCN-specific regions: Sequence locations=1-368,390-710,732-830,852 -1403,1429-1605
atgccttttttaaatttttttggtgcctattatagtgcctttttcgcgatttttggtgcctttttagtcgtgctctactctttaccatttttagcacatattttggagattttttataatcagggagcaaacaaaggttttttgacaacttttttcaatttttggtgcctttaatctcttaatttttatgcttttttccaattttttgtgctgattttgccttttttgtgcttttttcatgcttattttggaaaaattttatgctgttatagtgcttaatcggtgattttttgtgctgaaaactgagcactagggctgccaattttatgtaaatacatattttttcctggcttcttgctctaaatagcaggaaaaacactttcttttttgtgtttgcgaacaaaaaccgggacttttatttacatatttttacatatttcggggtttttatacatatttacatatttcgggattttcttacatatttgtacatattttggattttttcatatatattttcattttttacatattttgaaaagcacctgcgaccattcgtgctcaagtgcttcaaaacacatgcacacctgtgctggcctcttttccgagcaaagatgccacaaaaaaggtgggttactatcaaaaacaattttgtaaataattttgttttctttttattcaggtcatcaaacgtttgcgccgtgatgaaaatgcaccgcgagccgaacctctcaatttggagcagttggagattccgaatacatatcgtgtttataagcgcactgagattgacgaggagcaattcctgttggcggacactggcgtttttaaaattcacggacagaatggaccccaacggtaagacatttaccgtttaaaccattaaataatggtcatttacactagccacaacttaatggcgttttcaattggttaagtccgaagacgaattttatgaatttttttttttctaggtttctagacaactacacgggcagaatgcgcttcaatgttccaatgacgcacctctgtttgacccacacgaatggaatgttcatcagcgcaccttggatggtgctgatcggacgaacaacttcgccgaggcattccatcggaaactttatcggcaatttagctgaactcatccaacaatttggcgattcattgacacgatcagatgtgagcagaaggcgcttgatgctgatatggcacgttgcatgatgggagaagccgcaccccaaaagaaaaggaagtatcgcgatgccgattcacggattcttcgtctcgtccaacgttataacgatgtcaatattgtcccccaaaatgatcacaattagagaccggcgcaggacaggatcctgcgcaggattttgcaggatcccagtctgcaatcctgcatattttggaaaatacaggatttgcaggattaatcctgccggatcctgtcctgtaaaaaattttgaattccaatcctgcaacaggacccgcaaatttgatttttatgcaggattcagcaggatcctgcattgattttttgaaaatttaaaaaaaaagaatgccaaatattcagaaactttcttttttcaaaaatttttttctaataaa

SEQ ID NO: 68339 - DNA, 333 bp, Heterodera glycines
  Genomic contig location: Contig_ID=SeqID_8509; Location=1022..1354; Strand=-
  SCN-specific regions: Sequence locations=1-89,111-111,134-137,159 -159,181-333
attatgagccacccaatttggcaaatcggtctttttaaacgcattaaagaagaatcagtcgattgcttggagtgtaagcaaaaaaacgttattaatttttcatcttcatcattttttggtttaaaaatatattgaatacttttttatactttgaaagacttttttattaatacagaattttttgaaatttcctaaaatccgcaatcctgcgcaggatcctgcagattttaaatgcaggattgcaggattaatcctgccggatcctgtcctgtaaaaaattttgaattccaatcctgcaacaggatccgcaaatttgaaatttccggtctctaa

SEQ ID NO: 68340 - DNA, 95 bp, Heterodera glycines
  Genomic contig location: Contig_ID=SeqID_39864; Location=62..156; Strand=+
  SCN-specific regions: Sequence locations=1-3,25-95
cgcgaggaggaggagcattaactgcaacaggaaaagaccagcaaaaaggagacgaaaaaggccaagaaaaaggagttggaggaggacgtcattga

SEQ ID NO: 68341 - DNA, 309 bp, Heterodera glycines
  Genomic contig location: Contig_ID=SeqID_39866; Location=1..309; Strand=-
  SCN-specific regions: Sequence locations=1-90,147-309
tgatgagataaaattgggcgagagcaaacgacgacgagatgccgagttgtttattttgttgttttgattccagtgtctgatggagcactgcttttctctttctttcttttctctgtcatttccacacttttcccttccttttttcttgacatggtccaaaatgttgatgattgttttcgtaacaaaacttcaaattgtacaaatgcgacatttctcatttatagtaaattattttgttttggttttggaccagttcgggcaaattgtctatgttttgatgatgcgagatgccattttggttgatgatga

SEQ ID NO: 68342 - DNA, 184 bp, Heterodera glycines
  Genomic contig location: Contig_ID=SeqID_39869; Location=840..1023; Strand=+
  SCN-specific regions: Sequence locations=1-184
cgacaacgaagcaaggcatgttggtcaaagacgcacaagtgaagccggacatttcgaagccgcgctgggaccagtcgacgttcagtggtcgcgcacggcacttcttcaccgtggtcaacccactgaaccttttggcatcgaacaaccaattggaaaacagtcgcaaaatcgtcaccgattacga

SEQ ID NO: 68343 - DNA, 130 bp, Heterodera glycines
  Genomic contig location: Contig_ID=SeqID_8512; Location=2848..2977; Strand=+
  SCN-specific regions: Sequence locations=1-130
tctcgattcccgagtcgagaaatttctcgggttttttgggtctcggttctcgtatcgtttcccggggtcatttctcggttctcgtatcgtttctcggttcccggtaaaaatcacttctcgcacatcccta

SEQ ID NO: 68344 - DNA, 666 bp, Heterodera glycines
  Genomic contig location: Contig_ID=SeqID_39872; Location=304..969; Strand=-
  SCN-specific regions: Sequence locations=1-666
  Gene Ontology: Mol. function=DNA binding; Cellular component =nucleosome; Biological process=nucleosome assembly
atggcacgccgacgaagaaagaaggagccgcgaaagcagtcgtacaaggtgcagtttacaacgaaagcaaaatgccatgataattttgtaattgtccccttatttcagctgtacgttcgacgtgtgctgaaggaagttcatccgggcaaggaaatctcaatgcgtgcgttgaacatcatgaactcgtgggttgctctgctgaaagctcaacaataatattcattcgtttaaccattttctagcttcgtcatcgacgccttggaccgcattgcaacggaggcgacgcgaatggcccacaacgaccggcgcaaaaccatcacgcttcgcgacatggagttttctgtccgactgtgcctgcctgacgtcatggccaaagatgcgaaccagaaggctcagaaaacggtgaccaagttctatgctgcaaaagtgcgggatcggatgagaaggacggagatgcgtcgtggcgaatttgcgatgatgcagatggcagcgctgtgagcacactcaacttttggacgaccggcggatgaaggcacctgtatattgttgatgattggccccgtatcccccattactgtatgtgtatgtattatacaatgtatctaccattcttgtgtgtgtatgtattattcactatgtgctttatatgtatacctggtcaataaa

SEQ ID NO: 68345 - DNA, 804 bp, Heterodera glycines
  Genomic contig location: Contig_ID=SeqID_39875; Location=409..1212; Strand=+
  SCN-specific regions: Sequence locations=1-6,41-804
gtagagaaaattttatcaaaaatttattttaatttaaaatctccggcaagttttgctggaattcaaaaaattttaaatgaggccaaaaagattgacccgaaaattacgaccgatgacgttaataaattcctagaaaagcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacattgggagccaaaccgtcttcaattaattttgaaaatgcccgtgcgctctgggaaaaattatataaggagaaggaatttaaaatttcgaaaaagaaaaaatttaaaatcggtgatatcgttcgtattaccaaggaaaagggaaaattttcaaagggatacctc

SEQ ID NO: 68346 - DNA, 133 bp, Heterodera glycines
  Genomic contig location: Contig_ID=SeqID_39880; Location=45..177; Strand=-
  SCN-specific regions: Sequence locations=1-133
ggaagctattcccgaaggattcggtctccccataaatctgggcgcatcggttcggggggactgccccgaaaacaaaaaaatcgattttttcaagagagcgtttggggtactcaaacaattatggggagcaaag

SEQ ID NO: 68347 - DNA, 170 bp, Heterodera glycines
  Genomic contig location: Contig_ID=SeqID_39881; Location=1..170; Strand=-
  SCN-specific regions: Sequence locations=1-170
atgtacttatgtatgtgcctgtctatgtctgaaatggccaccatgctgcccactgcgggaggtggctatagctttgcgcgtaccgcatttggtccatttggcggctatctcacaggcacggcaattttaattgaatatgccatcgcccctgcagccatcgcatgctttat

SEQ ID NO: 68348 - DNA, 1290 bp, Heterodera glycines
  Genomic contig location: Contig_ID=SeqID_8513; Location=2092..3381; Strand=+
  SCN-specific regions: Sequence locations=1-26,48-539,561-749,771 -830,870-1005,1028-1290
atgaaaaacacaattaagtccgagctcttggcagtggaggaaggagagaccatcttccacggacctccggaaggcatgttaactctggaggagttaataagccgtctcgaagagaaggttgccggctacgaagccgagaaacacttctgcgtcgggccactctatcggcaaacggaccaccgagaggccaaggagctggcgcagacagtatttgtgaagtttaaaaaaatgaacaacatgtgtttagattgcgcaaaagcaagcagtagctgttcacctgcagccgactgctgagcaacttgagcaaatggtgttccagttgatgtcggccgccgaggaaaccactcttcatttaattgaacagagggaagaggattttaaatgggtacggtgaaggcaaaaatcggaaaattttatttgttggaatttcaatcttttgtttttcagatcgccattgagctgttcgctcgcaataagcttaagccgaaggacctaaatgagttttgtcacagagccatgattggctaaattaatcttgacatttattttccagccaatttggaccaccggcgaagctcaaggcgatgaagaggaggacgcagaaatggaggaggtgcaggatgatgattgggaagattgagggggtttttttgtgggattgttaatggcggccacataggatggtttagcaactcccttttttcttttatgtttgggtggccgccaaccagggatgcaacaggcataagaagtttaaattttaaaagtttcgaatatttccgagaatagtgacgagattcaactgattaattaagaaacgttttggaattaattatctcaaattttttgggaaaaaattttctcaaaaatatagtcagccgaagcaaaaaaatgcggcttcttggctcagaatgttctgactacggcggaaaacttggcattttaaaaagtgaacacacaaggctttgttttggtttcacgaccaaaaatttttttacccgactaatgaaattttaaaactcaattaaaattcaaactttttttcattaaggagtaaagaatttttcaaataattttttaaggtcgagcaaatttttttgaggtcgtgaaaccgaaaccaagtctaatctcatccctaaaagctgttccaatttttcaagggttgcattcctggtctcaccatttgttcatttgctttttgttggataaatttttgttggaaacaaggaatccttctgtcttggttcaccccccccctcccgctcacaatcgcttttttccatgaaaaaa

SEQ ID NO: 68349 - DNA, 395 bp, Heterodera glycines
  Genomic contig location: Contig_ID=SeqID_8513; Location=5750..6144; Strand=+
  SCN-specific regions: Sequence locations=1-395
atgagttttggacgactgaacaatgcaacgccaattgagctttttgaattggagaacgaacggactaatgagaagctgacattgaagggagtgtcacgccatcctggcaattggctgttgaagcgatgcccaactaatggagaaacgacgacggttcagcagcagaaagatgaaaattcggatgtcaatttgcacaatgtccattttgtgcttgatattgacaaacaatgcattgggtgagcaataaaaaaaacatttgattttgtttaaataattcaaattgcacttaattatttaggccattgtcgccaccatcggaagaagaaaaagcgggtcaaagcaacgatgaaatgttctcaacgactcccgagcccagtaatcagcggaatgagtga

SEQ ID NO: 68350 - DNA, 784 bp, Heterodera glycines
  Genomic contig location: Contig_ID=SeqID_8513; Location=4899..5682; Strand=+
  SCN-specific regions: Sequence locations=1-31,53-463,495-784
atgaaccgacaattaaagaaaatgtgaggaatttttaaattgatgatttatcatttaataaatcttttcacacatttcagctacatttgtacggatgtttggatggacattctcccgttctttgaacgagttgaactcggcctcacattggcacttctctctccgcgtttcgatgttttggtggacgcgcatttcgacggaaaaagaaaattgacaatttggagacgtatcattgttcgaaaaggcaaaaatgccgaaaaagttcttgttggaatttattggtgcaaagaagagcattacacactcatggactgctgtccgttgccgaacaaaattcgcttcgattgccttcaaattgagtaattcttacaaaattttctgtgtgtattatgaacgcgttttttatgtcccctttttcagatacatcgatcattctgtgctcgcattttttcgctccaatcagcaaatttttgacaaaggcaccaatttgactatacatatacaatcatccaaaaccgaaagcaatgtgcagccaatttgggatgttttggtccgtcaaatttggcctatttttacggcgacaaatgtccatcatttgcgctttggcaatgctgatcatttggacactttgcttcgcctcacatcgccgacaattccctccgatctgaacattaattcaatccagtcttatcgtggtctgttccccgacgcgcttggtggtgatgatgggccaaatatttcaaagaggtgtgaccaaactttcgttaaaccactgactaattga

SEQ ID NO: 68351 - DNA, 135 bp, Heterodera glycines
  Genomic contig location: Contig_ID=SeqID_39882; Location=553..687; Strand=-
  SCN-specific regions: Sequence locations=1-135
gcaataaaggaaattcacagcattcgacaccgtcggtacggagagcacataaaaagcactctgaagccgggaaaacaagcggtgaagagggcaatggtggagaaggcgcgcaagaaagtgcatttgataaggcaa

SEQ ID NO: 68352 - DNA, 506 bp, Heterodera glycines
  Genomic contig location: Contig_ID=SeqID_39883; Location=506..1011; Strand=-
  SCN-specific regions: Sequence locations=1-12,34-136,158-251,292-506
atgtcaaaccgaacaaattttgccattttatttgcagagggatccggacagcgaggaaacgaacaaagcgacgaggaaaggggcgccgatttcatcggatattccccgataatcccaggcgtatgtgaacattttgtattaaaataattaacttaaatcacgaaaattctataaaactctaaaatattttagcaacgaattgtcgatgtgaaaatggcggttgacttccaaaggcaaataacaaagtacgccttaacatacaaaatggtaatggaactgtttgagtttgaatatgtgagcaaaaatgaattggaaaatgcggacgaatgcgccgtttgtttaaatgaatttgatgaagaagaaaagttcgtcatgatacataagaatgagcggcaacagacaaagccagtaaagaattgaaattaaaattgaataattaaataagcattgattaagcatgtgtttcatgaaagctgcatctttaaatggtttgtgttgataataaa

SEQ ID NO: 68353 - DNA, 88 bp, Heterodera glycines
  Genomic contig location: Contig_ID=SeqID_39887; Location=86..173; Strand=-
  SCN-specific regions: Sequence locations=22-88
cagcagcagaaatgaatgaatggaaatgtggaagtgagcatttaatgaaaagggtgccctttttataggccgaaaatgtgagggcggg

SEQ ID NO: 68354 - DNA, 123 bp, Heterodera glycines
  Genomic contig location: Contig_ID=SeqID_39890; Location=541..663; Strand=-
  SCN-specific regions: Sequence locations=1-123
aaacggcaagcactcgaagaaaaggaccaactcgagttgtacgcttccgccttggacgaagacttagagcgtctttccaccgactccgaagatgagcaggagacgcggaaagcacggccaaat

SEQ ID NO: 68355 - DNA, 1466 bp, Heterodera glycines
  Genomic contig location: Contig_ID=SeqID_39891; Location=91..1556; Strand=-
  SCN-specific regions: Sequence locations=1-81,118-224,279-280,303 -446,488-695,728-903,925-1031,1070-1096,1118-1127,1149-1243,1265 -1377,1399-1466
atgacggcggtgatttatcacgggaaaaaatcattgaggaaattaaatacgaatctggcatttattcgttggcgggtgaacaaaaaataataattttaaatgaaaattcaaaatttaggttatcaatcggcacattttcaactctcaattttgccggacaaaaatgcatttgtgaatttattgaaaatcgtcaaagtttgggcaaaaagtcggttaaatactactaaaattattagttcaatttaaataataattttataaaaaataataatttttatgcgaaatttgatatatatattttttcagctcgcctcatttattcgggcatttttggttattttaatggcatttctttttcaattatggcatccaaaatttgtctgctctttccaaatgcgcctttgtcatatttattgcaccaatttttctcgatttactcaaaatggtaataaattaaaattaaaatttggaatattaaattaaaattgcctaatttagggattgggcccgtgttccgattatgcttaatgaattaactccaatcacaaagaataaaattgttttccgttggcccccattgattgggcaaaatccaatgacaataattacgccaaactttcccgaacaaaacacaacattcaacgtgaacaaattcacgcttaagacaattgtcgaagaattggcacttggtttagaaatttttttttactaattttaaaaattaaaagattttaggtaataaaattctgtccgaacatcagaaaaactggcaaacactttttaatgaggttaaaattgaagaaaagtttaaaaacttcgcggtcattgtgggtctgacttctcagttcgacaatttcactgaaaattgtgcatttcaacggagtaaaattcgaaataaattatttgaatgggcaaaaagggaaaatgttgccgacaaattggaccattaccaattaaatgccgaattggaggaaaaagtacgctgcaaaatatttaggtaattttaatctttgggaaatacataattagtgtaaaatttcttaattttaaattttgtaaatttatattagttttgtgctttttgtcgtggttaatctcaaaaaatctcaaattttaagaaagaaatgagaaaaaccttttaaaattatggttcgcagatgcctagctattaggcgccgatgaatttattaaaaaaatgccaatttatcttttagttgtagaagtgatcaaaaattcattccccttttaattttttaatactattaacacaaatgtttttagcaaatctgctttttgctgttattggcttgttggtcttcgcttaaatgctcaaaactttcatcgtgtcgctgatttggtcccaatttatggccaaaattcttccaaaaaattttttatgcgatcatttttttcagcgacaaaaaacctcagcaaattgtaattaaagcatattttattttaataaa

SEQ ID NO: 68356 - DNA, 167 bp, Heterodera glycines
  Genomic contig location: Contig_ID=SeqID_39895; Location=88..254; Strand=+
  SCN-specific regions: Sequence locations=1-167
atgtttggccaacattttggcgccctgttcggcgcctccgatctgagcccatccgctgctgaggacaaacaacaggcggtgccgtcctccggcgctgagctagcgccggctggcgcagagaacggcacggcgccggaggcgccaaaaacgccgagcttctgcactct

SEQ ID NO: 68357 - DNA, 49 bp, Heterodera glycines; identical to SEQ ID NO: 57477
  Genomic contig location: Contig_ID=SeqID_39900; Location=248..296; Strand=-
  SCN-specific regions: Sequence locations=1-49

SEQ ID NO: 68358 - DNA, 2459 bp, Heterodera glycines
  misc_feature (551)..(551): n is a, c, g, or t
  Genomic contig location: Contig_ID=SeqID_8516; Location=65..2523; Strand=+
  SCN-specific regions: Sequence locations=1-200,378-396,418-713,737 -764,787-1151,1174-1190,1212-1299,1323-1504,1529-1627,1649-1869,1891 -2072,2094-2436,2458-2459
atggataattcttcagaaaaaaaattattaccattttctaatcatcctaatattgatgaaaacacaccattgctcagcacaaggtgatttacagtactctacaaattttctatttgtattcttcggtaaatcaatcggttgataattttgtgctctttccaatgtgcctaataatttttccagtttacctaacctcaaagaattttttaaaaatattaaaatttactgaattttttaataaattttattgaatttttgaaatattttttcgtttatttcaataatgaatttttaaatttttcactaaattcgccttcagaaaaaaatcaaaaaatttttttaattaaaatttataagtaaataaattttattaaattctcaatttggcaaaaacccctaaaataatttttgaaaattgttttaatttttttgaaccaataaattttaatattctaatgtagtaaaacggactcgaacctccgccctttttccctttattatcttacaaaaaccactaatttaagccaattatgcatttaattttgaactgngagccccaaattgagtcaatgtataaagttaagcaaagcggtttttttgctgcagacggacagcccttccatcgattattatttgtagcataaaaaaggcagtggctcttcttttcttcgttgttttaaatgaatatgagagggttaaaaaatcaatttacgcccaccccctcccctcagccttcgtcggctgttcgtcatttttcattcacaccttccttttctcttccttttgcaacattcttttggcaatgaaaagatatagtagcaaaatttaatttttgaaatgcatcatccttctgccaaaaaccaacgccatttgtgctcttttgaatcaagttcattgccctccgtactaactgatccgttgccgtcctccgatgtacaagctgacgatgaaagaaattccttggttctcggcacggaggcacaattttccatgcaaatgggcaattcgcaatccgttgaaaatttggggcgccgaccacggcgaaggaatggccctcaagcgaagcactcgtcaagaaagcgaacaaaacgacggcgcacgcacagtgacacggacattcgtaaaatgcggttggtttaattattgactatttacaataaataaaattacttgttatccatttctatgcatattaaggccattcattttatctccgtttatgcctacaatagcaacacaagtttccattaacaacggtcagccggatagacatcgtgccacgacaaatccatcggttactctctcctcttcactgcctcaaccgccaattatgacaaaagcaaaagtgattgttccacggatcattggagggccttctgaacgtggcgatgttcgtgtggttggtcaggcaaaatatggtgcggtgcccaattcgacgacagataaaaatgttacggtcggaagcgtcgtgaaacatacaattgctgaaagtgaatcggagagtagtgatgaggatgaagaggaaaggtaaagcaacaaatattccgaaaagtcgctctttgttgttcaagtgagagtagcagcagcgtctcctcttcgtatacgcgtttctccgatctgacaaaaaagcaatgggtcactattgggatgttggcaattgcaaatctctgcagtactgtggcgttcagttgcattgctccgttttacccgggcgaagctgaaatgaaagggtgggccattggcgtgtcttcccagtgactggcaccattcagaatgactacctcagaggttggcttagtcttcggcatctttgagctggtgatgttcgttgctgcgccaatccttggcaaatatgttcgtttcatctttcaatcccatttttacaaaaataagtaaagatggattttattggctcaaaattgatgttcactgctgggcttctgattactggtttaactgcaattgcattcgggtatttgtttttgccttttgcacattttgggctgaaataggaattcgtttgagcgaattttgggcaaatttttgagcattacaatcatttttaatccgtttattttcttttgatgacagatttttaaatttgcttcctggtggaaatgtctttttcttcgcttctttgatcattcgttgtgctgaggctttgggcgacgcgtgttttgtcacctcctctttcgctataagtgcgaaatgttttcccggtcgaattgccaccattgttgtgcgtttcgcaatttttaagaaactacattgcttttcagggcattatggagacttttgcgggtcttggttacactgcgggccccgtcattggaggtgttctgtacgaatatggcgggttccaacttcctttctttgtcctcggctctgttcttataatggctacacttctgtcctattaccttattgaggaaattgaaggtttttatttcatttattga

SEQ ID NO: 68359 - DNA, 590 bp, Heterodera glycines
  Genomic contig location: Contig_ID=SeqID_8516; Location=2726..3315; Strand=-
  SCN-specific regions: Sequence locations=1-362,385-590
atgattgttgtggtgagaggaaacccgattgattcaacgccccaaccgccaagcgttggaccaatgaatgaactgaatttagtaaatatgagcaacatcttaatgcttagtaaagagggcacccaaatgcgaaggctgactggaaaacccccgacacacagccgtaagtttggaaggagtcgtcgtaaccattctctcttaaaccaatcagtcactttgaggaaaaaattgaaataaaaatgacttcactgcgtctaaacatcgctgaaaggtcggaatgtaaagagcacccgccgcaattccaagaacggccatggaaagaccaatgaaaaagagattcctaaaatggtacgaataattacaaaatggttttgtggttcctcacttttctatgggaatgagaggagacggtcccacaaaaagcattgagaaaatggtggctaacgagccgaaaagcatgagaatgttacagcactggcaacggtcgaggataaggccccacaacggagcagtcaaacagtagaaaccaccacagagcagaaaaataaggccaaccatagtcgttgacagattaaactaaagtaaataaa

SEQ ID NO: 68360 - DNA, 802 bp, Heterodera glycines
  Genomic contig location: Contig_ID=SeqID_8516; Location=3788..4589; Strand=+
  SCN-specific regions: Sequence locations=1-694,716-802
  Gene Ontology: Biological process=signal transduction
ttccaaaaaattcggtccactgttgccgcacaagttcattccgtcgctgcacaagtcagccaagcgcttcctggaaacccaattttccgtgaatacacaatcggagctcaaatcggaagtgctggccccgggctctgttggaaaatattcagtgggaccaaaaacacaaccaaaaaggtgaaacgaaatgcatgcagaagttggagtcaaatgcgactgttcaggaagtgaccatttggcttttcgagaagcgtcaaacagaaaattgggccccggccaaaagggaggaattcccggagattctgaagcgaggcgtcagtcagctgacccggctcagacacccgcgcattttgacggtggatcgggcgttggaggagtcgcgcgactgtttcgctttttgtacggaggtaaattcgatgactgacgcgaccttttgaatattcgttctgcttttgtcatggacagccactcttcgcgtgtttggccaactgttttggcgatttgaccaacgttttttcccctccggcccatttgaaagagtttcagctgttggacgtggagaggcgccatggcctttaccaggtgcacaacggtcaattgtccttccaattggcacttttctgtttctttattgtttgtagtccttttttgtccatagattgccgaagcgttggcatttttgcacaatgacacgaaaactgtccacggaaatgtttccccttcctccgttctgatcaattcgaagggcgcttggaaattgggcggattggacttttgcattttgggaaacacttcgattccg

SEQ ID NO: 68361 - DNA, 2532 bp, Heterodera glycines; identical to SEQ ID NO: 8517
  Genomic contig location: Contig_ID=SeqID_8517; Location=1..2532; Strand=+
  SCN-specific regions: Sequence locations=1-46,68-263,301-513,536 -1448,1470-1548,1570-1769,1792-1855,1877-2039,2061-2085,2108-2532
  Gene Ontology: Biological process=signal transduction

SEQ ID NO: 68362 - DNA, 1056 bp, Heterodera glycines
  Genomic contig location: Contig_ID=SeqID_39902; Location=99..1154; Strand=+
  SCN-specific regions: Sequence locations=1-344,367-481,533-1056
atgccggctggcagtaatttgatccaacaaaaatatgtgacggagggcattgagacggtggcacagaattgggcaaacggatgctcaatggcacattcggactcatcacagcgcaatgggatgggcgagaatttgtacatgacgagttcgtcgtcaatttcggaaggtaaaagcaatggaaaacgtgtttgataattagggatgatatttttaggcaaaagcctattttttcctgagctccccgtggcctgaaacgcacgaaaaacatgtttttttgggctgttgttaagctacttttcgacttattaatgccttttttctaggcttttatttttatagccttaaaagcctaaaaatttttgaaaatacctatttttgcctattttggcgttttgtccaaaatttgttaacaaacatgcaataaaaatgaaaaatgcaccactaagaaacgacctgaaaattttataaatacaccattaagtaattaaaattttttcaaaaattcatcttcaaaataatttatttattttttgagaatttttgattttaagaattatttagctaaatactgttttccctaatttttttacttttttgtaattttgtcattttaaacccctaaatttgagactatttagagcctattttccattttttggagactatttttagggtttttagagcctaaaggctacctattttagtgttttccggaaaaatttggacttcagaaaatctggttcgggtgtgtttgcaaatcgtttatcaaatggggtttgctggatcaacaagattaagcttagagtctcagttatttttgtttgtctttgagtacagcctttactcgggaatgaatttgatcaaatggatttctggataccgaattgataaaaaaaaacaatttctcatgatcaacactgttttgtagctgatgcgctgaaacaagcttgcgacatgtggtgggcggagctaaagcaatacggcatccaggaaagccttgtgctggacagggaacagttcaacaagggcatcggacattggagccaggcaaaatga

SEQ ID NO: 68363 - DNA, 810 bp, Heterodera glycines
  Genomic contig location: Contig_ID=SeqID_39903; Location=239..1048; Strand=-
  SCN-specific regions: Sequence locations=1-64,87-134,159-337,360 -581,603-810
atggtgagatgaatggaatgactctaattagggggtaaaatttaacaatcgtcccacaaaggttaggaaagctttcgactgagacagaaaatcagccacgtgcatacggacaagtgtaaaagttttttgtgcctgcctttttcttctttctttctctaatcctttcaacgacgaagttgcggcctatcaatctgatggttttcaccaataaattgtcgatcattccaccgaatccacgccaaaacgaacttttacctatgcgagtgcttcggcatgaacgattaaacgcagctgacctagcacacttatacttgcaagtactcttcgaacttgatcatcttaaaaaatatctgtttttaatcattttcccttgaaatacggtagaaatcaatcatttttgaggtgtccaattttgaccccaaccctatctcatcaaagtataaatcatagtctgatcatttttagcgtaattgcgttgtgattatcactgttcggaatattgatcaatataaatggactgttcaataatctaaatgtacctataatcgtatctgatatgaatgagatttaccctatatctcaaatttaaacaaatgataacatgttcgacaggtctcaaataacgcgcctcaagatattgggtaacttcatcgtattttaacataattttttcaccattcggctcctcttttacacattcaactgttgactgcatcatatccattatagatatatttgaaaatatatttaacagcgttcatttctgaacaaaattctacattgatgagtgattggaatcacattaataaa

SEQ ID NO: 68364 - DNA, 437 bp, Heterodera glycines
  Genomic contig location: Contig_ID=SeqID_39904; Location=80..516; Strand=-
  SCN-specific regions: Sequence locations=1-3,40-437
atgttttattttcttttattttcattaattttttatattggtgactcggcgtatacgaaaaaacaactgaaaaactgtctagggcaatgtgggctaacgtttgacccaatgccagaagtgggcacttttcgtgtgagttaattgaatttaatggtaattcttcggaattggtttaccgcagaaaaaaaaattttttttctgctttttaggtaaaaagggcgttgatcacgactacgagctcttatgttgaaaatcaagatattgtctatgttttttttatcaagaatatgatttttcaaaaattttgatagaacgttgttgccggtaactccatttctaaaatatagaactcataaatagtttttgaataagccattaatatatggagaagtcaaactaaattattaaattcaaaagataagaaaacaaaaaataaa

SEQ ID NO: 68365 - DNA, 861 bp, Heterodera glycines
  Genomic contig location: Contig_ID=SeqID_39910; Location=82..942; Strand=+
  SCN-specific regions: Sequence locations=1-337,359-861
ttaaatgaaaaaacgtgggccaaatcggaatttgtcggaacgaaagaaggatcaatgtcagaagtgatcagaaattttgatgaagtcgtgctgtcatcaaaagtgaagtggctaatcgtaatggccggcaaagattcgattttggcaggagaatcgattgacagcataatggagaaagtcaaaaggctccgacaattatgctcaaaatttggccacctgaagattttttggctcttgccgccgttcatttttgccaaaaagaatgagtcggaagagttttgcgcgagaatgagagctttcttcagaaagaagagtgaaattgagctgatttcggtcaatgaagaaggacgaagtctgttggaggtgttcagatttggcaaaagttataataacgagcacgtgaatcagaacggatggatgacggaaaaaggaatgaaagtgatgaaagcatggctgacgtcgctggttccgggattcccaggcgatcgggagcttggaattcgaacggtgaagtcaaaagtggttgtgccggacgttgagcagggcagtggtccagtagaccctccccaaattcgctacaagggcccggtgaaaaatgtgggaggaggcccaggtgacccttccccatctccgttcgactccttttctgacgatggtccaacccattcagttcggtcggtgaacgtgcggaattttggcggagaatttagccaatttgggcgggctggtacagcataccgctcggctcatcgtggtggaccgtcgtcgtcgcattatcacccgtaccagcgcgcgcgcggcgggcccgtctaccactcgactccatctcgtcgccgttccgattttgtgccgagacgttga

SEQ ID NO: 68366 - DNA, 412 bp, Heterodera glycines
  Genomic contig location: Contig_ID=SeqID_39911; Location=419..830; Strand=-
  SCN-specific regions: Sequence locations=1-107,134-260,285-312,339-412
atggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaactttaaattaacatttgggcgtttcagagcagtttctgaaaaaatatttatgaattgattttgctaaaaataaaatagtgaagcttaaaaattaataaaattttaattcagaattactggagttagcatctagcaggcttttccttgctttttgatgctctcgcaaatctggtcgcttctgatcagtttataaaaaaaaagtaagcctaaattttcgcatatttaaaagcaataaa

SEQ ID NO: 68367 - DNA, 149 bp, Heterodera glycines
  Genomic contig location: Contig_ID=SeqID_39911; Location=1270..1418; Strand=-
  SCN-specific regions: Sequence locations=1-14,38-149
tggcctggcaggtcatttaaaaagcaattaaaaatttttagattttttattcatctccctttttgatagtgaaagcatcagagagccttatttaacttttaattaacatttggtgcgtttcagagcacgttctaaaaaatatttatgaa

SEQ ID NO: 68368 - DNA, 719 bp, Heterodera glycines
  Genomic contig location: Contig_ID=SeqID_8518; Location=444..1162; Strand=-
  SCN-specific regions: Sequence locations=1-19,41-58,81-576,599-719
atgattgttttgtctgtctatcccctgctgcttcttctcttatctcttcctgtgctccatttttccttttcatcttctgtttcttcgattagtgtctctgatcaatcccccggcttaattcgcaattccactgatcagcaggaaatcgccccgggactgtcctcgctgacatttgtgttcgatcggaccggctcaatgaatggtaacgaatgagttgaaagtgatcgaaatgattctgacaattgcagacgatctgaaccaagtgcgacaaggcgcgaagggcattttggagacggtgatgaagcagcggcagaagttcatcttcaactatgtgctggtccttttccacgaccctggtcagaaatgaatttgaaaagggactctctcgaataagaaaagccaatctcgagaaggactgatcggccatattcagaagtggacccgccattgatcaccaccgatccggagatgttccagcagcagctcgcatccgtctccgtccaagggggcggcgactgtcccgaaatgactctttccggcatcaaaaaggcatccagtcatgcttttcgtccactttttccatttatccaggctttggaagtgtctcttcccggctcattcatttacgtttttacggacgcccgttccaaagattatcacttggaggagaccgtgctcaatctgatccaggagaagcaaagctcggtgtgttcaaatga

SEQ ID NO: 68369 - DNA, 912 bp, Heterodera glycines
  Genomic contig location: Contig_ID=SeqID_8519; Location=709..1620; Strand=-
  SCN-specific regions: Sequence locations=1-439,463-492,516-773,795-912
  Gene Ontology: Cellular component=plasma membrane; Biological process= cell-cell signaling
ttttttctgcctttctttctttgttttggcattttgtcttctttcgtttccgcgcacacttgtggcaacaatcgaattccatacggtaaataaatgacggaaagtaaagttaaaagtcccccaaagtccgatttccctaataaaacacatcgtccaaaaaatgccatttcctttcgctttaggcattgaaatttaccacaacggaatgccgtctttgctctgctcccgccccaattgcttcgacaaaatgtacgcggtgagtccgtcccttttgagtgtttcgaatggtttttcgatttgcgaaggattgcgacgaacgcgccacccgaaaggcgtgcgactcgaaaacgacttgggtcggcggttttgacaagggttacggcgacttccaaccgtaatcatttcgacagggaaacggggccatctgtggggaaatgccaaaaaaattaaaataaaaaatttgcaaatcatcccaattaacaattaaatcgtttaattaattgatcaattaattacccactaattacccccccccccttcccctcagtttgtacctccaatgctgcgagttcgaaatgctccccacactttcgaaggaattgtattcgaatgtgatcattagacctggcgaatatttcgagggggaagaaataatggacaaatacggcgaggaagtgatcgcttttgatctgatcaccaatctgaggaaaattaacggcgatggcacaaaaaacagcaaaaattcgtcgtgagtgttttcaacggcttttatctttcaaaggggtcactgatttggcttttgaaattgcttaagggtttcttactctgtggacattcgccgcttccattgcgaccaaatgaccaggccgaagagattcaaaccttggaaatggccatgaccagcaaatcgcc

SEQ ID NO: 68370 - DNA, 68 bp, Heterodera glycines
  Genomic contig location: Contig_ID=SeqID_39912; Location=761..828; Strand=+
  SCN-specific regions: Sequence locations=1-68
ctgcaagtgtgaaggttgaggcggcggacaatccgaaccttcgcatcaacgaagccgacccaatgctg

SEQ ID NO: 68371 - DNA, 540 bp, Heterodera glycines
  Genomic contig location: Contig_ID=SeqID_39913; Location=361..900; Strand=-
  SCN-specific regions: Sequence locations=1-2,25-51,92-316,338-352,374- 428,455-499,521-540
atgtctggaagtgaaccaatgtctaatgagatcataaacaagtcagtaataacagttgacagagaagaatggcaaatttttaaaattttatagctaatattatcgggagaagtgccatttttattcggaagttttttcagaagattttgggtctcgatgatgttaaaatttatatccgatataaagcattgatcaatttctataatattacccaagcatggatagcttgggtcggtttcactattattaaatgaattggcaaataatgtggcaaataattcagatttctcagcactattatgatagcatttattttcataaattagattaggtatttcaaagggattgacattgaatttttgtatatatttataaattgaatttcttccctttgaaatagcctttttctcaatttggctatggtatttatttgtttgtatttttatatgtaaagaaatgctatcgtatagtgcttttttggatgggtcagttttagcttgcctgaataatttagccttttctttgatagatgctaataaa

SEQ ID NO: 68372 - DNA, 657 bp, Heterodera glycines
  Genomic contig location: Contig_ID=SeqID_39915; Location=204..860; Strand=-
  SCN-specific regions: Sequence locations=1-657
caaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaagcaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 68373 - DNA, 441 bp, Heterodera glycines
  Genomic contig location: Contig_ID=SeqID_39921; Location=365..805; Strand=+
  SCN-specific regions: Sequence locations=1-320,344-412,434-441
atgttatactttaagaaaaggctggccattttgggtgcgcgcccaaaatctcgccgccaaaatttttaaaagtttcaattttaccaatttttcaagaaaaaatcaaaaaaattttatgagtaaatttcaatgaaaatgcattttatttttttcaaaatagctagaaaattttttataaaagaatttttaagtttgaaaatttttctcgaaaatttggcggctaaatttcagccggcgaatttttgtcctgttccggcaatccctccccccccccccggagaaattagtactgtcaaaataattctattaaaagtgcattgtaattaaattaattatttattttcagccaaatctgctgacaagcttgctcttcaactggatgaaaagatggaattttgaaggaaaaaaaatgttttttaaatttttgttgtttattgttaa

SEQ ID NO: 68374 - DNA, 1038 bp, Heterodera glycines
  misc_feature (988)..(988): n is a, c, g, or t
  Genomic contig location: Contig_ID=SeqID_1132; Location=145..1182; Strand=-
  SCN-specific regions: Sequence locations=1-614,636-814,838-887,909 -1038
atggctgatgactctaacaacaactacttctttgttgtattgcctagcaatgttactgattacgtggacaactccacgtcaaaatatcgtgtgcacctaccgaaaccagttcaattccgtggctcatgggtctgtggactgtactcaatacagtaccctcactcatgggcttctacaatcggaactgtggaggatcaatggattgacattcattacattgatggaagattgctacgtgttcatctaccaaaatcatcacaacagaacacagaaggactacagcgccatttgaacggtacactaacgaccgctctaagccgcaaaagcactgaagatggtcaaactccttccattaaacggtccaaaagaagcgtggatcaaggacaacagcaatcacgggaagagacggaaaaagaaagcaaaactggtactatggagataaatgatgaaggcgaaagagtaccacaagataaccgtggagtagagtgtataaagattgggaagctgaccaaatgcaagcggattacaccaattgcacctgaggaagaacagaatcaagagagtagcagtaaggacctacctaaagatgacgattcatctaatgatgaaggtgaaagagtgcagcaagacaataatgcggtagagtgccgtaagataggaaggctgaccaagtgtaagcgcataaagccgattgttacggaaaacgataataaaaatgatggcaaagatggagaagcagtcatagatacaaaaacatcagcatctgatacaacattgaaaaattcagaaataacacccccatcaaacccctcagcacaacgacaacaacaacaacacgatgaacctcgagcccaagctcttacacgtggcgaacagctggggaagcgattaagaaaaactgaaaatgaagttcaatctcaacaaaaatcaccagtaaacgaatcattggaagctcagactcagttcagtgatgctaaggaccaatcgnaaacgcacgcagatgtgtttaaagaccgtctttctacaatacacggagat

SEQ ID NO: 68375 - DNA, 918 bp, Heterodera glycines
  Genomic contig location: Contig_ID=SeqID_1133; Location=904..1821; Strand=-
  SCN-specific regions: Sequence locations=1-16,38-62,84-626,648 -792,814-918
atgtatgcaaatcgctttgttcttgtaccagaggaaatttacaagggtctgaccgcaacagccacctccggggaccctaatttggactttacacgacgtgctcttgatgaagttaagagagagcacgctgatcctacaacaaaaaacgctcattacaatcaagaactgcgtcgctaccttcacttgaagaaagcatatgacgaacgacctgttaaagtctcaattgacaatgcttccgcacccgttcaacagtctgaaatacccgttgtaacaccctcacaaaagaaacgcgccaaacgttctatagtagaccgacgtggaaggaacaaattatcctcatcaacaccagcgacatcacggcgtagtagcaccagtaacggagaggtctctttctctacggacattgaggaaaatggaggcgcagaaacagattcgggtagtaaaattgacaccgcggattcttcatggacgagtgctaaaagtgccgaaacaaccggtactctacgagccgaatcagaagtttcttctgcaacaaagaccgcaacgcctgagcaacgatcgaaatggataaatgaattcggtgtgctgttcatggcaaatccgggcaagtatggcgtttcggcagatggtggaattcgaaatcaacagggtgctcgaattgcaaacagtaatattcgtcgttcgcttgaatggatcttcaatgttggaactcgagcgaccaccaaaaggcccccaggcacttcacagattgagcaaatattcgagagagaacgtcttctccgtgcctatttaccacaacctcaacaacaacaagggcaccaacaaaaacaaaagggatcgtcatcacgaccgctaataggaaaggaagaagtagcaaaatttgaccctaaattatggaaatatacggacaaagactga

SEQ ID NO: 68376 - DNA, 1400 bp, Heterodera glycines
  Genomic contig location: Contig_ID=SeqID_1133; Location=2217..3616; Strand=-
  SCN-specific regions: Sequence locations=1-606,628-1400
atggataacaaatctctcacaagtcaactacttcctacagtcaattttttggtcacaactcagggagtgactgttcacagtgaccgattggacactccgcgtgtagtgtttttcaatgatgatggtaccatttgcagacaatgccgatataatatggatttggactatctgatcagtaaggatggagtctacattcattcgagccgactaaaagggaccgaaaaatttgtaccattcgaccgagtgtatgacctgccgcgtttttgtgcgtttcgcgtacggtcgcgccgaatatttaaagtaccctatattttctcggattctccactagaaaaggcaatgtcgtcaactgttacatcaacgactgaaaaccctctcatcgacaatgttgagcggaaaaaagcgagatttgactcagactcgcgcgacattactacgaaaaatggcgaagatgagaaaccagaacttaccaatcggacggatgaattaaatgtgggagagaaagcaacagatgggatgatacggacagacaaaatggatctgtcgcaagtacaactaatggacgaagcaaacacaatggaaaatacacctaaattcagaacaaataaatttatttctaatctagacaccatcaaggaagaaaaagatgtttaaagcgatacgcatgttttatttgtataaaaaccctaattatatcattattgttcaataaactcgttatgattgacgcgcagcggtttgagagtaaagagctaaaattttgtctcccattcggatgtctcgtgtccgggcctagttcgagcggcaaaagcaccttcatttgcaaacttatcgaacaagcggaacatataatcgaccctgcacccaaatcgattttgttctgttatggggagtatagtccatcattaacagatcttcagcatcgtataaccaacgtgcaacttcatgccggagttccggatgcagaaatgattagttctttgacaaagcccgcgatgatcattctcgacgaccttttgtactctatagatgaacgctacctagcagaactatttaccaaaaaagcacaccaccaaaatttcggggtcgtgttcatcagtcaagacctgttcgatcgtaagcttaaagtggttcgtcaaaattcgatgtacatcgtcctactacgtgctccaaactccgcattggccatccggaatttgggcgtccaactgttccctcgacaattggactttttcttggatgcttatcgacaagcaacacgtcaaaaatactcatatctactcatcgatctgcacccatcgtcggacccattgctacgtctacggaccaacatatttaaagaagacaattccgacaccgctattcaacagacgatttttcttcctaaagcaggcatttga

SEQ ID NO: 68377 - DNA, 911 bp, Heterodera glycines
  Genomic contig location: Contig_ID=SeqID_1133; Location=4147..5057; Strand=+
  SCN-specific regions: Sequence locations=1-78,103-193,215-345,370 -557,589-781,816-911
atggagggccccgatgaagacgaatttactattgtagggtgggacccggaaaagaaagtcgtaatggacctcgtttgtttaaaaaacttaaagtgtaatttttcgataaattttaggaagccgccattcactctgctcaaacaatggaacgttcattcacacttaggacaaaaaacggaatggtggaacacaatggacacactgttgacactgaaattggcgcaatggaaaccgttcaaacatcatcaatcgatacatccccattgttcaacacacaacccgtccgtcaatctttgcccccaatttctctccttctgtccaacatcccccaaccagtgaaaagcgttttaaataatataaataataattctaaatgtgaaataccgttttatgaataacataataatacgaaaatgattttcacagagcgcctttcaaccctgctttcctcgcctcacctgcgataccaagcacgtaagacagttgcacactgcccttcaccaatcaaatgctgacggtgaaagcagcagcaacaacaatcggtgttcaagtgctatgtcaatggcgtcctcctcatcatcctcgtcaaattccgggcgaaagcgtccacccacaacagaaacggatttcagaaaaatagcaaaaattcaaaaacacaattaccgttgtgacgacggaaatgggtgccctgagtgtgaccgaattcatacacagaaattacccataaattttaacaccttttaaattcataacacatcatcaaattttccattttttatttgttaaaattcataaaattttccattttgtcatttgttatacattcataaaatttccacaccgccaaattttccgtcttttcatttgttagacattctgacctcccaaaatcgctcaataggcacgagaca

SEQ ID NO: 68378 - DNA, 166 bp, Heterodera glycines
  Genomic contig location: Contig_ID=SeqID_1134; Location=1416..1581; Strand=+
  SCN-specific regions: Sequence locations=1-18,40-166
tattatgtaacgtgaccggacatttggacagtggacatctggacagtggacattacgacagtggacatttggacagtgaagtcatttggacagaaccggacaattggacagtggacattacgacagaaagtgaatttttttactattaaaaatggctttagcagca

SEQ ID NO: 68379 - DNA, 345 bp, Heterodera glycines
  Genomic contig location: Contig_ID=SeqID_1135; Location=421..765; Strand=+
  SCN-specific regions: Sequence locations=1-345
atgaatgttgaacgacaggaatcggaaacgggactcagcattgtcgccaaactcttcctagcgtaccaagaagccaagaactacgattgtgaggaggcatgggaccgaataatggatggggaattgaccgaaattgagcctttgcattctaggaaaatcctaatgcaaagggccgaaaaattttcagttaatttattcactgaaatggcgaaaaacacaacgacaggactcggcacaattatgtccattctaatggcacgccaaggggaacgaacgcctccacaaaattcatgggatgagctattcgtagctaaacaaccagcattaaatgatttgattggatga

SEQ ID NO: 68380 - DNA, 534 bp, Heterodera glycines
  Genomic contig location: Contig_ID=SeqID_8521; Location=1011..1544; Strand=+
  SCN-specific regions: Sequence locations=1-26,48-52,74-219,253 -299,366-489,511-534
atgttcaaaaatcaatacagggttagttaaaaataaaaattattatacatagaagaaacccaattttatttaggacccatttaaaaagggcaaaatttttttatgggccaaggcctcctcacaagcgcacacaaccattgagaaggggggaagataacatgaaaacatgcaaataattgggggagaaaaacgcatgacaagcaaattgaccgaccaaaaacgagaaaagcatatgacaagcagcagcagcagtgatatttccaaagatttgcccttaattgggcgtttcatcatcactctttttttgtataaaaataaataaataaataaaaaattctttttttaaaaaggaataaaaaaaatttcaggatgttttgccgaatttttattggaaagaaaatgcaatttttaggcattcaaatcacgtttaaaaaatttaaccattgaaattttttgctttttgaccattgattgataccgttattttcaaaatttctttgttttcactctccaaatattcttcgacctaaccaa

SEQ ID NO: 68381 - DNA, 1419 bp, Heterodera glycines
  Genomic contig location: Contig_ID=SeqID_8522; Location=359..1777; Strand=+
  SCN-specific regions: Sequence locations=1-234,257-648,677-998,1028 -1122,1144-1253,1275-1355,1377-1419
atgatcggaagaagagtggtggaaatgaaatattatgccaatgatcagcaggccaaagattacgctgaccatgtgacccgttttcttcgagagtccaagtctcgaaaatgtaatgccgagagtactaaaaaaaattctcgctcccgagtatttggtagcttcagtctcaggttcgtacaaaatttctttgtaaaatcagcattcaaaaatgagtaaattttgtgaaaagccaaaaatttgattttttatatacataaacactaagcaaagagagacagctttttagcaatgttaattgacgatttaaaaaatttttagaaaaaaaggaaattatagttaaggaattttttaaaaaaggaaaaattgacgatttaatgaatttagaaaaatggaaaattgactgtgcaaagtttagcaaagaagaaaacgaaaatatttatcgtttaaggaattttgaggaaaaaaacggaaactttacagttcaaagaattttaggaaaaaaagagaaaaattgacgatttaatgaatttagaaaaaaaaaaccggaaattgagggttcaaagaatttttagcaaagaaaaaaaagaaaaattatgtttgacgaatttctagaaaaatttaaaaaattgacggttaagagaattttcagcaaagaaaaacaaattgaatacaaattgaatacctatgttacacaaagaatgcaaaattgaagaaattctctacgtctagaaaaatttcgattacaaatatgtatataattagctttttagcaaagggggggggcaaatgttatggataaaatacgtctgctccattcatcgatttgtcgttggcatttttttcaaatatgctaattaagaaatcaaaaatgcccaagtatgtacatataataatgaaacccattaaaatttgaaatgggaaagggggggggggggaattgcccctcgcccaaaatgaaaaaaaattttacccgaaaatggattttttttaaattttagtcaattttcttaatttatcaatttttcccggcggcggctaacacggacggcattgttggatcacaatttcccatatttttacaaaattggtggcacaagccaagcggaagaaaggtgaagtgaggtgaaagtgtggtgtggtgttgacaattagcatgagtgatgatgggatgggaccacagagagagaacaatcatcagaagagcattaacggggtggtacacacaaaaaaggaagggattttgtgcctggggcaattttctgggaaaaaagaatttccgggttgggagaggcatgacctgacgattttaattcattttcaaaaacagtccagaaaaaaatttcagcaggtggggtgtgaggggtaagggcgaaaattttcaaaattttcaacctcaatttttgagttcggtagggctga

SEQ ID NO: 68382 - DNA, 387 bp, Heterodera glycines; identical to SEQ ID NO: 52041
  Genomic contig location: Contig_ID=SeqID_39923; Location=233..619; Strand=-
  SCN-specific regions: Sequence locations=1-82,116-138,160-387

SEQ ID NO: 68383 - DNA, 820 bp, Heterodera glycines
  Genomic contig location: Contig_ID=SeqID_39926; Location=169..988; Strand=-
  SCN-specific regions: Sequence locations=1-367,389-820
aaaatcgattttttcaagtgtccgtttggggtactcacacacattatggggagcaaaaatccaacgcagaattaaagtacaggctatagggaagctattccggaaggattcggtctccccatatatgtgggcgcatcggttcggggggactgccccgaaaacaaaaataaatcgattttttcaagtgtccgtgtggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaac

SEQ ID NO: 68384 - DNA, 305 bp, Heterodera glycines
  Genomic contig location: Contig_ID=SeqID_39931; Location=690..994; Strand=-
  SCN-specific regions: Sequence locations=1-305
atgccaaaagccgatgattctcatgtaaagtcagcgaccgtccccgaaatgacatcttctgatcacctaatcgctgatgaacaaaaaggaacgtcgggaggaaaacacactttgctggaattgctcgggatagacccgaaccaagttcagacatattcagcggacatgccaaaagcctatgatacttgtggaaagtcaacgatggcccacgtgatggcatcgtctgatcaacgaattgctgaggaacaaaaaggaatgttgggaggaaaacgcactttgtctgaactgctcgaggaggaacacaa

SEQ ID NO: 68385 - DNA, 387 bp, Heterodera glycines
  Genomic contig location: Contig_ID=SeqID_8523; Location=9..395; Strand=-
  SCN-specific regions: Sequence locations=1-229,270-387
atgtctaacaattcgaccattgcaatgccaaacaataccaccaattcatcgccatctgagctgattttttgttctggcattgtgttgacctacattgaattggcagttcacccaatttcactgctgagcacattcttttttgtcgtattaatcatcaaaacatcggttttccatgccaatttgaagcgcattttgttgggccaaagtgctggcattgtgatggtatgccaaaaaaaaaaattaaataattttttaaatttttattttaagtttgaaatggcacgaattacgtatgtgctcattaaggttgtggctggcaatgtttttatgcaaggtccaattgtaatacaaatatttgggctgttcggctacattctacggaatgcg

SEQ ID NO: 68386 - DNA, 267 bp, Heterodera glycines
  Genomic contig location: Contig_ID=SeqID_39935; Location=215..481; Strand=-
  SCN-specific regions: Sequence locations=1-104,136-146,169-267
atgcaacagacggacaaaggcgaggagggcaaaatttcattggtggcatcgaaggacggattggaaatgattttgggatggtaagtggccaagagaatcgaatgaatttggcaattaattaaaatggaaaattaaggaaaaacggaacacaacacagatacattgagaggaaagccaggccaacttcactgcaaattttcatcgatgtcggatcagtggaagtgttctcggaccaaggcgagtggagttgcaccgcacgcatcccag

SEQ ID NO: 68387 - DNA, 144 bp, Heterodera glycines
  Genomic contig location: Contig_ID=SeqID_39935; Location=1031..1174; Strand=-
  SCN-specific regions: Sequence locations=1-144
ggcattctccacaaggacaaccgatggcataatgccgtgtgcgagtgcagtgggctaatccctttgggcgacccgctctcattgcagacattgtgggcatttgtctactcaatgtcgaacagcgtggacgaggacggaaggtga

SEQ ID NO: 68388 - DNA, 294 bp, Heterodera glycines
  Genomic contig location: Contig_ID=SeqID_39936; Location=9..302; Strand=-
  SCN-specific regions: Sequence locations=1-101,144-294
atgccacaaccccaggcactgacaataatccatttgaagaagcattgttggacaaagcggagaagggtgaagcatctgcggacggaaattcaaaaacggtgaaattaataattaaaaaaaatatgtcaaaaattttaattaaagggccaacccccagaaaatgacgaagaaaatgccaatgatgatgagagtcagcaaccgtatgaacgatcacaaacaattccgctgctgatcatgttcattgtttatgtgttcatcggcaacgtttgctttctgcttatgagccggacatga

SEQ ID NO: 68389 - DNA, 326 bp, Heterodera glycines
  Genomic contig location: Contig_ID=SeqID_39936; Location=560..885; Strand=-
  SCN-specific regions: Sequence locations=1-78,143-301,323-326
atgctgaccttggcaaatttttgtcagaaattttggatggttgggaaagaacttgtcggagtgcaaaaaagtaatttgaaaaataatcaaaaaatattttagtaatttttatatttaaattaattttctatttcattttattcagagaaattcaacttttttggcgcgattttcgtgcccagccaaaaaaatacagcttcatttcactcatcaatgcacaaaacaattgcattttggacccaaacaacaacaatccgagctttatggaacgtttacaagcctttcgtgggaatgtaaaaatatttgtagaattttgtataaataaa

SEQ ID NO: 68390 - DNA, 56 bp, Heterodera glycines
  Genomic contig location: Contig_ID=SeqID_39937; Location=254..309; Strand=+
  SCN-specific regions: Sequence locations=1-56
atgcagcagagacaaagggccgaggagagaacgccgtcaaaggatgaaaacacaga

SEQ ID NO: 68391 - DNA, 1369 bp, Heterodera glycines
  misc_feature (1266)..(1266): n is a, c, g, or t
  misc_feature (1338)..(1338): n is a, c, g, or t
  Genomic contig location: Contig_ID=SeqID_39940; Location=205..1573; Strand=+
  SCN-specific regions: Sequence locations=1-74,104-189,211-259,282 -343,371-776,798-1247,1271-1369
  Gene Ontology: Mol. function=pyrroline 5-carboxylate reductase activity; Biological process=proline biosynthesis
ctgaaaattggattcatcggagcggggaaaatggcgcaagcattgggtaagcgaaacgaaacaaatttaaagcgaaaattaaaaaaacaaaaaatttttttttgtttgtttagcgcgagggctcatcaattcgggtatgaattcggcaaattggacaagaaaaaaaatctcgaacttttgtcaatttaggacgctatccggcagagcaattgatggcgagttgtccaaaggtacggcaaaaaccgaacaataaaacaacaaaatgttttgttttgttcagacggaagttgcaacgattgagcaattcaaagtgagcaaaaaaaagcgagggctttgaattttcaaaaaaaaaatttatttttatttttttcagaaaatgggcgtcaaaatgacggatgacaacacacaaagtttgtggatcatcgcttttttcaccaatttatcaccaaaaaacacacacagttgcgcgtgagaatgaagtcatcattttgtcggtcaaaccgatgcaaatcggcaaagtgacgcccgaaattgcgccccatgtcaaacagagtcatttgctcatttcacttgccttaggcaagcgattaccgtaaaagggattcgctccaacaaatttaattttttcagggattaggctcctctccatcgaacaagttcacacattttgtacatttttttgatggtcgaactaataacaaattcacagtttttgccatcaaattcgcgagttgtccgcgcgatgccgagtaattaatttacttaattgtcacactaattgcacccctaattgccacagatactcccgccgttgtcggcgccggtgtcaccgcttataccatgggtatcaattgcacaataaattattcaccccccccccccattttcgtcgctttaattttgcataatttaggctcggcgtgccaagatggtcaattattaattacaataattgggaattgccaatgaaattttaggcgactcaaatttggtccacaatttgttctccaccgttgggcattcttttgaggcatgcatccctttttgaaaattgacgatcgatcaaaaaattggcattttgacagacgcccgaaattcaaatggacgcaatcggcgcattaagcggctgtgggccctcttatgtgagcatcaaaaaattttgaatctttattcgtatatttttccccataggtcttttcgatcatcgagggattggcggacggaggtgtcaaaatggtgcaaatttgaaaaaaaaatttaatttanaattggcgttaaatgcgtcgccaaaaatgaaatgtcaaatttgccagggcctttcgcgtgaattgtccatanaatgggcgccatgactcttttacgagctgca

SEQ ID NO: 68392 - DNA, 898 bp, Heterodera glycines
  Genomic contig location: Contig_ID=SeqID_39941; Location=121..1018; Strand=+
  SCN-specific regions: Sequence locations=1-898
atgaccttcggcaacaccgccccaaggaaatattcaatatcgcccgagtttgaacaaataaagttcgagaagagagtggcggagacgcgcgtgggacagctgaacgaactgctcgacaacgcgcgcgaattggccgaggcgttcaaaagggagctgcagcaaaggaaggaggaaatggcacacaaagaccaacgtctgcagaatcttccaaaactcgagtactttccacggcagtgatgccacgagagcgctacccgttttaaaatacattcgaaaatacgccgactttaacaaaattgtcgggaattcgggccctcccttccgaatcttgaacccaataggcaattaattattcaggcgtcaactcgacgaacttcgacagactttggaacgcgaacggaagtcgcattcattgttggaagaatctttcttaaatttgcagcgagagaagagtcatttgcaagacgaattggtggagacgcttcacagacacgggcagaagcacgaagcgatgctcgccgcaatggccgaagtgccaaatttatttatttttctcatttttattttcgtttttgtttagtcatcgcagcgtgaatcggaattgaacgcgaccgtacgacagttgcaaaacgaagtgctgcagttccgaaaacattcccatggcgccatgggactcgcgccggtgggctccgcgacgaactccttgtcaagtgcgttgtccacgtcttcgctgctctccagctcaaccattgcacttcacaacatttccatcggggaatcgagcatcgaattggaggaactttcccgggaagagctcatcagacgatgcaacgaactcaccgaacggtgcaaaagggaaatacgttctaagaacaaggagaagcagctcaaggaagag

SEQ ID NO: 68393 - DNA, 2299 bp, Heterodera glycines
  Genomic contig location: Contig_ID=SeqID_8524; Location=1502..3800; Strand=+
  SCN-specific regions: Sequence locations=1-327,349-817,839-1009,1059 -1131,1154-1269,1295-1471,1501-1803,1832-2299
atgtggccattgaggtcaacgggtaatgaaaaaaattccaaaaatgtgccaattttcccattgaaaagatgctattggtatggatgcccgagctgcttccccgacgatgcggcaattgtgggcggaggagaaacggccggggccctcagggcccgggacgcaaaacgaacccggtacattgcgcgggagtttgaggtcgaagtcgtttgggagtgccacttgaacgcaatgctggaggacaacccagccatgaaggcgtatttcgacaactgtccggattctggaccaattgacttccacgatgcattctttggcggtaccttttccatttaatttttaactaattttccggcacaggtcgaactgggcccgaatacttgggcgcatcggtgatcaaccctgagacgggcgactggaaaagccgaacgatcaaagtgaaagactttaacagtctttacccatcgcggtatgaaaatgcgaaaaaaataattaaaaaatctttgaaaattaaagaaacatgttcaccaattacccggttggccacccgaccgtggtgcagtttgacaaggacgtggaatggaggagtccagcggacattgtcggcgacgacggcatccgcctcgagggcatcatcaagtgctacgccgtgccgccccgccactgtcactacgacatcccggtccttccctaacggctcaacaaccggacgttgttccccctgtgccggacgtgttcggaaatgtacccgcgcggcttgatcgaccccgagtacaactgcagacattttgaggactctgaaaggggtgggtttagaaacttttattaagcaaatatttttcttgataggattttcgacaactgtgacgcacattgagctggaggccaccctccgctctgggtacaaggtgacgcacgtgtaccgtgcctacatttggcggcttgcgtgcgattggagcaatgggctgttccactcgtacctgctcaaatttctcaaaatgaaatttgagggtaaaatttgaaaaacttaataaaaaaaaattaaacaaacaaaattttaagcaagcggatatccagcgtcttgtacgtaggcgggcatcagtgaggaggagtcggcacggagaaagcaggaacacatcgacaaggccaaagaaaaggcccaagtccatcttgaggcggaccgaatcaaacacaaccccggactccgctacctgtccaagctgtgtttgaattcgctgtggggccggttcgcacttcggtaaaactttttagaaaaatttataaaaaattaaaaaatcaatagaaatcggctcaccaaaaccgaaatcgtcgagtgccatgcggagctggccaaactgctgaacgactcgaagattgaggtcagcagcatcgatcagctgacggaaaagttttggatggtctgctacaaggccaaggatgagcatgtggtggaacacagcacgagcaacgtaagaaaaaatttttaaattttgaaatttatttgcctttctcaggtggccattgccctatggaccacctctgctgcgcgaatccacttgctggaatcgctgaaaaaggtgtatggccctgcaccaggtgtagagcgctacgacacccgcattctctacatggtaaaaaatttggaaataaatgaaaatatgaagtaatttttataatcaggacacggacagcatcttctacgactacctgacgcggctgggggacccacttccgggtggtgagcagctcggggagctcgccgacgagtacccgaaccacacgattatggaattcatttgtggtaagactcattaaaaattaaacaaaataaatggaatgtttgtttagctgggcccaaggcgtacggattgtggctgcgcaacaacgcaacgggggaggacgagtacaagctgaaggtgcgcggcatcacgctcgactcggatgcctgcgagcgcatcaccttcgagaagatgaaggacatggtgcagaacaagctgggacagccggacaacaacgtccgcttcaactacccaacgaagaacttccggatcaccaagaagggagagattttcactgtgcctctggtgaagcagttcaacccgaccgtcaataagggggtgatcagggatcacggcttgaaggtggtgccctttgggtacagcgacgaagagtggtgtaagtggaactgccctggcgcttgcacctgtctgttcaactcagacctcaatgtgaacatgttcacagaagaggagctgaacgaccccgacattatgccataattgtttttattttttaattttca

SEQ ID NO: 68394 - DNA, 601 bp, Heterodera glycines
  Genomic contig location: Contig_ID=SeqID_8525; Location=122..722; Strand=+
  SCN-specific regions: Sequence locations=1-144,166-601
gacacggacagcatcttttacgactacctgacgcggctgggggacccacttccgggtggtgagcagctcggggaactcgcggacgagtacccgaatcatacgatcatggagtttatttgtggtaagattagttaaaatttgaccaaaataaatggaaactttttgtttagccggacccaaggcgtatggattgtggctgcgcaacaacgcaacgggggaggacgagtacaagctcaaggtgcgcggcatcacgctcgactcggatgcctgcgagcgcataactttcgagaagatgaaggacatggtgcagaacaagctgggacagccggacaacaacgtccgcttcaactacccaacgaagaactttcggatcaccaagaagggagagattttcaccgtccccttggtcaagcagttcaacccgaccgtgaataagggggtggtcagggatcacgggttgaaggtggtgccctttgggtacagcgacgaagagtggtgtaagtggaactgccctggcgcttgcacctgtctgttcaacccagacctcaatgtgaacatgttcacagaagaggagctgaatgaccccgacattatgccataa

SEQ ID NO: 68395 - DNA, 1746 bp, Heterodera glycines
  Genomic contig location: Contig_ID=SeqID_8525; Location=763..2508; Strand=-
  SCN-specific regions: Sequence locations=1-70,92-171,193-710,733 -1449,1480-1658,1686-1722,1744-1746
atgtacaaccagcagctgcgccggtacctgaagatgcgcaaggaacataaggagcggcccgtccgggtacagctcagcaacggtgctcaactgctaaataaaacagtggagacgggtgtgcaggtacggcctggtccggacgaaccgaaggacaagtccgtgatggttaccgacgaagatgaagaggaagagattgaagtgccaaagtttttaaccccaacaagcccgacgcagggaagcagccgatcacccaggaccaataagaaagcagcaaaacagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaggaaactcgcacagaatccgctcgccagtagcctactcaatcgactgtttgttgggtctgggttcgtcggacaagtcaaacaaagcgggcgttttattccctcaaaatggacaagaaaataaacaaaatatacaccgacccggccaatccgggcgggtatgcgggggcgagtgctctgtacgcggcggtgaaggagaagcacccgaagttgaagcgtaccgagtttgaagactttttgcaaaggaacaccacctacacgctgttcaagccaaagagagacaagttccgacgcctacgcactgtgcctacgggtttcatgaccggtaagttgtactggggcttattgtgcacaattcagggttcagatgttcaggcggacttggcagatttccaggcactttcgcgcaagaacagcggctaccggtacttgctgttggcggtggatgttctatcgaggcgaatgttcggcgcgcccgtaaagagtaagcgaccagcggacatgaaaagggcttttgaggagcttttcgagcaaatgccaagggtgccggacacactgtacaccgatcgagggctggagtttgtggcaaaaccgttgaaggagttttacgcggagaagggcattcaaaagtttgagaccagttcaaagaagaaggccgccgttgcggagcgtgccatacgcaccctaaagactcggctgtacaaatatttttccgccaacaatacgtcggtgtgggtggatgtgcttccaaagtttttgagtgccatcaacaactcggtgtgccgcgcgaccggacttagacccaacgaaatcagcgacgccaatgcgagggaggtctggaagagggtgtacggcgaagggctcgcacaattggacaagacaccaaaaatcagagcaggggaaacggtcagaattcccgagcctaagcacattttcgagaagggtacagtatttcacacattttttcggtcaatttattttaattttaggttatatacccaattactctgatcacgtttacacagtagacgaggcccgctcaaccaacccccagcactatttgctcaaagactattatggcacaaagttgaagagaaaattttatttgcccgaattaacaaaagtacaagtggatgaaaacacaatgtatcgaattgaaaagaaatacaaagaacgagtgagagatggaaaaagagaaatattggtgaaattcattgggtttccggaaaaatattgggtgaaaaatgatgaaataaatgaataa

SEQ ID NO: 68396 - DNA, 526 bp, Heterodera glycines
  Genomic contig location: Contig_ID=SeqID_39946; Location=594..1119; Strand=+
  SCN-specific regions: Sequence locations=1-13,38-39,64-72,94-526
atgcgcgacacggataagaagaagaagaaggaagtaataatgcattatttaccacagtttaacaaaaaaattttcaaatttcaggaaattattgctgctgggacgaacaatgtagtgagcgaacagcagcaggacggagtccccggcgacgaacactcggactcggacaattccactgaagaacgtgcgcagaatggagtgcccggcgacgaacactcggacaatgccactgaagaacgtgcgcagaatggagtgcccggcgacgaacactcggacaatgccactgaagaacgtgcgcagaatggagtccccggcgacgaacactcggactcggacaattccactgaagaacgtgcgcagaatggagtccccggcgacgaacactcggactcggacaattccactgaagaacgtgcgcagaatggagtgcccggcgacgaacacgcggactcggacaattccactgaagaacgtgcgcagaatggagtgcccggcgacgaacactcggacaatgccactgaagaac

SEQ ID NO: 68397 - DNA, 497 bp, Heterodera glycines
  Genomic contig location: Contig_ID=SeqID_39947; Location=1..497; Strand=+
  SCN-specific regions: Sequence locations=1-102,125-497
agtcagcaatcgttgcttactttgccagatcggacgggtgcgcatgattccactgttccaagcaccccaccaaaagcaaaacgatataacccaaatataaggaaaaatttttaaaaaaatttttctccatcttcctttttgatactaaagcatcagagtgctaaaattgacttgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctattcccgaaggattcggtctccccataaatctgggcgcatcggttcggggggactgcaccgaaaacaaaaaaatcgattttttcaagtgtccgtttggggtactcaaacaattatggggagcaaaaatccaacgcagaattaaagtacagactatagggaagctattcccga

SEQ ID NO: 68398 - DNA, 321 bp, Heterodera glycines
  Genomic contig location: Contig_ID=SeqID_39948; Location=764..1084; Strand=+
  SCN-specific regions: Sequence locations=1-77,100-145,183-203,260-321
atgcatgacgacattctgcacaacgttggcctagacagtcgtgccgcaattccgacaagttcatgccgtcgcacagctgtcatcatttcacttcatttcggattgtgtgtgcctagtttagtcagaaattaaaccgaaaatgacgaaaaaatattgttaagaaattattttaatttttaaaacatgttattgtttaagcgaacattaatatcattaatcaatttaattaaattaaatcattaattatgtaaataattttgacattttaggcacaaaaactcgcaaaaaagcgcctaaaaaggcagaaaaaatcgtaaagca

SEQ ID NO: 68399 - DNA, 171 bp, Heterodera glycines
  Genomic contig location: Contig_ID=SeqID_39949; Location=698..868; Strand=-
  SCN-specific regions: Sequence locations=1-171
atggcaacaccgccaaaagcaaatgcgctggtcgaagcggccggcaagttcaacaaactgttcattatgccgcccaatcggccgacacgcatcaaaaaagcgatgaacattttgtttggccgcaccgaggaggaaaaacgagtgaccggcaattttgtgtcacgcattgcg

SEQ ID NO: 68400 - DNA, 588 bp, Heterodera glycines
  Genomic contig location: Contig_ID=SeqID_39950; Location=334..921; Strand=-
  SCN-specific regions: Sequence locations=1-210,250-459,481-588
atgcgaaaagcgaaatgcgaaacgccaaaaaatgcgaataatgcgaaaggcgaaatgcgaaaagcgaaacctcggcccatccctggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcgcttcttatagcaaatattaatttatatttgcgtagcttcaaatgagcattctgccttcaatttcgaagggaagtgaatttttttataataaattgatagagagcaaaaagcacaattgtataatattcaaaaaatttatctatgcatttgttgaatgttcctaaacccgatcaaattttttaaacctttatatgaaaacatttattgcaggaaatgacaaattccaacctgggtgagcacacatttcagataagcttcctatcattatttcttagaaacaactaataatctgttgaacagttatttcaaaataaa

SEQ ID NO: 68401 - DNA, 597 bp, Heterodera glycines
  Genomic contig location: Contig_ID=SeqID_39950; Location=92..688; Strand=+
  SCN-specific regions: Sequence locations=1-155,206-350,372-597
aaattttttgaatattatacaatcgtgctttttgctctctatcaatttattataaaaaaattcacttcccttcgaaattgaaggcagaatgctcatttgaagctacgcaaatataaattaatatttgctataagaactgactatttagtcaacagaaaataattaaataataaaattagaacaaaaaatgattttattttataatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaattttttgaatattatacaattgtgctttttgctctctatcaatttattataaaaaaattcacttcccttcgaaattgaaggcagaatgctcatttgaagctacgcaaatataaattaatatttgctataagaagcgactatttagtcaacagaaaacaaataaatcataaaatt

SEQ ID NO: 68402 - DNA, 2008 bp, Heterodera glycines
  Genomic contig location: Contig_ID=SeqID_8526; Location=1288..3295; Strand=-
  SCN-specific regions: Sequence locations=1-47,69-74,170-619,651 -684,708-1363,1385-1703,1725-1733,1758-1792,1814-1921,1943-2008
atgggtcttaaactatttttgatactgaaaatgtcggacaatccgaaagaagaggagaaacaaatggacaaagaaatgtaatttaataaaaataataatttacgattttatttaatttaaaaattatttaaataataatttaacatatttatttaataaatttcaatttctgttccatttgtcctgctgattggcacgcggtgttcaatttgctgccgccttctcaactcggccttggcattgcgttagtcagccgtcgatttgacggacgagtggacgaacacttcaaaacacgcaaatggacgctctactatatggaaatttgctgcaaaattggcgagaatggggccaaggaaatggaaattaaaaagatggaaaaatccctaattggggttggaaaatgttgccaattccgcagaagccattgcctaacaacgtcatcggatttccacgcatccaaataaagtaatgaaaacaatgagtgttggtcgagaccggaaatttcatggcctcgacaccgagactcaacccaggggtttgagtattcaaaaaactcgagacttttctgggttgaggccgatattctaaggctcactgaaatgggaatggacagtttagcttttaaatttttattggtttaaacataaaataggtgaattttcaaaattagcccaatttatattaaacagtcagtttaattggcccaatttgtcttttggaaacaatttgtgacaaatttcactctgcccgaaaaattctttattttttgaaggttttcttaaatttaactcccatttatattgaaaaattctaagaaattttcaacgacccgtccaaaaaatgacaaaatttatcagattatacatcagttctcaattatttttcagttacattgaccacaatgtcgtcgtttttctgtgccgttttcttcccatttttgcttcctatggcacaaattttgccattcaaacggaaagtgaccgcgttttggcgttcgttgtgcgcaacatttggccaatgttacgcagcgaaattcgcgccattgaatttactcaccacaacaatttgcaccattttcgtcaatcttcctcgtccattctgcgcgattgccaaacccttcactcagtgttttcctatggacagtttcccgcctttccggccgacgacagtgccacggcgacagattgccaagcgttggccaaatggttactgtgctcgccccctcgtccggacggttcgccgcgaatgtttcattgcgaactcgaatccactgagcaggagtaccaactggcaccaaaaatagacgaatttaaagcggtagttaattaattaactacatggtttttatgtgtttaggacgtcgaaaacttgaaatttgtttttcagggatttttaagacatcacgacatatttcttttgttattatggataaaatcaaggatatcaatcaccctttaaatgggcatgatcgaatttcaggcctttttgtatgcttcttcccctgcaaatttcatcattaacatttgtctcgtttcgcttgctcacacttcgattttgccattcgatttgacgaatgatttgacgggagagcgaatggtattgacaaagacagtactcgagtacgggcagtacgggacgattactgtacctgaatacgttacgaaatttgtgatggtccgttctccgatgtgccgcgatgagaacaaatgggccaaatgggagaaggaagcagaggaatgggaggacaatatgaaccagcggaatcgaaacctaattgaaattgatgtcaacgaggaaaatttggatgatgggtcagtaaatatatttttaattaaccagcaatgcccaaaaacggaagggttccaaaaaacggaattctgaaaattttctggaagagtggtccgtactcagatggatttacagttctattttataaatttttaattcgtcttttgtttttagacttctcaatacaattaccagccctaatgatcaacagcagaagtga

SEQ ID NO: 68403 - DNA, 2419 bp, Heterodera glycines
  Genomic contig location: Contig_ID=SeqID_8527; Location=1186..3604; Strand=-
  SCN-specific regions: Sequence locations=1-1224,1247-2419
gcacccattgccacggccggacgacatcttcaatgctctccgtggcgcgacagtctttagtcaaattgattttaaagacgcttatcttcaagtcgaacttgacgaggagtcaaaacaacttgttggtctgaacacccatcgtgggttgtttcaataccagcgattaccattcggggttaagtcagccccgtccatttttcagaaattaatggatgaactcacgtcggggttggaaggtgttttcgtctacttggacgatttcattgttgcctcaaccacgaccgaaaagcattttcaaatcttgtccaaatttttcaaacgtttacaggactggggtcttcgtgtcaaaatcaacaaatgccagttcctgtgcaccgagctcaaatttcttggccatgtcatttcagcggatggtattcgtcctgaccctgatcgctcacggtcaatcaaggaaatgccagcaccgtctgatcaacgaacgctcagatcatttttgggggcaattaactattattcccgatttgttagccaaatgagagacatcagagctccactggacgaactgttgaaaaaggataaagaatggaattggggaccggaacagcagcaagcatttgaaaacgcgaaacaaatcatcacgtctgaccttttgctcactcactacgacccgtccaaaccaatcgtagtcgcagctgacgcgagcagcaaagggatcggagcaacgatcagtcatgttttcgccgatggaaaagaaaaagtagttgaacatgcttcacgatctctgtctccggccgaaagaaactactcgcagatagagaaagaagcattggccatcattttcgccgtgcaaaaattccaccgcatgttgtatgggaggaaatttacactattaacggatcacaaaccgttaattagcatttttgggtctaaaaatggcatcccaatttatacagcatccaggcttcaaagatgggctttgacactgtccaattacgatttcaaaattaagtacatttccaccaaagattttggacaggtcgatgttctctctcgattgatcatgcagcaccgcgaggcacagcaggacgacgactatgtcatcgcaacggcacaaacaaattccgatttcaattcaagttcagaagattcaattgaacatggcacggctgctgttgagtatgttttgcatgcaacattggaccaattaccggtgacagcaacagaagttgcagagaaaacaaatcaggacgaagagttgctagaagttttgcaaaattgtcgtaatcattggccaaaaacggcacattcttcccctctttctgcattttacacacagcgcgcacgtctcacagaagttgatggttgtctgctcatgggcgaccgtgttgttattccgagttcattgcgcaaccgcattctcacggcattgcattttacacacccaggaattgtcagaatgaaaagtttggccaaacaattcgtttattggccaagaatggatttggacattgaccggtgggtgcgaaattgtcaggagtgtctgtccgctgccaaaatgccaccgaaagtgccgttgagtccatggccctctccaagcgaagtgtacgaacgattgcacatggatttcgccggcccgtgtgcggatggaaataaatatttggttgttgtggactcgtacagtaagtggccagaaattttcaaaatgaagacgacgactgctcgaattttggtcgataagtttatctggttattctctcgatatggctatccaaaagagattgttaccgataacggacagccatttaaatcatttgaaatttccaaattttgcagagaacacggaattcggcacacttttgcaccaccgtaccatcccatgagcaacggtcgcgctgagcgctttgtggacacgctgaagcgtcagttgaagaagtgtggggaaaccgattcgcattgggtccaaaactcgttgttggcgtatcgcagcacgccaaacgcaagtctaaacggcaagacgccagctgaattctttctaggccgtccagtccgcacaattctgtcattagttaggccaaacgaaaagaaaaagcattcggacacaaccgataagcaataccggcacaaaatggcacaacaattcaaccgccattatgggacgaaagaacgcacgttttgcaccgacaatccagtgcaatttgccaactacaggaacggctcaaaaatgtggttgtcaggaagaattgtttccggaaatggtgttgtttggcgaatatattccccacagttaaacgcagtggttactcgccattccaatcagatcaggaaatcttttcccatcccgtacagagacagttcagaaccaaacgagcaacaagatcagaatgaacagcaacaagaagcacctcagtcaccacgtcat

SEQ ID NO: 68404 - DNA, 764 bp, Heterodera glycines
  Genomic contig location: Contig_ID=SeqID_39952; Location=218..981; Strand=-
  SCN-specific regions: Sequence locations=1-114,136-476,498-524,546-764
atgtcggaattaaattttcaaatttggtgtttctcgttcaaaactaatactgccgatggtagggccccccctttcttgaaaaaaagtcagtaaaaatatatttctttggcttttcaagggcaccaaacaagaatttttgactgttttcgacgaatttcgaatccctactagcattaatcatcgaatattttttagccagaaagtacaacatttcggggctgatcagtcggtgtctgaaaattccaatttcaaatttgtccaatgttttcttggccattgctcaggcgcgtcttttcgacttggaggtgggaaagacgatgatttctttatcttctaatttaagtagagttcccaagtttttgaaatggaattcattttaaaataaggggagggtggtggaaaatttagaaaattagggtttgtcgatacggctgagcctgtaggcgctacaggggaaaaatttaaaattttatgaaatttgatgttaaaatttgattccttaaaaaaatttacagcccttaattcagaaaatcagcaagaatataagcaattattgcactttaataagtactattaacaatattacacattcttagaatttttcgcatcaatgtttgcgttacatttgtcaaaatgcgggccaattgttcggatcagaggaattcttgcaaattgatcagaatttgctatgtgaattattcgaccgtgatcaattggtggtcagcaatgaatttgaaatttggaaagctgtaattttaacttaa

SEQ ID NO: 68405 - DNA, 455 bp, Heterodera glycines
  Genomic contig location: Contig_ID=SeqID_39953; Location=88..542; Strand=+
  SCN-specific regions: Sequence locations=1-264,291-420
atgatggaactgaaaatggtggcggagactgatcagccagcaaataaatgccttttgctcaccgtccaacacgcgtttcccaaatcggcaattttcacgttaatttcgctgtttattggacagaaaacactctcttcgcatgccgaagacggcgacgtttgtccgttacgcattggcacccgcgcactctccgccgccatccgtgccacttctcgcgggtcgagcgcaacgagaacattcggaaatggatggaaagtgagagaaagcaaagggaggaggggagggcacctcaggcttaatgtccgtgtgaataatgcggcatttgcagtgcaaataggcgagaccctgaaaaacagaggagaaaggcatttaaaatgtggaagagaaattgacattttgagcttttggcctttgtttttgtttaaataatttgtttattttttattagttaaata

SEQ ID NO: 68406 - DNA, 56 bp, Heterodera glycines; identical to SEQ ID NO: 67782
  Genomic contig location: Contig_ID=SeqID_39956; Location=160..215; Strand=+
  SCN-specific regions: Sequence locations=1-56

SEQ ID NO: 68407 - DNA, 1329 bp, Heterodera glycines
  misc_feature (27)..(27): n is a, c, g, or t
  Genomic contig location: Contig_ID=SeqID_39958; Location=166..1494; Strand=-
  SCN-specific regions: Sequence locations=1-438,477-879,927-1090,1116 -1329
  Gene Ontology: Mol. function=transcription factor activity; Cellular component=nucleus; Biological process=regulation of axon extension
cgatccctgtgccattttgcacttccnccgcccaagtcagaggcatacggagcaattctccgatctcaccccgaattctcaattttcagtttcacattctttggcagcggctgccgccgcttcgctgacgcctttcatgggttttgcgtccaacggactgtacggaatgtctgcagcggcaccgggactgatgtacggacagtacggcgcccaccaatacggacactttggcgggacaacgagcggcggaaccaaaacgaactcaaggtcaacaaaactgtgccgattcatggaaatgtgattgccaaagtttctcttttttggcatcgaattttattggccattttgctacacttttctatcagtaagcctttaagctagagtgcagagggaccgggaattttgagtttaaccgggactgggaccttttcgggttgaaaaaccgggaatttttggttgggaaaaccgggaaaaaaccgggactagtcccggtcaaaaccgggacctcggtactcagtttccgtgtttaggtcccggtcccgctgcactctactttaagccatttgacctgccgatcaaaataaaggttggccataatggtaaaccggggagggagaatcgaaccgtcgaactccgccggtgcctttgtgcctccgctttaaaacgttttatattccccttcgatcggatactctctatgatcagatcagcccctcccccctctttccttgattagttggtccttctctctctctctcctctttctttgatccctcctcaatctctccctaatcatttcctctttctgattagttgtatttccctgtttcggtttctccaggaatggtcccttccacccgtacaacaacaactccaatccctcgtcctcctccaactcttccgtcccttcttcttcctcctcttccgctgcgatgagttcgctttttatcggcggttcggcactttcgccctacaaattgccgccacaacagcacaatccgtcgtcctcctccattaagctcagtttcggctcggcttctgtcccttcggccgaccattcgttgctttgctcggcgtcactctccgccggtaaataattaattaaataattttttgccaataatccgaaaaacgcttcgaggtataaatcccaacgagcgacgaaaacagcggcgcattcgcacgacgttcacttcagcacaaatgcgcgagttggagaacactttcacggagacgcactacccggacatttacatgcgtgaagacattgcgatgcgcatcgatctgacggaagcgcgggttcaggtggagcacagagaaacaaaaaag

SEQ ID NO: 68408 - DNA, 453 bp, Heterodera glycines
  Genomic contig location: Contig_ID=SeqID_39959; Location=64..516; Strand=-
  SCN-specific regions: Sequence locations=1-108,132-278,300-453
atgacggggtttttctctaatggggtgatacattaggcagctgggaatcagtttttgcttgaagaaaaatgtgtttgaatgtgtaaggatttgaaagcgattaatggcagcaaaacacaatctaaccaggtcacagaaaaaaaaggcatttgtcacataaattggctcttttaggagagccaatttagtttttatgacccacaaggattggtggaaaatatttgaatttttcatagtcaattagattttttttttttttatgctattttaggcgaatgaaaattacatttttattgctgccggaaaatgcgtcagtggaaagatgcagtaagtagaaaatgcgtcattggaaagacggtcagcaatattagtgcaataaggtgctgtagaatagtattgtataacaaaaggacagaaatagtaaaaacctatgtttgtcaattttttaataaa

SEQ ID NO: 68409 - DNA, 73 bp, Heterodera glycines
  Genomic contig location: Contig_ID=SeqID_39961; Location=1135..1207; Strand=+
  SCN-specific regions: Sequence locations=1-73
atggacggacgttcggactttaacaaagtgctgagcgctgacaaaatgccagttcgtgcaaaggccgcttcat

SEQ ID NO: 68410 - DNA, 1028 bp, Heterodera glycines
  Genomic contig location: Contig_ID=SeqID_8528; Location=1571..2598; Strand=+
  SCN-specific regions: Sequence locations=1-121,173-188,212-629,669 -1028
atgacggtgttcccaatgattgcagagttttcgttaatgccacaattgttgtgctacaaatgggcatcggtgtactcaaatatgacttcatcgttgcgcaccttcgtgaggtgtttagcgcaaaaatttgaaatttattaaatttatatttttgttaattctatatttatatggagcaaatattaatgaaaacaaacacaaaaaggaggaatgtaaaaaaataattaaaatgagaatatttgtgtggattttggtctttgcaataaaaaattgaaataatagaattcataaatttgatcgctcattctctccccccccccccacaaattgaagctgttcaatgagttcacctccttccacgtgtccaccttcgtttgggctttgataatttttcctccgatggttttgctcaatttcattcggacacttcaacgaattgccctgctcagttccatcggcaatttgtttatgttcggcgcttacggcgccattttttatgttcgcttttttaaaaatttatttccggtcaatttatgtatatttaatatttgaattgtcagaatttgcttctgccgccctatcgaattgccgaattgccgtggtggaacactcccgcaggcattttggtgttttaaaaataattattaatatttttataaatttaaaatgtttttcccgttatgctttagtccgcctgcggttccattctctactgttttgagggccaagcaatggttctgccgatggagaacaaaatgcgctttcctggcgagatggtcagccgcgttggcgttctgtccactggcatggcactgactgcgattttcgacgcggcggtaaaaatcccaataaaaaatgccattctaaacccaacaataaatgttcaggtcggctttctcggctatgccaaatttggcgaacacatccagggatcggtaacgctgaatttggcacccactccgctgcttgtgctcgtccgtttgattttcaccgccatttcttttctcgattttcttcttcagcaatat

SEQ ID NO: 68411 - DNA, 839 bp, Heterodera glycines
  misc_feature (803)..(803): n is a, c, g, or t
  misc_feature (828)..(828): n is a, c, g, or t
  Genomic contig location: Contig_ID=SeqID_8530; Location=1175..2013; Strand=+
  SCN-specific regions: Sequence locations=1-5,27-119,141-169,192 -424,466-468,491-736,760-779,834-839
atggcatggcacagtacgacagacattggctgtggcgtggccaaatgccaagatgcgcaatggaaactgtttgtggtctgcaattattggccgccgtaatttcaatttttttctttggaatttttacttaaacaaaccaattaattttgttttcggcttttcgggattggctttgtgagaaaagaaaaacactcagcctaattgactcattaatgccggtacaatttcaggggtaacgttttgggccaaaccatttacggctcgggtgacacgtgcagtgtgtgtgagtcggggtgggcgtgcgacttcggcagaaggggcctttgtgttcggcaaaatcagtgacaaaatgccaaacaaaaaatttgaagaaacaaagcaaaaaaaaggcggaaaaggatgatgctttaatgatgtgatgaacaattttaaataataaaaatatataattttatcaatttaattgtatagaaataaaccttaaaattacacaaaattacaattacacctataatattcttaaagtttatacacataaatttaaaattgttccccgaatcacttaccatgacgaaaaaataaagtaattgtcataattgcagcattaacgagtggatattgagtgattaatttggaaaaagtctttataggtattttgttttaatccaatatttatatagcaataatacgaccatatatcacgaggtttattttcaatatccaattagattattttgtttgaaaaatccaaaaaagggatgaaatgaaaatgcataaggaattttatttattagttaaaaaanagaagaattgaaaaaaataattatnaaaaagtaata

SEQ ID NO: 68412 - DNA, 690 bp, Heterodera glycines
  Genomic contig location: Contig_ID=SeqID_39963; Location=305..994; Strand=+
  SCN-specific regions: Sequence locations=1-78,100-288,310-652,674-690
  Gene Ontology: Mol. function=RNA binding; Cellular component =cytoplasm; Biological process=embryogenesis and morphogenesis
atgaaggcattcttcgccaagaacatcaaattgacaaggaaggcgcaccaagacgaggccggccatttgacgttgccgcctttggagaaacaatttctcatctcaccgcccagctcaccgcccgtcggatgggtaagaaaaattgctatttccaaaatgttagggtcaaatgcgttttctcaaccagaatttagtatcatggcgcctgatgtaaaagaacccagaattattctgttatatggtgaaatgtttgcttttgcgtttttttttgggtcgtccaatttgatgagaacccacattaattcaaaagctgcctaataattttcacaattttttctgggaaaatggtacacaaaagcaagagcatttccaatgccttttctgttgtttcagattcaacacgctgaaatggcacccgtcgtttgcgatttcgatttaatggcgcgcctcgcgtcgctaactgtggacgaaaaattcgaattgttcgaaggcgacgaacaccaacgacgcccgtccattgttatcactccgtgtgaaaaggggggaggcggaggactactcgcaaaggacggaggccaaatggcaaactcagcggacgaatcggaagcagaaaaacagcgacaggccgaattaaggtcgaaagtgccccttccgcacacgccaagaccaccgactttgaaggaagagtga

SEQ ID NO: 68413 - DNA, 187 bp, Heterodera glycines
  Genomic contig location: Contig_ID=SeqID_39968; Location=792..978; Strand=+
  SCN-specific regions: Sequence locations=1-30,52-76,105-187
aatttgatgcgtttcagagcagtttctgaaaaaatatttatgaattaattttgctaaaaaaataaaatagtgaagctttaaaaattaataaaaaattttaaattcagaattactggtgttagcatcatagcagtgcttttccttgtctttttgatgctctcgcaaaatctgggtcgcttctgatcag

SEQ ID NO: 68414 - DNA, 487 bp, Heterodera glycines
  misc_feature (434)..(434): n is a, c, g, or t
  misc_feature (452)..(452): n is a, c, g, or t
  Genomic contig location: Contig_ID=SeqID_39969; Location=63..549; Strand=-
  SCN-specific regions: Sequence locations=1-23,144-173,197-216,276-487
tgacggcacattattattgtcaaaggtggaggtggaggaggacagtgaacgaagtgcatggaaaacggatgatgaagatgaaggtgacgatgacgaacatggaatagaggaggaagagaagttggaggaggacggaagaggagcaacaacagaagcaacaacacgggagggggacaacactaaaacaaacaaacagtagataaaggaaggaaattgaaaattttttaaaaaatttataaatgggtaaaaaatagaaaaatttttgattttttttagcaatttttggaaaatttttttcaaaaaactaattcatcattaaactttgaaaacgctaaaaaaatttttctaacaatatgaaattttttatgtgtaaaaaattaaaaaagaaatttcggggaaggggcaaaaaatattttgaaaaattggcttaaatncctttttaaaagcagttncctcgctctcctccctataagaaacccgaaataaa

SEQ ID NO: 68415 - DNA, 1015 bp, Heterodera glycines; identical to SEQ ID NO: 39970
  Genomic contig location: Contig_ID=SeqID_39970; Location=1..1015; Strand=+
  SCN-specific regions: Sequence locations=1-82,104-147,169-176,201 -299,325-481,510-584,606-741,763-830,852-908,931-1015

SEQ ID NO: 68416 - DNA, 1092 bp, Heterodera glycines
  Genomic contig location: Contig_ID=SeqID_8532; Location=1763..2854; Strand=-
  SCN-specific regions: Sequence locations=1-41,63-104,126-126,164 -193,310-310,354-368,456-499,574-794,817-821,881-882,910-989,1017-1092
atggtccaaaaaaaccatttgctcccacctatgatcccgaattccaaaatcagtttatttttgtacttttttcaaaagtcttataaaaatatagaataaacagaagcttatagaggaagaatttcatgtttttcaaaaaaccttttcagaacagcgctattaatttttttttctcaaaaaacgaatttttcctaaatttatgtaataacttcttcattttgaagatagaaaattctaaaaaagtataaaatgctccagatttttctctatttttaatgcttttttgcactttaattgattcatttagaagtgaattatgaattttcaaacattcgcctaaatttccaagggccaaaaaatgaaaaatcttttcaattcaaaaatttcagattaagatttaaattgtaccattatgcagaaagcaaaaaattttaagaatttatatagggaaaggggttgaacaataaaagccccccctcgattggaagccccccccccctcgaatataagccccctttggaggggggttgaacaatagaagccccggggcttataatcgaggaaatacggtatacatattttcttgtttagaaacaaaaaaaattcggttatttttttgcttttcagggacatactacatccatcattcagcgactttggtttcctggtgcctggccgtgtcgcccgttacatcggcgttcagggcgacttggacccgctgttgaccggcacagccgtattcgagatgtttctgcagttcatggagtcgcaatttctgcaccagcaacaacagaaggaggacgaggaggacacggaagattaagaaggagaagaagacgagttggaagaggaagaaaaggaagaggaaggagagaaggagtcaaaagagagaggaggaggagggcaaagcaatgtgcggactgagcaaggggagcaggacgaagtggcgagaaggtgaaaaacagggcattacctttaatttggagttcattatgtttcctccccaccccccgaaaaatcaacaaattttcaaacttaagagaatttttcggaaaaaaccaaaaaaaaatttccagcgatttcttgaataaa

SEQ ID NO: 68417 - DNA, 584 bp, Heterodera glycines
  Genomic contig location: Contig_ID=SeqID_8533; Location=117..700; Strand=-
  SCN-specific regions: Sequence locations=1-160,182-186,290-584
atgacgacaaaacagcaacggagcgacaacaacgacggcaccgcagcaacagtcgcaggacggcgccgcaacgacagcagcaactgcacagccgagtgtcaccaacacggacagccgaatgatgttcacgataaagtgagtggtgggagaagcggtgggaaaagcaaaaatatacatattttcgtgtttataaacaaaaaattttctgttatttttaattttaaatacttttaaaacacaaaaattttctgaaaaaatagtatttttttaaaattcataaaatattttagaaagactaaatgtacaaacgggacccacgcgtttcggcgctcgcgtttcggcgccagctctttttctacgatagcttttttctttgacatccaaatacaacattgttggtatcactcgaaagctcttaacatgctctattagccttaccaaaagcgaaaagattttcaagcctggaaaaaaatttattacgaaaaaacttcaaaaatttcgacttttcgcaattttcatgtataacttttttggaaattgtctaatagcgaagcaatagcttagaaaaaatttctgttaataaa

SEQ ID NO: 68418 - DNA, 673 bp, Heterodera glycines
  Genomic contig location: Contig_ID=SeqID_39973; Location=177..849; Strand=-
  SCN-specific regions: Sequence locations=1-449,471-574,596-644,666-673
atgttcagcggaaaaacgtgagtaattgtaattggatacaaaattattttggtttctctccctcctaacaatgatattcccaggactgaattgttccgattggctcagcggtacattcttgccggacggaaagtcgcagtggttaaatatgcgctcgacacgcgttacgacgagtcgcacgcatgcacacacgacaaacgcaaaatggaggcgattagtgcgacgaaaatggaagacgcattcgaggaactgaacaaattcgatgtcattggcatcgacgagggccaatttgtgggctttttccctccgttaatttatcacatttggcatttccatttgtgttagttcaaagacatcgtcaaatacgcgcaagaattggcaaacactggcaaaacagtgatcattgctgcactgaatggcgattaccggcaggaggttcaccgaagacgcacaaaaattaaaacaaaatttagtaaatcgattttagcaaagggttctatacacagcggcccaattttgggctccaagtacaattatgctggctttttcgtcttagtggtctgtgagttagtcaccaaaaggggggtcccaggttcaagtcctccctatgttgtgtgttaatttcaatttcttcttttaaagaagaaggcagaattattttttcattaataaa

SEQ ID NO: 68419 - DNA, 476 bp, Heterodera glycines
  Genomic contig location: Contig_ID=SeqID_39973; Location=399..874; Strand=+
  SCN-specific regions: Sequence locations=1-476
tgcgtcttcggtgaacctcctgccggtaatcgccattcagtgcagcaatgatcactgttttgccagtgtttgccaattcttgcgcgtatttgacgatgtctttgaactaacacaaatggaaatgccaaatgtgataaattaacggagggaaaaagcccacaaattggccctcgtcgatgccaatgacatcgaatttgttcagttcctcgaatgcgtcttccattttcgtcgcactaatcgcctccattttgcgtttgtcgtgtgtgcatgcgtgcgactcgtcgtaacgcgtgtcgagcgcatatttaaccactgcgactttccgtccggcaagaatgtaccgctgagccaatcggaacaattcagtcctgggaatatcattgttaggagggagagaaaccaaaataattttgtatccaattacaattactcacgtttttccgctgaacatgggtccttaaattaaaatattgaag

SEQ ID NO: 68420 - DNA, 304 bp, Heterodera glycines; identical to SEQ ID NO: 55978
  Genomic contig location: Contig_ID=SeqID_39976; Location=206..509; Strand=-
  SCN-specific regions: Sequence locations=1-304

SEQ ID NO: 68421 - DNA, 305 bp, Heterodera glycines
  misc_feature (46)..(46): n is a, c, g, or t
  Genomic contig location: Contig_ID=SeqID_39976; Location=711..1015; Strand=-
  SCN-specific regions: Sequence locations=1-305
aaaattccctcaaaaataaaaggtctattgcgcaccgccctccctnatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 68422 - DNA, 447 bp, Heterodera glycines
  Genomic contig location: Contig_ID=SeqID_39977; Location=495..941; Strand=+
  SCN-specific regions: Sequence locations=1-106,129-270,294-447
atgtgttattatgctatatctttttattttatcaacgttatagttcatttttttattgcaatttcaagtgcaacgtcaccggtgagttgtttttttactttgccataattccccatttaaatttaataggttgaggacaatgcactgcttgcatttatgaaaagctatggtttgcacaagcagaatgaaattcagaccggtgaatattcggcgcaaaaatacgaagcacaccttggcattgtttattttatgagagagaattggcaatgtgccaaaatttgggacaaatttgacgaatttgaacagggagaatgccaaaaatatcgcaaatatttggagattttgtatgaatatttgttcaccgagtacattggaatgcccgcagtgaagcgaaaatttgtgtttgaaaaattcaaatttgaaattgaaggcccgataatttatgcg

SEQ ID NO: 68423 - DNA, 54 bp, Heterodera glycines; identical to SEQ ID NO: 53113
  Genomic contig location: Contig_ID=SeqID_39978; Location=106..159; Strand=-
  SCN-specific regions: Sequence locations=1-54

SEQ ID NO: 68424 - DNA, 431 bp, Heterodera glycines
  Genomic contig location: Contig_ID=SeqID_39979; Location=71..501; Strand=+
  SCN-specific regions: Sequence locations=1-276,377-431
atgcagcgtcaaaaggatggaggagtgccatgtgaggaggctttacaccaggttttgggactttacagagtgacaccccacccagcaacaaattcatcaccagctgaaaagctattcggtcgcaaattgcgtaccatgttggatttggttcgggtttgggatcacaagataattcgtgggttatgtttagggatattaaaagggcatgttctcaaaaacattgaaatttaaccaattccaaaaatcgcccgaaatgtctgtccggaaaattattcgaataatataattattttaattggtaaattacttttcacctgcctataaattaaatattttaaattttcataattatcaaaaacaatttttagaatataatgaaaccaaaaacccatgtttcacccattcagtctattccaaatttatttttataa

SEQ ID NO: 68425 - DNA, 1295 bp, Heterodera glycines
  Genomic contig location: Contig_ID=SeqID_39980; Location=285..1579; Strand=+
  SCN-specific regions: Sequence locations=1-204,226-351,387-596,618 -861,925-1295
atggaaaaaataatgattgaatcgaaaatggtatcgattctccaaaacaatgaaacttttctggaacggtttaacgttgtttccatatctccaacaagttggttgatcgatttttttttgtttaaaactgcttattttttaagctgtctgttatgtatgtgaaaacgacacactttcgacatccgattttttcggcacaattttttcatttattgacggaaaaaactgtaaagaatcgtttacacttttaacttaaaagcacaatttagcgtggggcgtattttgcgcttgtgtttcaattgttgccgttttcgtgttatttttcaaaggcctccctttcttttggcaattccaagaaggagaaaggaaaatgacagaaaaattggaacaaactttttgtgcgattggttggacatttgcgacgtgcaatgggcgattcagcccaattccatcgctacggaaacccaaagacaatttggtgaacaaaaccctaatggacggtgagtgtttctttcggggggtttaatatgacctgaataatacaagattcggaaacattgttggacaacgaattgtctgacagtgcgagtaattacgaagaggaggagggggaagagattcacccgacaaaacgcatcaaattgtacttcgattctcctgacacccaaacggggcgacattcaacagaatgaacaacagattttcttaccattttcccggtcattttgctggtctcgatgatttactgaagataatgatctcatttccttccaattattgaatgtgaaccttttttgttgttgctgtaatttacagattaatttcctatctgattaatgatgatttaatcagttcgaaccgtaaaatattttttacatttaattaatccctttaatttttgttagtttttttaatatattttttcatggattcatttctaccaaaacccgaggatcattgtcgcattcaaatccttgtaggtatttcccctatatttattttttatgcgtactttttaggtgaaaccgttgggaaatttcagtgtgttgtcttttggtcgccttgtcaaagcattggagcggcggtttacttctgttcatggtgaaatcccatggaaccccaacaagaaaatcctttataatttgttttgagattttgctcttctaaaaagttaaattttcttccaataatttccgtcgttttcagtgtcttccaatgtcaattcgcaacgccaaattctgcctaaattggtcacggagttggatttggaattgaccaggtttggcgagtttcag

SEQ ID NO: 68426 - DNA, 1238 bp, Heterodera glycines
  Genomic contig location: Contig_ID=SeqID_8535; Location=213..1450; Strand=-
  SCN-specific regions: Sequence locations=1-39,61-518,541-728,752 -818,850-889,954-1238
atggaaattttgaaaaaaaaaattttttttcctcaggaacttcgtgatgtgttggctgcccgtgagcagcgactggtgggcgaactgtcgcagtgccggaccgatggccaacgctattttgacgcacgttttgccactcttcatgcactgattgcggacagtgggaaggcgaagagcagcgcaaaggcatcgtttgtgagccgtatggagaagttcaacgccaaaaagacggacgatttggaggtggcgctgaccgcccgttttctgtgcgacaacaacgcatcatcggccatcagtgtggccatcagccaacttggcactggttggttttttcacattttaatcaagggacatccagtttcgattaatttgtcctgtttcaatttgtccattaatcgatttgtccgatttcgacacataattgagatgggttttcaaattctatcgtaaaatgattttatttaaaccaacatattcggaaattataaattgcaagttgggtggttgtttccccctcaaatatcaaaaaacttttttgggccatcatccattttggtgtcatttatgtacaactttgaagattatgtcacagaattctatcattttttttttgaattgatcagaatttcctggtttactactatggtctttaaaacaaagaaaggaaacaaactcaaaaaaacaatatgcaaatgccgtggttcgaatgcctacaagctgaccaattcaatttttcacacacacattttttgcagtgcccgccgtaagcgctgtcgagccaacgccgacgccggcagcagtcatcactcaaaatggggacaaccacaacatcaacaacaacaacaacaaacgttgtggtgaagcgtcgtccaacaaaactgtggctccggccgccgccgccgccgctgtctcaacaaacgccgcagcgccgccacacccaccgccaccagcgcgcaacgaaaatgtcgtcaagcggtcaaacagtccgtcaagtttggtcagctcggtgggcgaagactcgggcctcggcggccaaatcagtcccgtcaaccatggtatgtatgatgggtgtcaaattttccatgatgtaaatttcattcgtgggtttgggtgggagtccaaactgccgaaaagggataattgggcgatagccggtttttttttggcgggggtataactccttttataattgcccgaattaatgcccaaacacttgcagataagcaaaaataaataaa

SEQ ID NO: 68427 - DNA, 1899 bp, Heterodera glycines
  Genomic contig location: Contig_ID=SeqID_8536; Location=71..1969; Strand=-
  SCN-specific regions: Sequence locations=1-390,423-541,564-601,623 -759,785-1129,1151-1157,1186-1434,1472-1762,1784-1899
  Gene Ontology: Cellular component=cytoplasm
atggccgccgtcgctgctcaaccgaaagtcgagaagaaaattatggacgagaaaattgccaaagttcgcgaggttgtcaagaacatcagcacaaatggtaagaacggacggcagagagtggcacttttgcagtttagtgggcccaaggaaaaggagtcactttttattgtgatttggcatttttatagaatggggtcgacaaaaaaatcaaaagccctccctttgattttcgacccccaactctgattctgtgtcggtccctagtctataaaaatgtccgtattttacatttttttagggttcagtgacttatctcatagacctaaaccgattttggctctgttgttaccttttggctttcaatcagtgaactaccctcagttttttaggccataactttgtttttcttgcttattgttaatcaatgctttataaatacaaaaaggagcaaatattggcaagttattgccttggaaactgaagatggtcattcaccgggtccattaaactcaatcaaaaggagggggcgtaccttgcaaagaaggaaacttttgaattctatcaaaaagtaaaaacaaaaggggtgagtgacccttttgtttgcaaaattttttaatattttgtcatgaaaatttattccctggggttcttggggtccaagacctcgaattagatgtcagattcgtgatcagcgacctctaaaacccccggataacaaaaattttcatggatttttatctcaaaaaaattttgcaaaacaaaagggtccccccttttgtttttgataaaattcaaaagtttcctctttgcaagtagcgccgcaaaaagagtgttttttcatttcttattaccattttcaacaccattcatatttacagacattgttttggccttgcacaactttgaattggacgtcgcgcggaccatccacgcattttgtgaaggtatttgtatggttttaaaactgaaatattgtttccatcggagtaggagattgatcagtggtttttatgcgattttgggatgtcctctgaggttttcaaggggcgctcgctgatcatgaattgcatcaaatttgtcctgtgtttatctggtctatatcttaatgtgtatgctttcattttttcgattttaaacaatggatttttgtgcaatggaaataaaaaaaaagatttaaaaatttatgaaacacacttctagggtaggaaaatgcgctgatttcaaatctgagcttggatggatttatatatcattgatttttttcatgataagggttttcgaaaacctcagaatagatctcaaaatcgcataaaaactacttaatccatttttatgtgaccagcagggctaaatgattttccggttttagcataactgtgaatctgctgaatattgaattgccgaatttttgtctaaaaccggaatcgtggtcccaattatattaaaaatatatttattattacaaattttaggtggttctgaggtggcactcggtgactgggaacggaccggcggtgccaaaaagcggaaccagaaaaagaagtcgtcgtccaagggtggtgcagccattgcaaatgcgtcgtcactgtcccaccaatccaacaattcgggtacaacaacgccgagcgttgcctcctcgttggtgaactgctccaacgtgtcgtcggccaccaatttggcggacaaattgttgttgacgaacggaagcggccccgccgccacggcgttgccaacgaacgcctccgtcggcgtcgtcacccatcaacaactccaacaacaacaaccatcgttgttgttgaatgagcggggcaatgatggtgttgcggattgtgaggagaaatcattttcaacaacacaaaatcatcaccacaatcaccaacaacagccgcagaagcacca

SEQ ID NO: 68428 - DNA, 99 bp, Heterodera glycines
  Genomic contig location: Contig_ID=SeqID_39985; Location=885..983; Strand=+
  SCN-specific regions: Sequence locations=1-99
atgacggacgagcccgaaacaaaggaccaactaatctacctgatcatcgtgtgcgagaaggcgcgacgcttcgacgacatggtggaggcgatgaaaaag

SEQ ID NO: 68429 - DNA, 465 bp, Heterodera glycines
  Genomic contig location: Contig_ID=SeqID_39990; Location=374..838; Strand=+
  SCN-specific regions: Sequence locations=1-465
atgaatgataaaatcgactggctcggccgcttcgcggcctcgcatcctattcttggctttttctccaatcgccgggactcaatccaccagcattcaatcactgggactcaatccaccagcatttcaatcactgggactcaatccaccaacattccaatcaacgggactcaatccaccagcattcaatcactgggactcaattctcctgcgtttcaatcactgggactcaacccaccaacattccaatcaacgggactcaatccaccagcatttcaatcactgggactcaatccaccaacattccaatcactgggactcaatccaccagcatttcaatcagtgggactcaacccaccaacattccaatcaacgggactcaatccaccagcatttcaatcactgggactcaatccaccaacatttcaatcactgggactcaacccaccagcatttcaatcaacgtga

SEQ ID NO: 68430 - DNA, 282 bp, Heterodera glycines
  Genomic contig location: Contig_ID=SeqID_39991; Location=73..354; Strand=-
  SCN-specific regions: Sequence locations=1-282
atggccaaatgcttcccatgggttcagctccgtctgatcgggcagccgtcgctggagttggacgaggactttgacgaggagttcgagctgttcaagcgctaccaaatgcaagtccatcgcgagagggcgtcggacctgaccccggacgcattccgtcgctttttggcctcgtcgccgctgtttccgagccccccgcacgagggacaacagcagcaacaggttgaaggagcggaggacattttggcattgatcagaacccttccgccgattctcccgatttaa

SEQ ID NO: 68431 - DNA, 2673 bp, Heterodera glycines
  Genomic contig location: Contig_ID=SeqID_8537; Location=2885..5557; Strand=+
  SCN-specific regions: Sequence locations=1-558,580-794,863-971,993 -1058,1080-1522,1544-1624,1647-2303,2325-2354,2376-2451,2473 -2595,2617-2673
  Gene Ontology: Mol. function=structural constituent of cuticle; Cellular component=extracellular; Biological process=cuticle biosynthesis (sensu Nematoda)
atgctcattaggtgtcagtgtgaaccaataaagccccagtgccctccgggaccgcccggaccaccgggtgagcatggcatcgacggacaacccggacagcacgggatgccgggaaaggactacacattagtctatatgccatccgcggtctgtcctgtcatggactacagccaatgcatgccatgtccgtccggacctcccggcccaccggggccacccgggtctcaaggccgtcccggctgcgagggagagccgggagaaggaggacgactgggcaaacacggagcacccggtaaagaagaatttgggaaagtttttaatcgggttttaggccagcggggcatggctggtgaagcgggacttccgggactaccaggtctgcccggacttcccggagcagcgggggaagacgcggaattcgccccaacgctggtaagagcatcgaaaaacaaaacgcaatagtcacccatgcctttaccatgtaattagcagaatttgcttggtttttagcccggtccaaaaggattgccgggtcagccgggccttcccggcttaccgggcgaggcgggcctcccgggcacacccgggacgccaggccccgagggcccacccggcccagctggacagcttggcctccccggcgcgcgtggatcagcgggcatccgcggcacaattggacttcccggcacagatgccggtggggggaatcaaacattttatttcgggtttcattttaagcatattgcccatgtccgaaccgatcgcccgtttatcgtcgacagaaataatggcagaatatataatattttacatattattatatactataaaattattcggaaaaaaataaaattttatttatcaaatcgcactaaaaattaattgggttttccattatattatatattttgttcattggatttcaataattttatatttttcgaggaaatcgagcttgatcaatggcattctattgaatttccgtatttttcgcaaaatctcaccggaattttctaaataaaaaaagttccggatccgtaaagaaattctcgtcactattttaaatttgaaatttaattcttatggcgaaatgttattatttttttgcatcgatttgctttccattccattcaccattcatttctcctaaaaccagccaaaagccaaataaatattccttgaaatttttttattgcaattatggagttggagccgatcatcaaacagaaacacaaattgccacgagaaaaggtattgtatttgtttagaatttttaaatttggtgtttttaatgttcaaaagagaaatccttacctcaatgtcaccagggactaagattttagcctcagaactattctttagggtatcttgaaaatctttttttacaaataaaagattgtttgattggtcagtttcccaacgacgtgtggcacagagagcgttatgcccgtgacagtctgataatgctcacctttggcagtgccacagttatcggtgtcatttacaccaccagaccgacctggtccaagtggcttttgaagctttctcgcaacagagttgggaccaaaggagcaggttctccaatttttacttcttttacacattttagcaactgacttcccaacctttgtattttttaattatttgttcgaattcgacctgaaaagaaagaaagacccgggtttgggttttggtctgcgaaatacagactggccaatgtgaagccctgactttcaaaatcttttttttcttgtctttcattttgttttttcctttaggttcgtttcgccccaaatgtgccgcccttcttgtgccattcgtcccgatgttgtccaaccgtgccaatcactccactttcccgcacaatttggtctccccaacagtgcatcgccgttttgtggttatttttttttacctaaattagatgccccccccaccccctaaaataaagacgacacatttttcactttcggtcatattaaaaaaagagcccgacgggcttttgatggcccgtttcaaaaaaacaccgggcccgtgccgcccggttagacgggctttttttgctgggcctgacaattctaaaagtccggtactttcctaaattccggctctattaaaaagcaaaacaaatagttgatacattattttatatttcagattgtcggccgggtcattgctctctccacctttttattcgccatgtatatttttcggatggatgagcgttttattaggctttgcgagaacattatgaaagagattgacgatgacgatcattgaatgattgatttggaagggatgaccaatgttaggctttgtttgtgctatcgagataaaaataattcataaacggacgaattattcaacaaaaaattggttcgaatgatgtgaaatttgggacggagctttggttggccgggcttttaaactttaaaaacaccgtcctcttctggtccccattttttggaaaaaatcctaaccgatttgccggcgaaattaggctttaaaagcagaatctgagcttcgagctttgggcaatcaaaaaaaaatttacctttaaagatttgtgggtttgggaaaaatttatttcacttgaaagtttgatcaattttttaaaatcacttctcacaaaaaagcattaaattaaaggatttaaaacccttttaatacgaa

SEQ ID NO: 68432 - DNA, 198 bp, Heterodera glycines
  Genomic contig location: Contig_ID=SeqID_8537; Location=1..198; Strand=+
  SCN-specific regions: Sequence locations=1-86,108-198
ttaacgaccttttgctcgggtttaacgccaaatttacgtcgaaaaggtttttccatgtcgcgaaattgcccaataaaatcaattaaagaattattgaaattatgtttcttagcattgaattttcataaatttatttagggttttttgcgattcaatgtccaaacaacagaaagttaatggcagcaacagttcaagcgg

SEQ ID NO: 68433 - DNA, 285 bp, Heterodera glycines
  Genomic contig location: Contig_ID=SeqID_8537; Location=755..1039; Strand=+
  SCN-specific regions: Sequence locations=1-285
gatgactgattgtgagcatcactccgtgcccccgtccgcccctcccgtcgacttttgtccgtcttcgccccctccgagttatgcttcctctcccacggcaccgcgcaacaatgccaacgacagacagcagcaaaacactgcaaaaggctgctttttaccctcgtgtaaaaatgccaaaagagcgacaaaagagaatgacgcgggcggcactgaaccatcccagccgacttcggccactgtggtcgttccaatggccaaagacaaagtgaccattctatgccttgg

SEQ ID NO: 68434 - DNA, 220 bp, Heterodera glycines
  Genomic contig location: Contig_ID=SeqID_8537; Location=5898..6117; Strand=-
  SCN-specific regions: Sequence locations=1-220
ggcccttttcccgaatttggccccaattattcctcgccatatttcactcgcaccggcacttattcattcccgaatcattaccatttgcaaaacgaccgtttctacagtgccttctttcgcgcgtcttaccgtagtactgactacagtcccgagagtctctacagtagtcggatcgcttaacgctgaatgaaaataattctgctgctggtggatgcgcaaa

SEQ ID NO: 68435 - DNA, 60 bp, Heterodera glycines
  Genomic contig location: Contig_ID=SeqID_8537; Location=6429..6488; Strand=+
  SCN-specific regions: Sequence locations=1-60
tgatttgaatgggaaataaaagcacataaaaggagcgaatgaatcagtgaaattattcaa

SEQ ID NO: 68436 - DNA, 277 bp, Heterodera glycines
  Genomic contig location: Contig_ID=SeqID_39992; Location=871..1147; Strand=-
  SCN-specific regions: Sequence locations=1-54,77-100,122-144,166-277
atggtaatattcgacaaaagtatgttatgatataaataaatttttgacaagtacaaaaaatatatatatttgaaatttctgctccaatatttttgcagcgtaaaaaatataattttattatcattaacactcttagttacaatcaaaatagttttaataaagtttgaaactaaaaaaaataatttaaacccagaaagagcagagaattcttggttagaggatctgatggttattctaacaaaagttaaataaaaaaatttgatcgatcgaaaataaa

SEQ ID NO: 68437 - DNA, 659 bp, Heterodera glycines
  Genomic contig location: Contig_ID=SeqID_39995; Location=121..779; Strand=-
  SCN-specific regions: Sequence locations=1-257,281-378,406-473,503 -556,578-618,643-659
atgaatgagagtgagtacagttaatgtgataacgattagctttgtacaggcatcagtaatcttgtggacacactccgtgctgggattgacaccctctacagagcgatgaacacaggtccgagcacgtccacggtgcctaaaaagcgaagtgagtgggaaacattgacaaaaataagagagtgtggaataaatatgaattaaaatggttaatgcttacacatttttctaaacattttctcagagaacagcaccgcaccggaggaagaggagaaaaagaaaccggaaggagaaggcggaaatgagcacggaaaggggggcggcgaaaaggaaaagccataaatgttatagcaaaagagttgttggctttaaaaggaggatgtgttctctctctctccttttgttgttgctttttttccagtatgcataaagacaacaagagaatacggagaaaaattcatgaatatttacgggcggtggggacaaagcaaaaatatgcttttttaattgttaatcaaccaatttaaagccttaatagcgcccggatgggtttttttgttgcctgcctctgtcctcatcaaaacggagaacgaaaagcgttcattctttattatgtaaaaatgaaagttaaaaattatttgttttatttgcaggctaataaa

SEQ ID NO: 68438 - DNA, 61 bp, Heterodera glycines
  Genomic contig location: Contig_ID=SeqID_39997; Location=1194..1254; Strand=+
  SCN-specific regions: Sequence locations=1-61
agagcccatgaacagctgaatcgtatgcaagtaccgcccgttgctgtacgcctaacagttg

SEQ ID NO: 68439 - DNA, 904 bp, Heterodera glycines
  misc_feature (54)..(54): n is a, c, g, or t
  misc_feature (61)..(61): n is a, c, g, or t
  misc_feature (65)..(65): n is a, c, g, or t
  Genomic contig location: Contig_ID=SeqID_39998; Location=1..904; Strand=+
  SCN-specific regions: Sequence locations=1-904
  Gene Ontology: Mol. function=uridine phosphorylase activity; Biological process=nucleobase, nucleoside, nucleotide and nucleic acid metabolism
aatcattctctgatgcccgcttcttccacagtgaactacctaggtttctcccgnctttgtncgancaaaccgtcgtccttttgccccacttgggactgtccacattaaacacggattttaaggaacaattcggcgatgtcaaggtgttcaaaagttgcggattggttcagtcatttaattgatttgctaatatttttatttattcccttttatttttttgtttcctcagtttgtctgcaccggcggaagctcaactcgaatgtcggaatatgcaaagtttttctcggcgatggccaatgttgcgtcgggtggaaatttgtgcaacagaacggacagattcgtcatgtttaagactggcccggtgctttgggcaaatgtgtgtgtgttttggaaccaaaaattcgctcaaactgtgccgtttttcgtttagcatggcattggcatgccatccgcgtccattttgctgtgtgaggtcagtcaccgtttgcacatagtcagacggagtactgtactcaaaatcacatttatttctatgtgcttactgtatgtcttatcttcccacctgtccctaaagctcttcaaattgctgcgtttggcctgctgtgccgatgtgctgttcatccgcctgggcacctgcggaggcatcgacgtgaagccgggcaccgtaatcatttccaacggagtggtaaacgcggccatggaaaaacacaaattcgtccagtggatccagggaaaagaggtccgaacggagcaaaaaactaaagaaaacaactgctgctaaaaggtgaaacgggacgcactgctcgacgcgcaattgggcgacgatcttttcgacacggccacggaaatgcatttgccagtggaccggggactcactttttgcaccgacgatttttacgagggt

SEQ ID NO: 68440 - DNA, 579 bp, Heterodera glycines
  misc_feature (4)..(4): n is a, c, g, or t
  misc_feature (93)..(93): n is a, c, g, or t
  Genomic contig location: Contig_ID=SeqID_40000; Location=47..625; Strand=+
  SCN-specific regions: Sequence locations=1-229,251-406,429-485,507-579
atgnagatggatttggtgcaaattgatttcaaaatgggcaaacttttgcaggccttacgaatgactggctttggtttgcacaaatcggttgcncagcataaatatgaagaattgaagagcaaaatggagcaaaaaaagagaggcggaaaactcggaataattgacgtgtgccaattgtggagttgcgcggaagacatcaaaaaaataagccaattaatgaacaaaaccatttcaaacatcaaaaaggagataaacaatgctgaacaattgttaaaaaggagcaaaaagttcgatttaactattattaactattaatccgattttagaagaaaaaaataattaaaatggttttataagtgagaatttccaattaaaattgtcaagctttgcatcaaagcaacaaaaatattatacattttgtttttattgatagtcaaaattgtcctagtcttttttatttgtatgcaaaacttaaaaatcgtttgatttctataaatttaaaataagagaatcttttttgaattttttaaaacatagtttttttcaaatccaaataattatattatgaatcattgcata

SEQ ID NO: 68441 - DNA, 411 bp, Heterodera glycines
  Genomic contig location: Contig_ID=SeqID_40001; Location=131..541; Strand=-
  SCN-specific regions: Sequence locations=1-171,195-411
  Gene Ontology: Biological process=glutamate metabolism
atggtgctgattagccaaaaacaattcgatgagctttccacgcagtccctgtggaggcctcagctggaaaaagatgcatgtggcgtcggattttgtgtgagcgttagaggcattccgacgcataaagtgagagaccatttgaaaggcatttaatcgagagaataaataaacggaaatatttttgaaaataaattcaaactgttcagatactgcaggagggtcgagtgatgctcgaacggatgggtaagttatcttctaaaatccccctttccactgtccatagatattttctgaatcaattcaaatttcagtccaccgaggcgcctgtttctgtgacgatgattctggcgatggcgctggcgttatgaccgcaattccggacaaactgtacagggacgagctgaagaaaag

SEQ ID NO: 68442 - DNA, 632 bp, Heterodera glycines
  Genomic contig location: Contig_ID=SeqID_8539; Location=233..864; Strand=-
  SCN-specific regions: Sequence locations=1-17,100-134,156-256,279 -343,372-375,409-436,504-632
atggttacggaacagaatggcgctacttttgctgttgacgttgaggaaattgcggctgggcatcacgttacgcctgtggacatgacaacagctaccagcaaacttcagcttgaggtgtgttcattgattccaattacatttttacttaaattttattcaatgaaaacttaattttcggctgccgaagtgcgaaatccggcgaataaaccgaattggtcatcgtatttgcgctctcaattggtgcctcaaaatgagtacaatttcattattgaattggaaaaggccaaaaacaagcaggagagggacgaagcgttagccaaggacaagacgaattcggcacggagtattatcaatttgatcaccgaagttgcgaaggatcagctgatccgttacgttctcacccttttcgacgaccttttgcaggtctttcatttccatttaaactttaattaaaatcgttttttattgaatttaatttatttttaaatatatttaatttaattcttggttgttttcaggaggacaaatcccgggtagagattttccatgattatgcaagacggcaaaaacgaactatttggtcgtggttccaagggattttaacgcgaaatgacagtttcattgtcaaccaa

SEQ ID NO: 68443 - DNA, 947 bp, Heterodera glycines
  Genomic contig location: Contig_ID=SeqID_8539; Location=1033..1979; Strand=-
  SCN-specific regions: Sequence locations=1-35,57-494,523-582,604 -744,766-947
  Gene Ontology: Biological process=positive regulation of growth rate
atggtatgtgagaaatgtaagttaatggggctgccttgttttttaaatatttctattcataggcactaagaaactatcaaagttagctactgtccatgtggagaaaagtgaccaaactgcgaaacgagtgacaaatgaaaacaaattgttgagttcgaaacaaaagtgagtcttacggacatagaaaattgaaaaaatggcttatattgctaaatttgacatgattcctttttggttatttttacaaaaactaattgtaagcgcaaaagctttagtattcatgtgggaacagattttattcgatttgctcatgtagttaatttttttttaaagggtgtttttattatttaaaaagtgagaggcccagttaggttcatttctaatgttgaacgtttttttttagattcaaacctgcaagtgaggaatttaagaaatgcagaatctgcaataagatgacacatcatatttcagcgtattattgtcaaggtttgggatttttaactgaaattttgtttttctcttacctagcaaaaacatccaatatggcttgattggctaaacaatagctttagataatttattacattaatctttttattgtttctatgttttcagactgctcgtatcagaaaggcatttgtccgatgtgcgggagaaaacaaattgagacagcaaaatacagacaaagtctgacataaacttgtttctgatacctattcaaacgagatattttgtattcatttgaaatcgcaagttttcgtatttcctttgttagtagatcaatatttttgtcatattggtaaaattttgttttgcgcgaattggaaacggatgttaatttctgaaaaaaaaacaatttaatgttctaagtggtatttaaaactaacagtatttaaccgaagaaatataaaagcttagtgaatccatattaatttatttgaattaaa

SEQ ID NO: 68444 - DNA, 828 bp, Heterodera glycines
  Genomic contig location: Contig_ID=SeqID_40005; Location=37..864; Strand=-
  SCN-specific regions: Sequence locations=1-828
atgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggt

SEQ ID NO: 68445 - DNA, 93 bp, Heterodera glycines
  Genomic contig location: Contig_ID=SeqID_40009; Location=131..223; Strand=-
  SCN-specific regions: Sequence locations=1-93
atggggagcaaaaatccaacgcagaataaaagtacaggctatagggaagctattcccgaaggattcggtctccccataaatctgggcgcatcg

SEQ ID NO: 68446 - DNA, 51 bp, Heterodera glycines
  Genomic contig location: Contig_ID=SeqID_40010; Location=874..924; Strand=+
  SCN-specific regions: Sequence locations=1-51
aaaagttaagcctaaactttttggcctgtttaaaaaggaattaaaaatttt

SEQ ID NO: 68447 - DNA, 3706 bp, Heterodera glycines
  Genomic contig location: Contig_ID=SeqID_8540; Location=1707..5412; Strand=+
  SCN-specific regions: Sequence locations=1-512,535-746,768-828,851 -1100,1123-1667,1690-1885,1907-3016,3039-3706
atgacagcccccatccaggcattaatcagggggtgtgccagcaaattgggagcattattgggtaccgaaattccacctgacctgggaataaatgccctaccgaatcaatgccaaagaaggctgtacaaattcagaaaccttctgaatgacttagaaagggtggtacaaaagattgaagataatttgggtttggctaatgagtatattggtaaactgagtcgagacaatgcaatccgtaaggaaacggaaatgcaggaattaatgcaggagttacaaattaatgagaaacaaaaggcagctgatgttctcattccaattttgagggacaaaattgaggcattagaagagaggttagacataactcacaacacggatggtgacactacttccggcattggccctctcaaggagcgtgccaatgcgtaaaaatttgccaaaacctgagcttaagagatttgatggtagtccatctcagtggataccattttgggattactttcgtacaataattcatgaggactctcatgtcccaaaaattgataagttcagttatttagactcatgcattgaaggcaaagccagtgcaatcattcagggtattccaattagtgagagtgggtatgatgatgcaatagatttacttttaaagacctacggggagaccaaacgtctaattcgaacgttaaaccgggaatttatgtcgcttccaattagtgagtcattggaagacgacgagtccttgtatttgaagtctgaaaagatttttcgacaactgatttcaatgaatcagaatgtcgaagacggtatgtattacagtaacctggagggcaaaatgtctccagcagaggtgttagataagtactgtgttatcaaggatgccgaagaaaatgatgattgggatacgtcaaagtttcggaatgcattctcacgtgcattggaccaaataaagcataggcaggaattaaggaaaaatgtgattgagcccaaaagggacaaacatgaactgaccatgtctttcacggcattttccaaaaatgataagtaccaagggaggaataaatttcctcaaaggaattcggatcaatcgccccctcgtgggcggaaatttgaaccaaggaaatttcgtgatcagaggcacgataatagtgactcatcagtcagccattcaccaatgagggataggaggaattctccttatcccaaaagggattggtcaagttcaccagagcgtgaaaaacggaaaaaggatgagcagagaaaatgccaattgtgccaaggtgagcacagtgcgagtaaatgtcctaaatatatggatgccctctcacggcgcaacaaagtattgaaaatggaattatgtttcatttgtctaaggactggtcattgggcaagtcaatgtacgttaaagggatataagtgcaacatttgcaatcgggcgggtcatcacatctcattgtgtagatccaaagacatacccaaggataggaggaatagtagttcagaaagttcaccagttcggtcgaagataaatacgactcaagacttctcagagtctgaagaagttgaaaaggaaataacatcggtcacttcgtgtgttacaagtaaaacaacgaaattgtctttgctgaaatgtaaatatgttaccatttataatccagaaaatccaaggcaaaggaaaaggattttggttttcatggacgatggaagtcaaaagacatacatttcgaccaaattggctcaatttttgggtttgaagccaattggtaatcaaaggtttgaactctcaggtttatcgaatgtcgaattgggtaaattcgaatctccaatttatgagtttggccttaaaaagggcaactttgacattctgatgaaatgtcgagcccttgataaaattttgaagaaaattccggtgattgaactcaatcagctctctcaggagcaattacggaaaacaaaattgaaggtaccagaggtatatggtgagcctgatttaattattggaaacgattattataatcgtttgagcattagtgtcttagaggaattacaatcgggactgtatatcaatgactcaaatattggtcaatttttgagtggacaaggaaaggttcaattctttaagtcattaaacggatctcaatccgacatatcatcgtcagtcattcaccatactgtaaaccaaaagtgtggcaatgatattcaatggattattggtcaagtatcggactccaatcacgaaggttcagtagaatgggaactgaatggtgaccaactgagtccgaatgatttaaataaaatgattatggactggaatggtctagaacatgtcggtatgtctgatctcaattcagataagcaaaacgtgagacaaagaatgattgataaaatatcattcaatggggataggtatcaaacagaattgttatgggatgaagaattggctgctcaattgccaacaaattatgatatggcatttagacagttaatgtcaaatttgggcagacttagaaaaacaccggacttgcttcgacaaatccatgaaatcataatggaacaagtcgaaaccgggtttattgaagaatgtgagccattacctattgaagaaaggtatttggtaggaagtaaggttcattatttaccacatcacccagtggtaaaggaaacgagtgaacatactaaggttcgaattgtgtataatgcgtccgctagatgcagaggaggtctcaccctcaaccaagtgttagaaaagggagataatgattataatgatttagcaggcattttaattcgaagtcgaattaaaccaattctcttgacatgtgacatagccaaggcatttcaccagattttgatacatcctaaggataggaatgcaatgcgatttctgtgggtcagagacccatatgtagaagattctcccctcatggagtatcggtttacgagagtcacgtttggagtcatttgttcgccagctcatctctctttgacaatcaaacttcatttgtccaaatacaaggacaaaaaagtaagagaaatagagagagacatttatgtggacaacataatacttggtttagaaagggctgaagaaattcagtcatattactctcttctcaaagagattttttctaaggcaggtatgaatgtgagagaatttgtgtccaactgtaccaaggaaatagagaaattaccaagtgaagaccaagtggtaaaaggaggagtcaaattgttaggaataaaatgggatatcaacaatgacactctggtcatacattttcccgtgtttaagtctgagaagttgacaagaaggaaggtcttagcacaaattgctaaaccttttaatccgaacggatttgcggccccagcaattttgccagcaaaattatttcggcaaagggtagaaacgaataaaaagctcaaatgggacacctcgttgtctaatgaagagctaaatgaatggataacactgatgaaagactgggaaaatcagtcaataacagtaccaaggaatatcattccgaaagaaatgattaaaaattgtaagtgtgaattgcatgcgttctcagacgcatcacataaggccatgggaacggcaatatatttgagagtcattaatcaaaatcaaataaaggccaatctcatatttggtaaaagccttgttgttccagcaataattccatcaaagtatcggaccattccgattttgtaa

SEQ ID NO: 68448 - DNA, 197 bp, Heterodera glycines
  Genomic contig location: Contig_ID=SeqID_40012; Location=627..823; Strand=+
  SCN-specific regions: Sequence locations=1-197
gtgttggcaattacgactgtgtaccaaatggcaccgcgaacagcacacttgttgctgtttacatggaaccgttgttccacattcggctgtacaacatggccatgttcgcttggatgtgtgccgcaaccgcttcgtttgcctttttgtattggaatgggcggaggaaggcaaaaaggacgacaacagcgggggcaaag

SEQ ID NO: 68449 - DNA, 403 bp, Heterodera glycines
  Genomic contig location: Contig_ID=SeqID_40013; Location=645..1047; Strand=+
  SCN-specific regions: Sequence locations=1-184,206-403
aaaatgattcaataaaaatcgtaattacgctcaaaaagcttctcaaacaattttagcgcttccaattccttctacaatcgcctttatacatcctattatgaacgctaaaattatcagagtgccgaaaatcgcatgtgatctaagcagcctagaaaaaaatggtttaagtaaaaatcgtaattacgctcaaaaaggttctcaaacaattttagcgcttccaattccttctacaatcgcctttatacatcccattatgaacgctaaaattatcagagtgccgaaaatcgcatgtgatctaagcctagaaaaaatggttcaagtaaaaattgtaattacgctcaaaaagcttctcaaacaattttagcgcttccaattccttctacaatcgcctttattcatccca

SEQ ID NO: 68450 - DNA, 889 bp, Heterodera glycines
  misc_feature (823)..(823): n is a, c, g, or t
  Genomic contig location: Contig_ID=SeqID_40014; Location=1..889; Strand=-
  SCN-specific regions: Sequence locations=1-574,596-664,686-889
  Gene Ontology: Mol. function=GTPase activity; Biological process=G -protein coupled receptor protein signaling pathway
aattgccatggaaggagtatttatttgttgggtaatatatttttccacttgagattttttggaaccaatgtatttggtcagtattgtgacacctgcctaatatttctcgaacattgaaagactttgccaaaatgcccgcggggaagtgcttgagacgacttacatagacgaaaagcgaatgattctgaggtggcggttgccgttggtggaaattatcgtcgatttttttgacaaactcaaacttacaactagcggatttgcttcgtttgatcaaaaggatgacggtcagtttataccacaaaaaagtcgaagaatcgtgtaaacttgaagggagcaaagcgaatgattattattaaatttggcggaagggtcacccctcaaaaaaaaagcatacgtgcgccagggatatttaatagggatggattttaagtaaattttgttagaaaaaaatttgaaatttttcctcgtttccctttggcctgcgccccactcccccacctcttttacagccgcaccccttacgacggaagagtgtgggtgcgttacgacgaagcgggggggggggcgacgcgtcccttgcccatgtgtgcccaaattacacatttaaaatttaaacattttaatgcgagaccgcttttcagggtacagagattgtcggttagagaaaatttgcatttttgttaacgataaaccgattgacgaactttcggcactttgtcccggagtgaatgcaaaggcaaaagccgcggaaatagtgaagaaattggcggatgaaatcccacaacaccaattcgaagttatggtcaaagcgtaagtggcacgncttctaaagcggtggcacaacgaaccgtgagacgatgaaaaaggattttaccggagtgcttaaggg

SEQ ID NO: 68451 - DNA, 617 bp, Heterodera glycines
  Genomic contig location: Contig_ID=SeqID_40015; Location=51..667; Strand=-
  SCN-specific regions: Sequence locations=1-617
atggaatctttttgctgtgtttgtaaagcaatttatggaggaagccacaactgttctgtctgtaaattgccgtgtcacacattctgtggcgattctggtggagttgagaatgaaggcttcggcggaatggtcgtatgccacaactgcgtaaacgaaggaaatgcaccgatagcagaaggctcagaaaatgatgactacgaaccgcaaaacgaagagaatgaaggcacgcaggcaaaagacaagaagcgccacaggaataacgatgcgacgaaaaaactggatgcagtcgagtgggcgcaagagaactctatacattcagcagcaagaaagttcaaagtggacaggaaacagatcaagaactggatggcacatgaaaacaaactgagaaatcaaatgtacgtgacattttaatattttttgtgaccaaaaattttagcatgacaccgaatggggggaagcgcatgagacttggtggagccggtcgcccagttcaacgcccggacatcgacattgcaatggccgaatggatcactgaaaaacgaaaaaataaactgcctgtgtcaaggaacatcattcgacgaatggcgacgtcactattcatagacactgacattaag

SEQ ID NO: 68452 - DNA, 805 bp, Heterodera glycines
  Genomic contig location: Contig_ID=SeqID_40016; Location=331..1135; Strand=-
  SCN-specific regions: Sequence locations=1-2,28-37,59-203,251-369,391- 711,733-805
atgaaaaatttaaaaacaaaattgaaagtcagtcccatgcttaacaaacaaacaaatgctttcaaaggcccttccaaagtgagaagccccgtggaagtcgccgacgtcgaaattgggcctttcaaagcaatgctaagatacatttatttggatgatttaaatggattaaacgatgacactctgtttgaagtgcttttcgtaggtaaattttaaaatatttaagctttaaaattttacaaatataaattaagcgaaaaaatataaagtcaatgggctgatcaaagcttgtgccgactttcccatttggaaacttcgcaatgttttcatcgcatattctaaggccaattcccttggggagaaggtgacaatcataattacttatttatcaaatcaaatattcatggccactttcgaatgtcaaaatgatattttggtaattcggctgaagttttgtgaacgccccggaaaatgccacaaatgatatatcagttgttacatcacgaagagttaagcacgaaaaaatggtctccaattgcggaatgggtttaaatgttcagtttaaaaaaaagttcgagccaaaaaagttggaaaatctggtttttttgatgaattcttctggccataacttttttgaaccttaacgaaatttttcaaaattttgcaggctaatagaggatacatagggctatcgaatgataccaacaatgttggatttggttggcaaagaaaaaagttatagcaaaaacttgtgctcgtacgaaaacggccccgaccccatttttcatgcttaactctttgaaataaa

SEQ ID NO: 68453 - DNA, 205 bp, Heterodera glycines
  Genomic contig location: Contig_ID=SeqID_40019; Location=801..1005; Strand=+
  SCN-specific regions: Sequence locations=1-21,43-205
atgttgacgtccaatttaaaaattttggtaatttccttttttattgctttcattttgaccacgactcaatcacttggacaaaacgatggggatactaacgacggcgaaggcgatgaagacgacgataacccattggtgaagagggaggacaatgtcgtccttttaaatgcggacggtgaaaccgatgttttaaaacagtcgccag

SEQ ID NO: 68454 - DNA, 74 bp, Heterodera glycines
  Genomic contig location: Contig_ID=SeqID_40021; Location=378..451; Strand=+
  SCN-specific regions: Sequence locations=1-74
tccaagtggggaattgaacccaggcgaaaaattatgaaaggtagaaagtttaaccactacaccacatgtgcatg

SEQ ID NO: 68455 - DNA, 845 bp, Heterodera glycines
  Genomic contig location: Contig_ID=SeqID_1136; Location=280..1124; Strand=+
  SCN-specific regions: Sequence locations=1-558,581-845
atgccgcaaagcattgacgcgctgaaattcgccgatgagatggaccaggaggaggagcagctgatcagttcgtccgtcaacgcccttctgaagaattggcgccgtcagctgcgctcgggccaacagaacactttcattccgttgcttccgttcggcgtttgatgagaaggaaaaaaccaatttaaaacaatgatttttgatttttcaaatatttcatttattcagtgcattttttcaaaaattttacaaagattttaatgcccacaggacagccaaaatcagtgttaattgttccgacagaaggggtacgctattaaaaaacaccaaaaagagccatttccaccagtccatgattttttggggcggcatttgtgccatcggtaagattcccctggtgttaatcaaaaaaaacaccaagataaactcggcagtcgatcagaacaccatcctaagggacgtagtgtatcctggggcataagggcactttagaaaaaaataattcgtccttcaacaggattggacaccggcgcacgagccgaaaacatcaattcagctgagtgaaatctgtttcatggattttgggggccagacatttggccctcaatttgcaaatttgaatccacttgacatttccttttggtcgtttatggaccagagtctgaacaagcgattgcaccaaattaggcgctgaaggaggcttttcaccgtacctgggacgaaattgccgaaaaaataggtgcggacattttggttaattttcggaagcgtttggacgcatgtatctcagcccatagtggctactttggacttttgatgtaattttctaataactaagaccctattaa

SEQ ID NO: 68456 - DNA, 825 bp, Heterodera glycines
  Genomic contig location: Contig_ID=SeqID_1136; Location=2494..3318; Strand=-
  SCN-specific regions: Sequence locations=1-307,330-566,602-709,745-825
atgaaagatgaagaggaatatcaaaacaatcgtgttcggcctttcgaaattgatcagacaaggggcattgccgatcgaccacgtcttaaaaaatacatcgaaaatgactcagctattaggcaattggtaattgcttatgacgcgaaagaagaaaaaaatgacgatgatttgatccgacatattcatgcattgcaataccgtgtggggatgaagggattcgaaggatgggattagaatattgttgaaaatattaattttgttgcgttgttaaaaattagtatatgtttgtttcgcttatatcaaaataggggggggggggggggcggcgcaaatgtcggcggcgcaagtgtcattttggctgggcggcgcaagtgtctgcggcgcaaatgtcacatcaccgtgccgccattggcagcgattggaatttatttgtacggcgcactgcccgaaaccaaaaacagaacaatggcggagattgagcacaaaatagcagaaatgatgaaagaaaaaagcaaacacagagaagagaaaagagactggaaaacgaatttttattgttcaaaatgttttttttatttacatttaaaaatagtaaaattaacaaaacaatcaaaatgaaatgacaagagttaaaaaaggataaattcaatccataaattaattggaaagaacagacaaaacaaaaatgagagaagaatttgtcttaaagtatttaaaaaaataatttcatttttaagtaaataagaaccagtttagacggaaaagatgtcaaaaggaatacaatcaaaaggaataatttaagcaaaaaaaaaagaaaaaaataaa

SEQ ID NO: 68457 - DNA, 234 bp, Heterodera glycines; identical to SEQ ID NO: 64376
  Genomic contig location: Contig_ID=SeqID_1137; Location=1224..1457; Strand=-
  SCN-specific regions: Sequence locations=1-234

SEQ ID NO: 68458 - DNA, 769 bp, Heterodera glycines
  Genomic contig location: Contig_ID=SeqID_1137; Location=1..769; Strand=+
  SCN-specific regions: Sequence locations=1-137,179-510,540-566,588-769
  Gene Ontology: Mol. function=zinc ion binding; Cellular component =nucleus; Biological process=regulation of protein activity, epigenetic
tctcgttgctcaacttttggagcccgaacagttcgccaattccgaggttttcttcaccaatttggccaatgccaaacggaggagcaagtgcaaaagttgcaggagatactcaaaccgatgatgctccgacggttgaaggaggacgtggagaaggaactgcagcccaaggaggaaacaatcattgaggcatgtgccagcggtgccaatgccaatgtagttacaaccgcattccggcacttttcgctttagacgggatcaggatcccatgggagtttctcgggatccttcccgatcctttttttccttctacggcattaatcgggaccggatttcatcgggatccctctcgatctttttcaaaaactatgtatatataccggcattctggcatttttaggctatgttaggggtgtatccatccgaattaaggcacgttgttggtgtgccaagggtatatccacctgaattaaggcactttttgggtgtgtcaagggtgtacccacccacatttcgacagtttttaaaaaatttttggcaaaatgcgcaacttcggtaccacatttgatgtgtgggtgccacaaagacaatggcactactctgcaattttttgtgatgaaatcccctctaattttaaggtccaactctccaacatccagaaaaaatattaccgcgcagttttggagcgcaatttcacccatctgatgaagggctcaaccccgtcactgatcagcctgaacaacacgatgatgcaactgcgtaaatgctgcaa

SEQ ID NO: 68459 - DNA, 788 bp, Heterodera glycines
  Genomic contig location: Contig_ID=SeqID_1137; Location=2049..2836; Strand=+
  SCN-specific regions: Sequence locations=1-246,270-352,400-462,509 -738,782-788
atggcagcggcgcaaatgtcggcggcgcaagtgtcattttggctgggcggcgcaagtgtctgcggcgcaactgtcgcggcgcaaatgtctgcggcgcaaatgtcggccaatcggcggcacaaaaaacagtgcgtaagccttcggagcaatcaatggatttaattaatgacttttaatgtctatcgaaaagagctctacaaagaatcccggcaaatctttgcgatttcacaaagcggaggaatggagcacaacaaccaaaaccaaaggggaaataaacgccacaggcgtttctggctcccaaaattccactaacattgctaaatttgacccaaaatcaacaacatgtccactaaaattactatttatttaaaaagtaaattgaaagaagcttatggagattttggtgccgaggtgatagccgacgaaaattttaaagaccacgattatgacaaatagaaaatgtttatttataaaataaatatttttcatgaatatatttaatatttttgatgtatatgtagctattatttcatgaaaaaaattatttgagaaaaaatgaaaattttttgaattttttcaggacccgttactcggactcggtttaaaaacttggacccggacccggcttttctggacccggcaataccccggacccaatttttgcccaaatacccggacccggccaaccctagttaagattggatcttacaaaatataatcacattatacaaaatagtgaatttttttaaattattttttaatttatatttaaaaatttaatcgtatta

SEQ ID NO: 68460 - DNA, 4143 bp, Heterodera glycines
  Genomic contig location: Contig_ID=SeqID_1138; Location=362..4504; Strand=-
  SCN-specific regions: Sequence locations=1-114,136-280,303-729,755 -982,1004-1716,1738-2023,2045-3345,3367-3704,3726-4143
atggacaaaacgctcgccgaaattttggaaaaattgacgcaagcgatcaagcagcagagcgcgtcgacatccaccgcaactcagccggcacaaaacatcactttgccggacattcacccattttcaacagataatgccgaagaatttgaggagtggttggagcgcttccaatttgcatttgattgcgcggtggcaaatatggcggacgaagccaaactcaaattgctgatgactaagctcaacccgtccgccttcggcgaatacaagcgctactgcctgccggaggaaatcaccaaatttgactttacggacaccaaaactcgtctgatcaaattattttctcatcctccttcgttagcaatcgatcgctacaaatgcctgcgagtgtgcagagaggacggcgaacaatttgaaatttttgtgaaccgaattaaggcagccctccgcaaattccgtttttcggaattaaacgaagaggaattcaaatgcctggttcttcttacgtcgcttaagtcaccaagcgacgcaaaattacgccaacatatcctcgcgcgtctcacagcagagggcacaaagacgacaaaaacgtccaaattattcgacaaagtcatcgaggacttaaatacacagctaaaaacggaggcggaagcaaaaattttggagcagccaaagcccaaaataaacgcaattcagcatggcaaatcatcgccaaataagcaccaaaatcgcggaaacggtcgcccaaatcaaaaattcacgggcaaatcaaaggccaaaataccgccgagcaactgctatcgttgcggagaattgcattgggcacaggattgcccaaagaaggaaaatatatgcagcaaatgcaatcgcagaggccacatcaatcggcaatgcgacaaaattcgagcatttcaccaaaataagggcagaaatttcaacacaaatacggtgatgctccccgcggcttacatcaattccgtccattcatcaaatctgcttaaagcaccgatcaatgtgaacggcacaacaattggtttcatcctggacagcggtgcggaaatcatcatcatcaatgaagatgattacaacgcaatgggccgaccaccaattcaaatatgttcagaggaagcacgctttttcgacggaaagcggtgcaaattcatcggacgcgggaccgccaccttccaattcaacggaattcagacaattcagccgttttatgttgccaaatcgggatcattgaatcttttgggcacaccggcaatggaagcgtttggatttctggaagaaatacggcgaatgatcaatcccgcccaaatcaatcaaatttcgtcaaatgatgcggacaaaatccaacaattcgtcgaaatattgccgcaaaaatatgagcaaatattctcagatggccttggctactgctccaaaatgaaagccaatctggtgctcaaggaaggcgcaaatccaacgttcaagcgcgcccgtccagtgccatattctacgctgccaataatcaatgcagaattggatcggttggagaaaatgaacgtcgtcacaccagtcgaacacactaactggtcagccccaattttggtggtcaagaaagcgaacggaactgctcgtctgtgcgctgatttctccaccgggctcaacgactctctccaattaaaccagcatcctctgccattgccagccgacattttcgccacactgaatggcggaaaattcttcacaaaattggatttgtcggatgcatatctgcaaatcgaactggacggcacttcaaagaaattgtgtacaattgctacacaccggggacactaccaatatgagcggctgccatttggagtgaaatccgcccccgggatttttcaatcggtgatggacaatatgttctccgatttcccattcgcattggcttatttggacgacgtcatcatcgtcagcgcgacatttgatcaacactgccaacatttgaaccaaattttcacccgaatttcagaatgggggttcaaagtccgaatggacaaatgttcatttttcaaaaatgaaatcaaatatttgggcgtgatcattgatcaaagtggacgtcggccggacccaagcaaaatcacagcaattgcggaaatgcgcatcccttcgaatgtcagcgaattgcgatcatatttgggcatggtcaattattaccaggaatttgtgcgaaatttccggtttattcgacagccccttgacgaactgctgaagaaggatgccaaatgggattggtcacccaaatgtcaaaatgcgttcaccaaaattatttcaatgctacaatctgagctggcattgacgcattttgatccaaatctgccgatcatcgtcgcagccgacgcttcacaacatggcatcggcggcgtcatatcacacaaatttgccaatggctcaataaaagccgtgtcgcatttctcacgatcactcacaccggctgagcaaaattacgggcaaatagaaaaagaagccctggcattggtggaagccgtcaaacgctttcataaaatgatcttcggcaggaaattcacattgctgacggatcaccagccactcaagaaaatttttggcaataaagatggtgtcccaaagcactcccacaaccgtctcgtccgttggtcactcattttgacggcttacgactttgaaatacaatacgtcaaaacagacaaatttggacaggcagatgcattatctcgcctaatttccgtccaaaagtcaaaatccgacgacgacgaagtcattattgcctcattcgaagtggaatcggcattggacagaaatttgatcaacaatgtcaaccaattgccgatcaccttcaaaaatttggcccaagaaacggcaaatgatcaggcacttcaacaaattcgtcaatttgtcaaaaatatttggccagaacctaaaaattttcagccaattgaagggctggacgaagccaaattcattcaattttatcggcgccgcgacgaaatttcaatcgtcaaggactgcctgatgttcggcgaccggacagtcatccccaaatcactgcagaagcaaattctcaagatgcttcatcaaggacatccgggagtcaagcgaatgaaatctttggcccgaatgcatgtctactggccaatgatggacgcagaaatcgaaacgttcgtccaaaaatgcacttcatgcgcagctgtcgccaaaaatccaatcaagacgacactgcagtcatggccaaaatctgatggcccatggaagcgcattcacatcgattacgccggaccatttcatggaaaaatgtatttgatcgtcgtagactcattttcaaaatatccggagatttttgaaatgaattctacaaatgccatggccacaatttcaaaaatgcgctcattgatcgcgcactacggcatcccggaaacaattgtttccgacaacggcactcaattccaaagccaccaattccaaaatttcgttaaatcgaacggaattgaacacatttttacagcgccgtacatgccacagtcaaatggtcaagctgagcggatggtcgacacttttaagagggcattcgcgaaaataaaaggggagggagttgacggtaatgtgctcgacacttttctactcacctatcgcaccacgccatcagaaactctggatggaaaatgcccggccgaattatttcttggccgaaagcctcgaataggcctcgacctcctccggcctccgctgtcaattccaattgtcaaggacaataaaatggaggaccaattcaatcgcaaacacggcgcaaaattccgatcatttgaaatcggacaattggttttcacacgtcggcacaattcagcggaatggcgacacggcaaaatcatcgacaaaaagggtgtaatttacaccgtcgaattgccaaacaattctcgcggccgatttcatgccaaccaaatccgcgcacgtcaaattccggatgaggacatcgaagacccgctcgatgtgatcaatggcacttttggcctcccaattccattaagggaccaaaatttggcagaagtcccgccagccaatcaatcaccgccagtccgccgttatccgattcgaaatcgccggcctgttgaccgccttcaaatcgaccccagccgatcgtcctat

SEQ ID NO: 68461 - DNA, 642 bp, Heterodera glycines
  Genomic contig location: Contig_ID=SeqID_1138; Location=5000..5641; Strand=-
  SCN-specific regions: Sequence locations=1-390,413-642
cgccgtatgccacagtcaaatggtcaagccgagcggatggtcgacacttttaagagggcattcgcgaaaataaaaggggagggagtcgatggcaatgtgctcgacacttttctactcacctatcgcaccacgccatcagaaactcttgacggaaaatgcccggccgaattatttcttggccgaaagcctcgaattggcctcgaccttctccggcctccgccgtcaattccaatcataaaggacggtaaaatggaggaccaattcaacaggaaacacggcgccaaattccgatcatttgacattagacaattggtcttcacacgccggcacaatacagcggattggcgacccggcaaaatcatcgacaaaaagggtgtaatttacaccgtcgaattgccgaacagttctcgcggtcgatttcatgtaaatcagatccgcgcacgtcaaattcctgacgaggacatcgaagatccgattgacgtgatcaatggcacttttggccttcctattccattaagggaaaataatttggaagaaatcccaccagccaatgatccaccgccagcccgccgatatccgacacgaaatcgccggcccgttgatcgccttcaaatcgacccaagccgatcgtcctatgtgtga

SEQ ID NO: 68462 - DNA, 906 bp, Heterodera glycines
  Genomic contig location: Contig_ID=SeqID_8541; Location=261..1166; Strand=-
  SCN-specific regions: Sequence locations=1-81,109-276,440-588,857-906
  Gene Ontology: Biological process=protein biosynthesis
atggctaatgctgattcgccgatactaatttctgatgaggacctaagcgacgacgagactcatttgagaaaattattattgtcggaaaaacaacaacaacaactacgtgaacaacaatttaaccccgatcggccctactcatcgactgtgcattctttgccaatcaaccatgtccaaattatgaccccagcgcaagcagaaaaattaaaaagggaacagcagctagcactaattaatcagaagataaaggagatggaagccgcaaaaaagcaaattgaagaagaagagagtgctgaggaagaaggacgaattttaaaagaaaaggcatggaaagcggaagagcagagaaagagggcaaagagggaattggatgaaaaggtgaagaaaagggaagaagaaaagaaagcagaagaaaaggcaaaaaaagacaaggaggaggtcaaagcggcatttaagaaaattggaatgagtaccgaagtggggggaaaagaagatgaaaacaaaccaaaaaagaaaaaatcgaagaacaacaaaggaaaggacacggaaaatggaaatttggaggccgaaaaactcaatgagggacatagagaagcgaagaaagatgcagaagaaaaggcgaatagaaaagcagaagcgaagaaagatacagaaaaaaaggcgagaagagaagcagaagcgaagaaagatgcggaagaaaaggctaacagagaagcagaggagaagagagacgctgaagaaagggcgaatagagaagcagaagcgaagaaagatgcggaagaaaaggctaacagagaagcagaggagaagagagacgctgaagaaagggcgaagagagaggaagagggaaaggaagcggcagtagaaacaaaagagacgcagaaagcacggcaaaatacacagtga

SEQ ID NO: 68463 - DNA, 1188 bp, Heterodera glycines
  Genomic contig location: Contig_ID=SeqID_8541; Location=1235..2422; Strand=-
  SCN-specific regions: Sequence locations=1-534,557-635,657-775,799 -871,893-1188
atgagctcaacattcaaatcgttggcaaaaacttggggattcgaacatcaaaccacagtgccctaccatcaatcggccaacggacaagtggaacgatataaccgtaccattgtggacatgcttgtcacaagcacggaaggaaaaaattgggcggcagcgttaccattaatttgcttcgcttacaattcttcaattaactaccaaatcggcaattctcctttttacgtaatgcatggtttcgaccctagactcccaagtgaagtgacactcggaaaagtggaagatcatttttcggatatggcagtgtatgtgcaggagttgacaaaacgaatggaagaggttaagacaacagtaaaagaaaatctgaggaaatgtgccgatcaaatgataaaacaacaaaaatggacaaaagagatcccatggatggaaggaatgctggtactgaagcggagaattgacaaaagaaataaactagaacaaaattacgatggcccttttcgaataattactgtagaaaagccaaatttgacactcaaagagatgcatgcagatgctatggggtttacggtacacatggaccagtgcaaaccgtatttttcaaaagaggaacaaattctggtaccaaacgaagagccgaattcgggatccaagagaaaaatcggggacaaaaacttggaagatacagacgaagaagaagagaccgaaataaatacaataagcatggaaatgcttaccgaatttgatgatggaaataatttgaacaagcacggattattattttggatggaaataattttggatggtattgtcatcaccgccctatatccgaaagactcttttgaattttcatcaatcccgaaatctatggttcaatcccagtgggaaatacacaagaccaaagaaggagatgaatatttaaccgcttggatttttgacgaaaatattcagctttttataactggggaaagggaagacttaattattgggaacggaattcaagcgtggttaaatcaaaacgggaatgtaatttgcgaaaatggagaagcaacctactgggagacttatttggacatggacggactcatttataaaaacaaaatcaccccagaattttggataacctataatgagcccgaaatgtgtaaagaatatgaatctcgccatgctcctcttcaacgatttttttga

SEQ ID NO: 68464 - DNA, 570 bp, Heterodera glycines
  Genomic contig location: Contig_ID=SeqID_8541; Location=3150..3719; Strand=+
  SCN-specific regions: Sequence locations=1-570
atggctccattggcgacaacccaggcggcggcaccattcgtcgctccgacccattctgcagccccgcccaatcagaaccagccagtgggagcggctccggatggcgtgagtcgccggctgttgggctctatcaatcgctcgttgatggacctcctgcaagcggcccacgtccagagaacagttttggaacgtttgttgatggtcgtagaggcccaacgatttggccagcaatttggtactgtgcgtggcggggacggtaggcgcggtaatcggcgttatcgccgtagtggaaatgcgggaggcggaaatgcgggaaattcgagggcaaatgggggggcccgtcccactcgttttcaggaaacaagaacggccgtaggcccagtgggagtggtcgaacagccggtgcttggacaatctgctggtcaaaatgttgcttcaacttcggaagaaatgccatccgacacttcatcgacttcggctgtcggggtttgagggttgaccgtcctcccgctcctgctgcgggggcgggaggctgtctacgccatattttttgattatttaaaaaacaaa

SEQ ID NO: 68465 - DNA, 451 bp, Heterodera glycines
  Genomic contig location: Contig_ID=SeqID_40022; Location=1116..1566; Strand=+
  SCN-specific regions: Sequence locations=1-451
atgagtgctcctttccgagaacaaattcgccaagcctacgaagaggcacaagacattttgctggaccaaaaggattttcctctccccgctcgccaacccgaacacacggtaaccctttaccacgccgaactgcgttccatcctttccgaattggacacagaattgaaaaattccgaagaaattctcaaagaggtaaatgaaccgtacgaaaaatggatgtccctccgcacaagtatgaccggtaatgaacgaacccaagatggccccctctacgatgaatttgtcctaactgtcccatttctgagtgccatcacaaatctccgtaaatacatccgttcccttcggtcccaaagggcaaaaatcgaacaaagcataaccactgaccctggctcaaacaaaacattcccatccttggtacacctccccaaaaccaccctccctactttctctg

SEQ ID NO: 68466 - DNA, 945 bp, Heterodera glycines; identical to SEQ ID NO: 40024
  Genomic contig location: Contig_ID=SeqID_40024; Location=1..945; Strand=+
  SCN-specific regions: Sequence locations=1-126,151-759,785-945
  Gene Ontology: Mol. function=protein binding; Cellular component =autophagic vacuole; Biological process=oviposition

SEQ ID NO: 68467 - DNA, 796 bp, Heterodera glycines
  Genomic contig location: Contig_ID=SeqID_40025; Location=1..796; Strand=-
  SCN-specific regions: Sequence locations=1-509,531-662,689-770,792-796
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttg

SEQ ID NO: 68468 - DNA, 330 bp, Heterodera glycines
  Genomic contig location: Contig_ID=SeqID_40026; Location=1..330; Strand=-
  SCN-specific regions: Sequence locations=1-183,205-330
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaatttttggtgcactttagagcactttctgaaaaaaatatttatgaaacaaaaaaatcgattttttcaagt

SEQ ID NO: 68469 - DNA, 1290 bp, Heterodera glycines; identical to SEQ ID NO: 40026
  Genomic contig location: Contig_ID=SeqID_40026; Location=1..1290; Strand=+
  SCN-specific regions: Sequence locations=1-126,148-392,415-475,717 -763,789-823,849-851,880-1042,1068-1290

SEQ ID NO: 68470 - DNA, 225 bp, Heterodera glycines; identical to SEQ ID NO: 59154
  Genomic contig location: Contig_ID=SeqID_40029; Location=18..242; Strand=-
  SCN-specific regions: Sequence locations=1-225

SEQ ID NO: 68471 - DNA, 941 bp, Heterodera glycines
  Genomic contig location: Contig_ID=SeqID_40030; Location=37..977; Strand=+
  SCN-specific regions: Sequence locations=1-189,221-284,306-941
  Gene Ontology: Mol. function=hedgehog receptor activity; Cellular component=integral to plasma membrane; Biological process=regulation of mitotic cell cycle
gaggcggtcgattggacgaggaaatgaattttttacccaatgccaaattaaactatcatcggagagagaaacgggccgtttcaccgattgtcgcgcaaaataatcggacggagacaaaagcggcaaatgttgccgaattgccgacagaaaacacatttggtggcggttttcaagtggttttcccttttcacatcacatttctcattcacttctcttcaggttgtcattcaaactccggaggttcccggagaaaacattctgacgcgggaaggactgcaaaggcacgtcgccattttggaagaaatctccaaattcagcgtggaaatgttcggcgagtacgatttacacatttaacccaaaacaaataattttccattgaatttgtcttctttttagaaaatggcatttgtccgacatttgctttaaaccgcccccgccagcctctgccaaagacgaattggcccagtttatgggcgacatcatgtctcagattattccctgcgtttggatcactcccatcgattgcttttgggagggctccaaaccgcttggtccattcccagaatacgacctgtaagacattcataaaatcggattactattatgatttagaggtccttttgcccaatttgtccctttcgtgccaaatggaaaactttcatggaaaacgttgaacccggaagctctgttaaacacgacgcgttcttttgttgatgttggaatggttggcgaactgttcgaacgtgtgggtgctttggtttactcgttttgctagcataaaacaaataatttaggccggcattggcgaggcgtaccaagacaggccctgcatcgacccgttggacccggactgtccgtcgacagcacccaatcacttcgaccgttgtgcggcatatgaacatttttcaaaatggaactctgaactaccaccggaccgtcgt

SEQ ID NO: 68472 - DNA, 321 bp, Heterodera glycines
  Genomic contig location: Contig_ID=SeqID_40031; Location=179..499; Strand=-
  SCN-specific regions: Sequence locations=1-321
atgccatcagataaatatgagcgaaagcggaagaaggaattggatttcgacacaacacaagagctgaagaaaaagcgcgacgacgacgatgaatttggaaatcaaacgcatcgacggcatcgctcgcgcagccccaaaaagtacggaaatgggttcgacctaaaaggcttgaaaaaccgcataattttcttaaggtcgtccaggcataaaaagcatcgcgacacatcgccgggggacgacggcgaaagagcgggagaggccgggtttgacaccacaattctgaaaggttggcatttggcaaaacaaaatgcatttgtttag

SEQ ID NO: 68473 - DNA, 588 bp, Heterodera glycines
  Genomic contig location: Contig_ID=SeqID_40031; Location=646..1233; Strand=-
  SCN-specific regions: Sequence locations=1-522,544-588
ccagaagtcatttttttgccagtacatttccctggacattggactctaattatccatgatgttcagtgcggtacacatattctcgattctttgcctactccttatggcaggttggattggcaactgacggaaaaaattggaaagatcatttctgacattttgccgtcaacagtgttgaccgggatttttaatgccgtaaatcttacggtacaacacgatggtaacagctgcgggtacttcgtgtgcctatatgctgaatcatggctcatgaacaatcgcacgtttgttctgccagatttgtccatcaattatgaaaagcggcgcatattgtggcacattaacgagctgtataactctgataatgttccatatcatccaagggaaggggtacctactccgtgcccaattgtctatcgacatgcggatgaggctccatcgacatccaaggccgctgagccagttgaagtagatgatcatgatgatataatgatcatcgaaccacaaacgagtggacaagcagttgttgccattccaacacaagctcaagtggcaggtgaaaaccaagaggacacgcgtggattggagtag

SEQ ID NO: 68474 - DNA, 182 bp, Heterodera glycines
  Genomic contig location: Contig_ID=SeqID_8544; Location=1616..1797; Strand=+
  SCN-specific regions: Sequence locations=1-182
aaacgggcgcgaagcgcccgtcatgaggccgccaagcggccaaatgttctcaaaaaattaaaagacgggcgcgaagcgccagttattaggccgcgaagcggccgaatgtccccaaaaaaattaaaaacgggcgcaaagcgcccgtcatgaggccgcgaagcggccgaatgttctcaaaaaat

SEQ ID NO: 68475 - DNA, 1597 bp, Heterodera glycines
  Genomic contig location: Contig_ID=SeqID_8544; Location=1..1597; Strand=-
  SCN-specific regions: Sequence locations=1-196,219-1597
  Gene Ontology: Mol. function=microtubule binding; Cellular component =cell cortex; Biological process=cellularization
aagaggttcaacagtgattagaagaggtacaaaagtgattagaagaggtacaacaatgattagaagaggtacaacagtgattagaagaggtacaacaatgattagaagaaatagaacagtgattagaagaggtacaacagtgattagaagaggtacaacagtgatatgaagaggtacaacagtgattagaagaggttttggaatttttaaaaaattatcagcgatttttaggccgcttcgcggcctcagacgggcgcttcgcacccgttttttaaattcggtgatttttaggctgcttcgcggcctcagacgggcgcttcgcgcccgtttctaatttttgttgtgcttttcggccacttcgcggccgttttttaaattgtgttgagtcggacgggcgcctcgcgcccgttattaaattttgatggactcagacgggcgcttcgcgcccgtttctaatttttgttgtgcttttcggccgcttcgcggccgttttttaaattgtgttgagtcggacgggcgcttcgcgcccgttattaaattttgatggactcagacgggcgattcgcaccctttttgtggccttttttaggccgatttgcggcctcgaacggccgcttcgcgccgttttttaaattttataacagatacaaaagtgattagaagaggtgcaacaatgattagaagaaatagaacagtgattggaagaggtgcaaagtgattagaagaggtacaacggtaattagaagaggtacaacagtgattggaagaggtgcaacagtgattaaaagagttacaacagtgattagaagaggtacaacagtgattagaagaggtacaacagtgatatgaagaggtacaacagagattagaagaggtacaacagtgattagaagaggtacaaaagtgattagaagaggtacaacaatgattagaagaaatagaacagtgattaaaagaggtacaaaagtgattagaagaggtacaacaatgattagaagaggtacaacagtgattagaagaggtacaacaatgattagaagaaatagaacagtgattagaagaggtacaacagtgattagaagaggtacaacagtgatatgaagaggtacaacagagattagaagaggtacaacagtgattagaagaggtacaaaagtgattagaagaggtacaacaatgattagaagaggtacaacagtgattagaagaggtacaacaatgattagaagaaatagaacagtgattagaagaggtacaacagtgattagaagaggtacaacagtgatatgaagaggtacaacagtgattaggagaggtacaacagttattagaagaggtgcaacagtgattagaagagttacaacaatgattagaataggtacaacggtgattataataggtacaacggtaattagaagaggtacaacagtgattggaagaggtgcaacagtgattaaaagagttacaacagtgattagaagaggtacaacagtgattagaagaggtacaacagtgatatgaagaggtacaacaatgattagaagaaatagaacagtgattagaagaggtacaacagtgattagaagaggtacaacag

SEQ ID NO: 68476 - DNA, 707 bp, Heterodera glycines
  misc_feature (97)..(97): n is a, c, g, or t
  misc_feature (159)..(159): n is a, c, g, or t
  Genomic contig location: Contig_ID=SeqID_8544; Location=1791..2497; Strand=-
  SCN-specific regions: Sequence locations=1-349,371-707
cctcaggacgggcgcttcgcgcccgtttttaatatttatgggggatatttggccgcttcgcggcctcaggacgggcgcttcgcgcccgttttttaanttttacgggggatattcggccgcttcgcggcctcaggacgggcgctttgcgcccgtttttanatttgttgggaacattcggccgcttcgcggcctcaggacgggcgctttgcgcccgtttttaatttgttgagaacattctgcagcttcgcggcttcaggacgggcgcttcgcgcccgtttttttaatttttgggggacattcggccgcttcgcggcctcaggacgggcgcttcgcgcccgttttttattttgtggggccagacgggcgcttcgcgcccgtttttaaattttacggggatattcggccgcttcgcggcctcatgacgggctctttgcgcccgttttttaattttgcgggggacattcggccgcttcgcggcctcaggacgggcgctttgcgccagttttttaattttttgtggggcattcggccgcttcgcgacctcaggacgggcgcgtcgcgcccgtttttttaaatttttgggggacattcggccgcttcgcggcctcaggacgggcgcttcgcgcccgtttttttaaacttttgggggacattcggccgcttcgcggcctcaggacgggcgcttcgcgcctgtcttttaatttttt

SEQ ID NO: 68477 - DNA, 197 bp, Heterodera glycines
  Genomic contig location: Contig_ID=SeqID_40040; Location=505..701; Strand=+
  SCN-specific regions: Sequence locations=1-144,166-197
cggaattgtatcattcgggaaacgccgtgtttgagggcgcgtacaacgatggacacgttgtgctcatacctgatggtgaacaaagcaacagtggataagtgatcggcactcatctccaattgtgatcggaaaaaagcgatatctaattttgtattgtacataaataggttattcggacaataaaactgtaatgtgca

SEQ ID NO: 68478 - DNA, 270 bp, Heterodera glycines
  Genomic contig location: Contig_ID=SeqID_40041; Location=327..596; Strand=+
  SCN-specific regions: Sequence locations=1-240,266-270
cagctttcattaattatttatgcattaatgctcgaacctcgcggattacggcttgatgctgatggctttgttcataatctgcagtgaaagattttcccttaaataatgtttttttcatcttttaaattttatgttgcactgaaaaaattaatttcctttttattataagatttttacttaaacagaagaatctattttattatacctttttttgatgatgctattgcaaaccaaaatttttagtaataataataatatagtataagcaaa

SEQ ID NO: 68479 - DNA, 251 bp, Heterodera glycines
  Genomic contig location: Contig_ID=SeqID_8546; Location=564..814; Strand=-
  SCN-specific regions: Sequence locations=1-251
atgaaagggcggcgtcaattggataccgccgccgcgaagcggctgtttaaatacgccgatgagatggatggatgcgatggacaaccacccgttgatgaatcgactgccgcttgctaagtgtcctgcaccgaacggcacggtcggtcggaaatttttttttgcgtttttccgattccaattttttgttgtaattttttcaatttttccagtatttcgaagcgccgagatggtcaacgaatgaggagggatga

SEQ ID NO: 68480 - DNA, 161 bp, Heterodera glycines
  Genomic contig location: Contig_ID=SeqID_8546; Location=1201..1361; Strand=-
  SCN-specific regions: Sequence locations=1-161
ccattgcggtcaattacgtcgtcgtttgtcatcgggcatcgcgtcgcaacaccgaggtcgttgagcgggagaatgaacggacgggcgagtggctgacgctgcgttggcgtgtgaccgcggagcctgtggttgtacgccagcggagcggcacggatcggcgc

SEQ ID NO: 68481 - DNA, 1686 bp, Heterodera glycines
  Genomic contig location: Contig_ID=SeqID_8547; Location=437..2122; Strand=-
  SCN-specific regions: Sequence locations=1-418,441-702,724-1090,1112 -1155,1177-1686
atgtcggaccatccaaatgttgcgctggccgacctgtaagccgcccgaatttaaaatttcacaaaaaatcggattttaaattttttcaattttcagcagctgcgtggcaaacgacgtttggctggacactctgttttggattgaccgcgtggaggtgggcacgaagtttgcactgatcgacgcacgtttcggcaagctggtggccacgcatttcaacctgcgcaagtggaggctgggcgagctgggcgttcatcgtgcaccaagcggatgggaccggggcggcacggcggctgtcaccgttatggacgacaacgcgttgatcaatcgactgccgctcgccacgtgtcctgcaccgggcggcgtgattggcttcagtgccatctacatttggtcttagcgaacaaaatttttttgcaaatttttaaaaattccctaattttccaggtacgtcgacctggaagtgatcgcatttctgcagtgcctgcaacgtgtcatcaatcgcggcatcgctgtgcagttcaccatccattcgacggacctccgctgctgggcggtgatggcgcaacgcatttggccactcatttcgcacgccgtcctcgcactgaacgacatgaaagccgtcaacttcgcgctgttgcgtcgccatgtgtcgccgaatgtgctgttcgactgtgctaaccttcgtgccatcaccaacacgcacatgttccccatccgaccgccgcccagcgctgtgcacatcaatgccctgctcaacccgccggacgagttcgatgagaagccgaagcacaacctgttccgctggctgcacacaccgcgcaaggatggccgtccgaaaattgtgaccattcgcaagtggcgcaaaccgcaatgggcttcgttcatgccaagcttaatcacggtccgaaagattttacggcattttttgcttccatttttttcatttttctaatcgattttacgcgtcccatgccatccacagtttcttaggccataacttttttcttaattggtcaatgcttatattcttggtaccaatcaaaagcttgaactctcgggatcttataaatccaagaaaacagcaattacttgcattagaaaataaattacaatgagaaaacatgaaattcaaggtttttcgagtattttcaagaataattttttgtctattgcttttagccgagaatttagttatacaaaagcttctgtagactttaagctttcgtttgataccaagaatataggcattgaccaagtatgaaaaaagatatgcccaaagaaactgaggatgatagtcattcatgggacgcgtaaaaccgtatatttgcattttttgattccatttttttttgaatttcaatcattttacagtttttcaacgcgagtgccgtccctgtcaacttcctcgtcatttgtcacattgcatgcaataccaacttccagaagatggaacgggagaatgaagagacggacgagcggctgacgccgaatgcgcgagtccctgcacatgccgtgattgtacgccagcggaacggcactgatcagcgcacagtggcgaagtggaagtgggaggcaaatcgaatattggacactgctatgcatcaacagttcggattttctattttcagtagccgcatggcaaacgacgtttggctggacactctgttttggattgaccgcactgag

SEQ ID NO: 68482 - DNA, 1750 bp, Heterodera glycines
  Genomic contig location: Contig_ID=SeqID_8547; Location=2464..4213; Strand=+
  SCN-specific regions: Sequence locations=1-25,47-428,450-516,538 -647,669-709,732-1006,1028-1384,1406-1750
atggccaacgcaatgtacgcggcacgggcgcgcgcggccaaggcggaaaagcgtcaagcgcagctgcgcaaggcggccagagcaagggcaggaaacgtaagtttagattaaaaaaatttaaaaccgaaaataattttccccaatttttttcccacagaccgccaaatcgcgacgagccgagcgctgttcaatttgctggggccgactgagccgaatcacgcgtaccacgatgggctgccaccatccgctgcaccgacgctgcctctacaattgggtgcgcgtcaacttgttttgtccgatgtgcggctacaactacacgcgcgggaggccccgtgatcgccatggacgacgcaccaggggactccatcgtatgacgccggatcaggtgcgacgtgaaatggaccgcatgcgtcatatcaggcgctgatggaggaggaggagaggtgggttttgttgaggtgtgggacgggggcagcagggaggacgagtgtaatttttggttctgtttcagtttggtgttttgtgggggagggagggtaataccaccgccgatggtatcccaccccccttttcgaaaaaaaaattttcaaaattttttagagcggttttcaaggtcggggaatacgattctaacatccatttgggccgtgtgttgggggagggggcggaggacgtgcaatttttggttctgtttcagtttggtgtgttgtgggggagggagaaatgaaaaattcagaatttattggactcaatttatttttaattatcatttttttgaattttcaggcccggaaacgagaagtcgtcgcaatcgcatggcaaacggcggaaggatggaaagaacggacgacggatcacacaatgaatgattgccgagtgtatttattgatgtatttgtgatggatattcactcatttgttgtctcataaccaagtcagaagaacacacgcattgtttgtatcacttaccattatatttgtactgaattgaatgcataaaattgttgagcacaaatttgattccaaattttaaggggggtcaatttttaatctcaaatcttatggtcgtgtgaactcatagagcccccggctcaagtacagtttatgcgcccaatcaaattgttactttaaattgctatttttttcaaaaatcccgaaaatattgatttcttcaatatccgattttgtcaatgataagccgtgccatcccacatattgattttaagcgcaggtcaacagaaatagagagctatccgaaacatggccactggatgaaaatttaattggacgcacaaaaatccattggacatataaactgtacttaagccctaaatttatcataaaagcatacacaaaacaaattaaaattaagttgatcaccaccacaacaaaacaacaattttataaacgtcaaatgggctcaaattcattctcaaacacagaaattcaaattgatcgatcacttctcaaggaatctcgattcgattccactgatcataaaagtcccatccaatcgcttccttttcccattttgcccatttgctttcgtcgcgcacaattggacaacggatcagaagaaaattgcgggtatctttcatttctttcaacgtcaattgttcccgagtcaattcgttggtcagatcgaagagctcaacggaattagcagaaggcggcagatgaaactcaatgacgacaatgaaattgacggaagaagaagcattggcaaatgcctaatgggggaaattggataa

SEQ ID NO: 68483 - DNA, 438 bp, Heterodera glycines
  Genomic contig location: Contig_ID=SeqID_40047; Location=3..440; Strand=+
  SCN-specific regions: Sequence locations=1-438
atgttctacggttatggcaataaaattgccaaattgttgatgtttgtcaccaattttgccattttcctcatcggcgtccgcttcttcgttgcattttcggtaaacacaaataattgcaaaattttctttattaatttggaaattagaagtaatatattgacttttcagcccaaattcggaaccaagtttcccgactttgacagtgaggcgcactttgtggatgaattggacaaggtatttaactgggcgaaaattggttaggttcttataatccattgggtgaaatttgagaacagagtttcccaaaaaattgtagccatttaaaaaaatgaaatatttgatgttttcgtttaaaattgaatttgactaccaacaaaatggttttgcatgtttaaattatacaacataattttgtcccattccgaaccctggattcga

SEQ ID NO: 68484 - DNA, 488 bp, Heterodera glycines
  Genomic contig location: Contig_ID=SeqID_40049; Location=475..962; Strand=-
  SCN-specific regions: Sequence locations=1-256,286-488
atccgtgctgtcccggcagtcaaaaagtggtttcgctgatggccaattacgttggcactttcgcccattccttttccaagtcatcgctttgtttggatgccaaaagtgttgcgggcgcattgaaaggccaactgatcggctgctcgaagggcggcgacgcaactcttttggccgacatcgaagcatctcttgccaaccattcttctggtattgatggactaatggatcaaatccattgccaaattagccaattaacttattttattttaattatttttatattttccgccttttagatgagtgtgcccacagcctcggcttcgtccgtgccatgttcgccattgccgcctccgcttcttcccatgccagcaacaacagcgaatggcaggcattgagtgcccagtttggtgggcaaatcagtgaaattgactcgaaatgtgccgagtttggcattagcattgccaaagtgtcatttgacggccccaagg

SEQ ID NO: 68485 - DNA, 471 bp, Heterodera glycines
  misc_feature (39)..(39): n is a, c, g, or t
  Genomic contig location: Contig_ID=SeqID_40051; Location=382..852; Strand=-
  SCN-specific regions: Sequence locations=1-471
atgacattctcattattaccggttcaagcaattatcatntacgaaagcgctctcaattggacaacaagcgttcatattttgcctaatgataggaggtccagtatttgtctcgtagaattgtttaaaaaatggcattctcattattaccggttcaagcaattatcatttccgaaagcgctctcaattggacaacaagcgttcatattttgcctaattgataggaggtccagtatttgtctcgtagaattgtttaaaaaatgacattcttattattaccggttcaagcaattatcatttacgaaagcgctctcaattggacaacaagcgttcatattttgcctaattgataggaggtccagtatttgtctcgtagaattgtttaaaaatggcattctcattattaccggttcaagcaattatcatttacgaaagcgctctcaattggacaacaagcgttcatattttgcctaa

SEQ ID NO: 68486 - DNA, 1365 bp, Heterodera glycines; identical to SEQ ID NO: 8548
  Genomic contig location: Contig_ID=SeqID_8548; Location=1..1365; Strand=+
  SCN-specific regions: Sequence locations=1-290,318-765,788-883,905 -914,945-1053,1075-1156,1178-1365
  Gene Ontology: Mol. function=transmembrane receptor activity; Cellular component=integral to plasma membrane; Biological process =axon guidance

SEQ ID NO: 68487 - DNA, 2527 bp, Heterodera glycines; identical to SEQ ID NO: 8549
  Genomic contig location: Contig_ID=SeqID_8549; Location=1..2527; Strand=+
  SCN-specific regions: Sequence locations=22-494,535-1047,1076 -1605,1627-2481,2503-2527
  Gene Ontology: Mol. function=semaphorin receptor activity; Biological process=axon guidance

SEQ ID NO: 68488 - DNA, 2688 bp, Heterodera glycines
  Genomic contig location: Contig_ID=SeqID_8550; Location=1495..4182; Strand=-
  SCN-specific regions: Sequence locations=1-291,319-602,624-1162,1184 -1773,1798-1816,1849-1852,1882-2158,2182-2197,2221-2328,2353 -2368,2392-2502,2526-2634,2656-2666
  Gene Ontology: Mol. function=cell adhesion molecule activity; Cellular component=plasma membrane; Biological process=neuronal cell adhesion
gtcgaaccgattggtccctgtctgaaaaatcaggatcccattgaaatacaacaaaaagcattccccactccgtcattaaggtcaattacacctttcggatgttcgcccataattcgtacggtgccagtgaacccgcgtcggctccgtccgcttccgtcccgtgcgccacccctccggacgtgcccttctcgaacccaatggaagtgcacgcccagggcactgaaccggacaatttgggtagttttaggaataattataatgctttaacacgaataaaagtgatccgatggacgcctctatcaagaaatgtttggaatgcgcatggactgaaatatttggtgcgctatcggcaaatggacgactcagcaccgacggattggcacgaattctttgtggaagatccatttgcagtaaaaagaagaaaacactgcttgaaaggggcacacatcttttttagaatcagaccacgattagggaacagcccacctttcggccttttcttgtccaagtgcgcgcagtgaattcgcgcggcttttccgcgattgaacccgaaactgtgctgggctggtcgggcgaagacggtcggcacaaatcccaaacggaaaatgccaaattggaaaaaagctgccccctttcagtgccattggaggcaccgcgcggactccgattggttgcgcatcgaaaccattcgacggtcgaattgggttgggaggagctgaagtcggcgaggtgactgtgactgatcaattgggccatttttagcccaatcatttggccatttcagctctgtccgtggccatttcgttggatttcgcgtcagtttttttttgttgccatttcacccttttttctccgcccatttcacatttctttgctcattgatcactctttgtcagttggaccattggccttctgtccgtccctttctgatcacttctcaaattgtgccgaatatttccaccgtggctacaatttcggggcttcaggcactgaccaattacgaggccaaagtcaattttgggattcttcctttccgaaaattaaaaccttttgcgcgaaggtgtgcgttttgaatggccaatacgaaagcgaagggtcgaatttgctgaaattcacgacaatcgaaggcggtaagacactaattaggcaattaatcgttgacaattaattaattgactaattagtccccctttgacttgcttcccgttcctttagcgccctccaaagtgcacaaatttgcgtgtccattccgtcggctcgcgctcccttctcgccacttgggagccgccgctccatcccaacggaaatctccgcggctttacctcgccttcgaaagtgccattgccccgtttcctttgttctgccgattgtttcgtcctttgtttttagacctttcctccggcttcaccgaagagacttttgtgcttcgtcgccaactcttttaccttcacgagtctctgtccccggagacgcctttccgcgtcgccgtttgggccgagacgggcggcggagagggaccgcgcacatggcgaaacacgcggacatggcccctcaggggtaattaagggagggcagactaattagggtaattagcattttgacgaatggcccacccactcttccagaccccgacccgcccctcttctccatccactccctttcccccaccattttgcgcgtccgttggtttccctccggaaacgcttcctccgccggccattggcgcatgtcgggctcctctttccttctcaactacacgaaaaaaggcattaactgttcatttaaatgaccaattttcaatttgaattcaattttcttttatattttaaaatgtaaattttaaaatttgtaatcttttgtcattttattttttcaattgttttctctcttaattacccccctccccaactttaataggcacctcccaatggcatcaaacggtgccaattgtgttgcctcaagtggtgtttgatttgcggaatttggccgagggaacggattatgtgctaattggggaggcgcgggaagggccgaaacgccggagggcatccgaagcgctagacattcgcacggaaagcagcagagggaggccaccgttcagcaacggtacggtatttattgtcacaagagtactgtaagcactcatcacagtgtttgctcaaagtagtctttcttttgtttgtgtacagtacccttccctccttttgcacagaacgcttgcgcagtgccgcttggtttttagccgttctaatcgcttgcgcattgactttcgcactgctcgcggtcgcgtgcgtagtcgcgcaacgaaatgcaggtcaacccgaaggctattaattaaataattaattaattgtcgaaattctcgaaagtttttgacccccctaaaaatggcgcaaattttccgtttgtttcgcttcagtctccgctttttgtcagatggcattccgctcggttttatggcatttcggcggcgcgagaaacgctttgggcccgcgttgcgcttccgcacgccctcctcctccacgggggaggaaggagttgggccccgcggacgcgttggattggctggcggagggcagcgaagcgcacaaacgctttttggcggaggcgcaacggcgattgagcggagcaatggacagcaaagaaagagagaaacggcaaaagacaagggagaaaggggagagagac

SEQ ID NO: 68489 - DNA, 438 bp, Heterodera glycines
  Genomic contig location: Contig_ID=SeqID_40055; Location=459..896; Strand=+
  SCN-specific regions: Sequence locations=1-222,244-438
aaaatggtctaagtaaaaatcgtaattacgctcaaaaagcttctcaaacaattttagcgcttccaattccttctacaatcgcctttatacatcccaatatgagcgctaaaattatcagagtgccgaaaatcgcatgtgatctaagcctagaaaaaaatggtctaagtaaaaatcgtaattacgctcaaaaagcttctcaaacaattttaacgcttccaattccttctacaatcgcctttatgcatcccattatgagcgctaaaattatcagagtgccgaaaatcgcatgtgatctaagcctagaaaaaaatggtcaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 68490 - DNA, 391 bp, Heterodera glycines
  Genomic contig location: Contig_ID=SeqID_40056; Location=56..446; Strand=+
  SCN-specific regions: Sequence locations=1-152,174-293,316-391
  Gene Ontology: Mol. function=helicase activity; Cellular component =mitochondrion; Biological process=growth
atttgccccccgaggttaagcgagacacaagtcaaacggttcaacgaccagaacgacccgtgcaaaattctgcttgcaaccgatgcaattggaatgggaatgaacttgaacatcaaaaggtcgcttttctttttaaattgcatgggtcaattaatctttgatatttttcagagtgattttcacaacattgaaaagtcgtgatggctctttgctccctgcgtatttcgtaaaacaaattgccggcagagctggcagatacgcatcagcatattgcaccggcgaagcgatggcgttggatgatgctgatgctggactgcttgagaagctgatgaatgaaccaattgattccattgaccaggccggcattttgccttcattcgaccaaattgag

SEQ ID NO: 68491 - DNA, 375 bp, Heterodera glycines
  Genomic contig location: Contig_ID=SeqID_40058; Location=109..483; Strand=-
  SCN-specific regions: Sequence locations=1-375
atgcacgcgttttgcgctcgagctatttatcatcgggcttgtcaatccaaagcgaaacaacaaagatggtgttttgaacgaataaagggcataggttattttgaagaagtgtcaaagaacatgcagcaataagcctgcaaaatctaataagtggaaaatacatgagtatagaatttattttcagaaagtgtctacagacttttggaaaaatatatttgcaatttatcaacaattttgagaagtgagttagaaatgataaacttcacgattcaaaccagttttcggtgctctaattaaccgcgataaaaacattcgaatcaattaaatagcttctgagataataaggtttatcataaaatttcatttaaaaataaa

SEQ ID NO: 68492 - DNA, 375 bp, Heterodera glycines
  Genomic contig location: Contig_ID=SeqID_40058; Location=519..893; Strand=-
  SCN-specific regions: Sequence locations=1-375
atgcacgcgttttgcgctcgagctattcatcatcgggcttgtcaatctaaagcgaaacaacaaagatggtcttttgaacgaataaagggcataggttattttgaagaagtgtcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccaattttcgttgctctaattaaccgagataaaaacatccgaatcaattaaatagcttctgagataataaggtttatcataaaatttcatttaaaaataaa

SEQ ID NO: 68493 - DNA, 65 bp, Heterodera glycines; identical to SEQ ID NO: 56492
  Genomic contig location: Contig_ID=SeqID_40059; Location=466..530; Strand=+
  SCN-specific regions: Sequence locations=1-65

SEQ ID NO: 68494 - DNA, 59 bp, Heterodera glycines; identical to SEQ ID NO: 52421
  Genomic contig location: Contig_ID=SeqID_40059; Location=124..182; Strand=+
  SCN-specific regions: Sequence locations=1-59

SEQ ID NO: 68495 - DNA, 59 bp, Heterodera glycines; identical to SEQ ID NO: 52421
  Genomic contig location: Contig_ID=SeqID_40059; Location=254..312; Strand=+
  SCN-specific regions: Sequence locations=1-59

SEQ ID NO: 68496 - DNA, 59 bp, Heterodera glycines; identical to SEQ ID NO: 52422
  Genomic contig location: Contig_ID=SeqID_40059; Location=644..702; Strand=+
  SCN-specific regions: Sequence locations=1-59

SEQ ID NO: 68497 - DNA, 59 bp, Heterodera glycines; identical to SEQ ID NO: 52422
  Genomic contig location: Contig_ID=SeqID_40059; Location=774..832; Strand=+
  SCN-specific regions: Sequence locations=1-59

SEQ ID NO: 68498 - DNA, 588 bp, Heterodera glycines
  Genomic contig location: Contig_ID=SeqID_40060; Location=6..593; Strand=+
  SCN-specific regions: Sequence locations=1-143,167-588
  Gene Ontology: Cellular component=nucleus
atgaaaagtccgaaaaaacgacaatcaattctctcccttcaagccgcaggtataccggcaaaacggcctaaggttttgttggtcgatgaaaaaatggaagaggcgaagtgcacttcatgggctgacaaatacaggtggtggtgattcttataaaagctttttaaatataggcgatttttttacatttatcattcgacacattcctccagaatgttaaaaactgacaaaaaattaaaaaccttttaattcggttactttctctacagaccgacttcactcaaacaactgattggacaacaaactgacaaatcttgcgccaacaaacttttgttttggctgaaaaattgggccaaaaataatcttaactcaccgccttctgctgaaaagaaaaaaggcatcgtctccagtacaaaacaaaaaaagaaataatttgtttatttagctcgtccaaatcaattccaagctcaggttgacggagccacgtttaaagcggctttactttccggccctccaggcattgggaagacgacttgcgcattgttgtgctgtaaggagctgggactggctttcgtggaaatgaacgcgtaa

SEQ ID NO: 68499 - DNA, 1201 bp, Heterodera glycines
  Genomic contig location: Contig_ID=SeqID_8551; Location=6..1206; Strand=+
  SCN-specific regions: Sequence locations=1-38,60-538,571-742,771 -829,851-1101,1123-1201
atgctttgctctgtggacttttatgaagtgagtgagcgtaacgcgtgtgaccacagcaaattcaaacccgacaaaaccgcgtccaaaaaattgcttttctgtcaaaatccgatggattttttttgttgatcaaattgaaattcatttgctgcttttgtcgcgttgagtttttatgttcgccaagtgtcaaaaagcatttcctattattgcgtcgcttaatttgttgttttttaagttcttcgtctttcggtatgccttcccttctgtctttggctggtgtgcttctgctgcgctctcatcccgtttgctgatcaattggacgaacttctggacctgcttcaacttccgcgcggattacacaattgtgccgttggtcactttggtgagtttgtgtgccacctttttgccatttgattttgtggcattttccaacttttaggtgctcagcattgtcttggcgtgttcatccgtcttcgagattttcttcatgaattcggtgctgaaaaagaagtgccccgtgtgtgcttatgcttcaaccgacgactacgatgatgatgatgattatttggtcacggaatgtgccatcgactgagcttaagcagacacgaaatcgggaacaatgctgatgccaacaaaacataaccaatgcgatgaaacaacaatgtgatggataagacatatgatcgatataatctaattctacgtaaactgttgtattccgttgtctattccattatattagtagatgtatgtatatgtatatatgtatcagattatctatttcaaaaccataaactgctgtattcaatgtgttgtgtattgtatgttccattatattagtagataaaatcttgattgatgtaaagtttttagtaagaatttattcccaattagttatccgaagtgtgatcactgatcagatagatgctcactaaatcttttttgcatcatcattttatttatttttaatactatgtatcagggatgtgccgagccagacaaaatccgattccgattatggccaaaaatccgatacggttttaaaaccgattacgattatggcccaaaatccgattaattgcgattccgattacgattccgatttttttaaaataattttttcccaaaaattttattcataatcaaaatcataaattttaagattgtgatgcaaaaataagtttgtccacattctcaggca

SEQ ID NO: 68500 - DNA, 1217 bp, Heterodera glycines
  Genomic contig location: Contig_ID=SeqID_8552; Location=3172..4388; Strand=-
  SCN-specific regions: Sequence locations=1-427,449-1068,1090-1217
ttggcgtgccgtgcctcttctgttggtcgattgtggtgcctccattctttggttcttttttgaccgtgtcaaaaaacggcgacgccctcccaaaaaagaaatgtaaaaaaataaacaaaaattccgaaaaaattcttcttttttgcagctttatctgcgccgattgttggcttttggtgttcgactttcttgcgccttctcaacttggcctcgaaattgcactgatcagccgtcgatttgacttctacgttgatgaacacttcaaaacgcgcaaatggatgttgaacaaacaattgctaattacatggaaaattgtcggaaatggccccaagcaaatgcaaattgacgatgccgatggaaatccattgccaatcccgcgaaatccgttgccgaacaaagtcatcggattcagacgcattcagatcatgtaacaaactgattagatagaaatttttcataattttctgcacttttcagttacatcgatcaaaatgtcatcgaatttctccaccgttttcaccgtcttttcggcacttgtgcaacagctttggacattaccactgaaaatgttcgcattttggactactttttgctccacatttggccaatgttccgcgcttccatgcatctgatgattttgaacaccatcttttttcgccgtttgcgtcaattggccccgtcttcgctcagcgattgtccatcccttcgcgttgtgtggttggatgacggcactttccccgaatttccgcccgatgacagtgccatggcgtcggatggccaagcggtggcaaaatgggtgttgacgccccgtccggatggtcagcccaagttgctcaaatcacctgttaattcaccggatcaatggtcgtcaacgatagaacagttcaaagcggtcggtgattatcactgggcattttattcgttttttgcgtttttttgtcccatttttaggcattttccaatgcttcttctccggtttccttttcaattaactttctgccgtcttctccgcttaactccgctgtgccattcgatcggatcaacgaagcgactggggagcaattgacactggaacaatatgacacaaacaatttttggctcgaccgttgtccaattggatgggatgataagaaatgggacaatgtgtggaaggaattgggtgctgctcgaacgaactcaattgacattcagatcgaagatggcggatacgacgacgg

SEQ ID NO: 68501 - DNA, 468 bp, Heterodera glycines
  Genomic contig location: Contig_ID=SeqID_8552; Location=2505..2972; Strand=+
  SCN-specific regions: Sequence locations=1-396,419-428,454-468
aagacggtcacagttcgctggaagtgctgtacaaatgcacggcgtgcggcaaagacgtgcacagaacttatgagtgcatcagtacgtacagtacagcaatttttaccgtatcccctctcaattacaatacatacaataaagtcccgtcgatttaagttgacgtcacttacaattggtcgggcggacgacaccgcgacacctttcgctaccgtaatcaaacgtacagtgtgtggggacagtacacggaaaatgtcatgaaaacggtagtgcggacgcggatgaccatgaacaactttgaggcggtggagcgcaaattcgacgtgatgagcgttgttcagacggacaattattacaagacaagcgatgaatggaccaacgatttgattaggcgtcttgaataattgaggcagaggccaaatggcaacaacaatttttgtgtattatatttgtgtatttctcgtatatact

SEQ ID NO: 68502 - DNA, 184 bp, Heterodera glycines
  Genomic contig location: Contig_ID=SeqID_8552; Location=5137..5320; Strand=-
  SCN-specific regions: Sequence locations=1-184
tcaaagtgacgaaaaagtgtgctcgacacctccgacggggcccagttatcagcggaatgattgatatttaagaaataatgaccgatctttttgagctatgatgaattggattgattgattgatgatatttttgtttgctctttaaactgcctattgacgctgaccattaaaaataggaatttga

SEQ ID NO: 68503 - DNA, 65 bp, Heterodera glycines
  Genomic contig location: Contig_ID=SeqID_40062; Location=655..719; Strand=+
  SCN-specific regions: Sequence locations=1-65
atgttgtgcgaaattttggaacgcgacgaattgcaaatccctgaagaaattcaatgtggaatgca

SEQ ID NO: 68504 - DNA, 93 bp, Heterodera glycines; identical to SEQ ID NO: 53399
  Genomic contig location: Contig_ID=SeqID_40062; Location=88..180; Strand=+
  SCN-specific regions: Sequence locations=1-93

SEQ ID NO: 68505 - DNA, 369 bp, Heterodera glycines
  Genomic contig location: Contig_ID=SeqID_40064; Location=349..717; Strand=+
  SCN-specific regions: Sequence locations=1-369
atgcacgcgttttgcgctcgagctatttatcatcgggcttgtcaatccaaagcgaaacaacaaagatgctgttttgaacgaataaagggcataggtattttgaaaaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaa

SEQ ID NO: 68506 - DNA, 311 bp, Heterodera glycines
  Genomic contig location: Contig_ID=SeqID_40065; Location=696..1006; Strand=-
  SCN-specific regions: Sequence locations=1-184,206-311
atgaaaattattgccgaggctcgtgacggaaccggagcgcattgttttgacaatgttgatcaaactatggctgtgttcgcgttcaaacttcgcttggccaactccgtccataccaccgctcattctctgcgtttgttcgtttttaaagaaggtagagctgcttttaagtgtcccaatattaatttttatgccttatctctgttttaggaactatcccaatggaggacaacagaattctcgggtactacataaccagcgaccgacatttgttttaccagcgtgttcaggggcaacagaacaatccgaattga

SEQ ID NO: 68507 - DNA, 71 bp, Heterodera glycines
  Genomic contig location: Contig_ID=SeqID_40069; Location=616..686; Strand=+
  SCN-specific regions: Sequence locations=1-71
gtgtccgtttggggtactcaaacaattatggggagcaaaaatccaacgcagaattaaagtacaggctatag

SEQ ID NO: 68508 - DNA, 91 bp, Heterodera glycines
  Genomic contig location: Contig_ID=SeqID_40070; Location=103..193; Strand=-
  SCN-specific regions: Sequence locations=1-91
atgagtgaaaaattccgccaggacatgccaccccagggaggctatccgagcttccacgttcatcgcacgttaccaaaatcgttcctttcac

SEQ ID NO: 68509 - DNA, 457 bp, Heterodera glycines
  misc_feature (148)..(148): n is a, c, g, or t
  misc_feature (150)..(150): n is a, c, g, or t
  misc_feature (153)..(153): n is a, c, g, or t
  Genomic contig location: Contig_ID=SeqID_40071; Location=66..522; Strand=-
  SCN-specific regions: Sequence locations=1-375,398-436
atggcaatattaaattattatccaccgagctcaaacaggtgggcagtgaaattgatttaatttattcacgttaagcatgctattatagtttatagacgtttcggtctaagcacaaaatttttgatcgcgtaatttcggggaattttgncntanaattcagtttaaattaacctttttgatgcaaacctagaaaaatcaaaaaagttacttcaaatgtaaaattaggcaattttgcccaaaatcaataaattaaatccaaatccgttaattatggaaaatttgaattttgattacggtcttttgccatttgattataccccgattcatatatgaacaggtgtggaacagaattaaacagctcgaacgaattgaatcaaggatttcaacaactcctacaagttcatttgagtttattcaagatgaaaatggcaagttgttttaaaaaataattaataaa

SEQ ID NO: 68510 - DNA, 884 bp, Heterodera glycines
  Genomic contig location: Contig_ID=SeqID_8553; Location=637..1520; Strand=+
  SCN-specific regions: Sequence locations=1-545,589-884
  Gene Ontology: Mol. function=transmembrane receptor activity; Cellular component=plasma membrane; Biological process=cell surface receptor linked signal transduction
atgccgcgctattgcctttttggggattcggtgaacaccgccagccgaatggaatccaacggaaagggtaaaattgggggggggggggggaaacaaattcatttcccatttcagccggcaaaattcacatttcatcgagttcaaatcgcttcttgaccaccgtaatcggaggatatgtgacggagccaaggggcgaagtgattataaaggtaattagggggggggaaaggcttttgttaattaattgcctgattaattcattagggcaaaggtgtgatggagacattttggctgttggggcgaattggcgaagtccatttgccggaagggccatccgtggcggaacggaagagcccagcggaaatgcgctgattgaccggtaattaacggtttacctcagttgggcgccagcatgtttttctactataactttctataacttttttctttgtcatccaaatccaacaatgttgctatcattcgaaagcttaacatgtttagaaactttttctaagatattgcggtacttatgcactttacagaccataaaaaataaaattattttttaaatcatataagaaatttatagggggttttcggggtcgctgatcacgaatctgatatccattttgaccaattcgaactccgaccacgtattcgaataaaaaatcaaatatatctatgagctctaatatggtgttaaggagctcttgaaggtgttgatagcgcatcttaactcgggtttgaccaattccgaactccggacccgaattcgaacaaaaaaaaattgagtttttttaatcaagaataattttttcagggtaaaagcttctaattcattatcaactatttaggtgtaaaacaatgtttcaattcttaattaa

SEQ ID NO: 68511 - DNA, 2340 bp, Heterodera glycines
  Genomic contig location: Contig_ID=SeqID_8554; Location=211..2550; Strand=-
  SCN-specific regions: Sequence locations=1-257,279-994,1128-1560,1586- 2183,2224-2340
atgccctgcccaaggctggtttgcccagctgaccgtgttcgagttctttgtgttcctcaagctgctcagctggcccattttgttcgcgctgttcgcgaggacagcaaagcgagtggaggaggaggccgatcagatttggaagtaccagctgtactcgctcaccacctcgtttaggtgggacggcaattccttggcgccatactttgggaagaaaatggcattttcgagagtgtcccgttaatctgatcacagtgcctactcttctcccacattccatcctttttccattgtctcgccgatttcatttcttaccgtaaccccaatccgtaatctgttgccacagtgtccgtccgtgccttcccccgcctttcactccgctgtttcttctctctgtcgccttttgtcgctgcggcgggggcggcgccttttcgtgtctgcagcgccgcaagggaattgcgcaatgtttggccaccgatcacccggactttgggggacgggcgccgaacagtccgcagagcaaatacatcgtggtctacaaaaacccatcggtgagctgggaaaaggacgcattgggcttttcactctttcatattttatgagttggccattgatacggtagtatttttggtccttgcctggtactgtacattcgttcgtttttcgaaatgccctcctccatcgttaaaaaggtgcccgtctcgcggggtcgcccactctgcggctattggcgccgtttggccgttgcccaatggaaaagcgcgacggaagggacgccggcggagggaaggcaccaaacgcagcaacaaatagcggacaaagcccatctgctaatcgcattcagttgcttacagcaacaggtggacaaaaacaacggcacgacaaaaggggcccagcgatggaaagttatggcgacggaaggaggcgaggaggaaaagccgacgcgactcgaagtgattgaataggggataaacagcggacgagggaaaaactgattggacgggaaaagactggtcggacggggcaagactgattggacgggaaaagactgatcggacgggaaaagactgatcggacggggaaagactgctcggacggggcaagactgatcggacgggaaaaggacgggaaaatattggtcggacggggaaagactgatcggacgggaaaaagtcggacggagtgggagaaagacggtttccttctttaggtcccagcttcggaacgcgattggctccaacttcagcctcattatcgtcccaattcgttttcaaaagcggccaatcagttcccggcagaattgcaaaagcacgtggatgaccattcggccaagggactcatcgaaattgggcggcagtggcgccagcgctgtcttcaggcgattttttccgccattgacgagtgcaaacagtcgccaaattcgaggagggctaagcggtcgattagtctgaatggtgccggaattccgctgaatcccggcggacggaccggaatggccggaaggggcaaattcgcgcggtttgggcccaatcggatgctgatctacgcactgattagacgaattgtggacgaagaggaggaggagaacgactgcagaaaagaagacgaagatgacaattgtgagcagaacggagcggaggagattcaggtggggacgagggatgggtgaagatggcattttgaatggcatgctctatatgctggggtcacatgtgaattagcaggggaagatgggccagagatttaaggcgaacaaatttccaacagacagtgcgcgagagtgagggagcggtaggggtactgtactgttgtggttactgactgtaatgttggttttcttatttttttaaattttcattttccatggttttcggcaattccaatatcccaaaaggtgctcgtcctttccgcctccggccttttgccgtttcgctggcgcttttcgcccggtcatccgatggtggacgaacacttggcacaggtgctgctccaactcggcatgtccgacccggacattcacacgctgagcacgaagacggcacttggggaaggcgagcgggacggaggggtggcgcacgtgtgcacggagagggcggagacggcgcagggcaaagagacggacaacgcgtgggccgaagcgcagctgtgggcggtggacctaaggcagtcccccaacaattcgaaattcgattttaatcatttaaattttattttgaaaaattccagcgccttctcaagccttcaccagcaattgccggacggaggcgaatattcgtggcgatctcttcggcggttggcgccggagcagcgccgatttgcggagagggcgttgaaaatgttccg

SEQ ID NO: 68512 - DNA, 780 bp, Heterodera glycines
  Genomic contig location: Contig_ID=SeqID_40072; Location=36..815; Strand=+
  SCN-specific regions: Sequence locations=1-5,27-116,140-780
atgggtgatgatggggagataaaccatcgacaaccacaaaagattacagctgttggcgctggaaaaggaccgcccgtttggaaaattccgaagaagtccacaagcaaaaagggaagtgatggtgctgggaaaccgagtcgagagagccacaacaaccgggagagccacaacaaccaacagtcggattcggcagccaaggggggatacaacggtttgaacattgacggactctttgaggagattgaacagcaaaagaaccaacggacgattaacgaaaatggcggcaacagaaaagaacataacgaagtggcggacacggacagtggcaacaacggtgtgcagtgggaaatgcaatgtaaaactaaatagcgcaccgatacaatgacagcatttattgcttttgcagcggaactctgttcagccaacggacgtgatgacttggtccggtcgccatcacttgctccacaatcttcgccgaacaagttgcagaccagcaaaggcattccaaaacaggagtgtgatgatgagaagtcgcagggatttttcggatctcataagtcgtcgacatgtaagttttgtctgaaaataacttgttttcattgtctatatagtaatatttcatccgttataactcaaataatatgtctcacgatcagtttgcctaaattcggtatttcagtaggactggcgttgtacaaggctgagaaggagggacgcgaattacgatctcgtcatttgcgcagcggacagtctccacaaaatgtgccaaactcatctgtg

SEQ ID NO: 68513 - DNA, 141 bp, Heterodera glycines
  Genomic contig location: Contig_ID=SeqID_40072; Location=83..223; Strand=-
  SCN-specific regions: Sequence locations=1-49,73-141
gaatccgactgttggttgttgtggctctcccggttgttgtggctctctcgactcggtttcccagcaccatcacttccctttttgcttgtggacttcttcggaattttccaaacgggcggtccttttccagcgccaacagct

SEQ ID NO: 68514 - DNA, 234 bp, Heterodera glycines
  Genomic contig location: Contig_ID=SeqID_40075; Location=1010..1243; Strand=+
  SCN-specific regions: Sequence locations=1-234
atgcgcttcgttctgtccctcgcccttttggcacttttcgtcgtccaatgctccgccgacgactcatcgccgtcctcagaggcagctgatgagaatccctctgctgcccatgccgctgctgaaccatcagcggcaggcgatggagtgccgccgccaccgccgtcggccgaaggggcggcagccgaacgaaagaagcgcagcggagggaaagtcgcaccggcactaatcctttaa

SEQ ID NO: 68515 - DNA, 443 bp, Heterodera glycines
  Genomic contig location: Contig_ID=SeqID_40080; Location=23..465; Strand=-
  SCN-specific regions: Sequence locations=1-443
aaaattggtctaagataaaaatcggaattacgctcaacaagcttctcaaacaattttagcgcttccaattccttctacaatcgcctttatacatcccattatagcgctaaaattatcaaagtgccgaaaatcgcatgtgatctaagcctagaaaaaaatggcctaagtaaaaatcgtaattacgctcaaaaagcttctccaacaattttagcgcttccaattccttctacaatcgcctttatacatcccattatgagcgctaaaattatcagagtgccgaaaatcgcatgtgatctaagcctagaaaaaaatggtctaagtaacaaccgtaattacgctccaaaaagcttctcaaacaattttagcgcttccaattccttctacaatcgcctttatacatccccattatgagccgctaatattatcacagtgccgaaaatcac

SEQ ID NO: 68516 - DNA, 738 bp, Heterodera glycines
  Genomic contig location: Contig_ID=SeqID_8556; Location=101..838; Strand=-
  SCN-specific regions: Sequence locations=1-18,40-330,362-514,550 -557,585-738
atgtcggcacaccaaaaagaggaggaggacaaaaatgaaaacattgttgcaaataaaaatgataatttcgaaagtgtggcggcggccgaagtttgtttttgtttctgtccggtactgttctgtccggtgaccaaaaaaacccatttcacaaagtcaacattttagggatggcattccgaggccccaaaaaatgttcggaaatcagaattaattggaaacacgaaatttccgaccctaattagaaaaaattatcaatttctctaaaacataattttatttttccgtaaaaacttggactttgctttgttagctgacagcaaaatttttgagtattaaattttaattttttcaatttttttttcagaaaagaggagtgccaaagcgcaaaaaacgccgaaagcgaaggcgcgcctcgtcctccgaggcggccagggacgaattggacatgtgccggacggttcagcaaagatatggcgccaaacggaaggttggctttgtgcatagttattgtaccatttttaaattttttttcaaaaatttttattttttgcggcgattttttcaaaaaacttttggggaacaggagtggttcggttaggcgccgccttgaaaaaattggaaattttcgacagatttggaacagatttcaccaaaattttgctaattttatggatttttagaaaaattttacttgatttttttgggaaaatgggtttttttttctaatttggcaataaa

SEQ ID NO: 68517 - DNA, 510 bp, Heterodera glycines
  Genomic contig location: Contig_ID=SeqID_8557; Location=23..532; Strand=+
  SCN-specific regions: Sequence locations=1-485,507-510
ctcgccgcattgacctttattcaaagcaatcgcaatttgtggtcaccggacgaaggggaaatgggggaaggcgatttgccacttgaaggtgctgggaataacaagaaaaaaacccgttaattaataatttatatttgaattaagaggaattggccgattgggtgcaggcggagacatcggacggacaattttactattggcacatttacacggggggtaagtgttttacattggaatagatttaggaaaacggaacttcatactgtaatattttattaagaaactcgttgggaacaacccgagaaattttacacttctgcccaatacgccgaacgttatgccaacattgtggaagagacaactgaccagagggaagtcggacagtgtgccaattccgcctacgatttaacacaatcatcggtattaaaaaaagttctgcaaattagaaccgaagaattacgaagaatttgtccatcgccggcacaagtcagactgcttgtcctgaactga

SEQ ID NO: 68518 - DNA, 384 bp, Heterodera glycines; identical to SEQ ID NO: 66175
  Genomic contig location: Contig_ID=SeqID_40082; Location=89..472; Strand=-
  SCN-specific regions: Sequence locations=1-20,51-384

SEQ ID NO: 68519 - DNA, 598 bp, Heterodera glycines
  Genomic contig location: Contig_ID=SeqID_40083; Location=71..668; Strand=+
  SCN-specific regions: Sequence locations=1-225,317-379,401-555,577-598
atgatgataattttatcaacaaaactgatcacattgtccgttctgctgcttccaattttgcttggcattgccaatgccgcgggcatcggcgacagacaaaaaagggcggtggaggaggaaggacgaaaaagcgtgagcgaactgtgtgccatccatgaacagaagttcaaggagttattcgaggttgaaagaggaagtgccgaaaaggaagaagttttatggatggaaaaaattgaaaataaagcggacaaagaggaggaaaaggaaaagcagaaagaaaaggaaaagcgggaagagaaagcggcagaagagagaatggatgctaaaaatgaagcatggcttagcactttgttgggcaattatttgtgccaaaaattgcgggggaaaggcggggagcaaaatgatgagaaattggattatgccattgagaagaatgtgtggacaacgcccgcaactgtagatcctttattagcctgcaaaatttcaaaaagttgcttttctaaacatttttgaccatgtcccgacttgctctggggtcgggccaaaatgaattcacggtgcggggttcaggggcaggcagggacgagactcggaatta

SEQ ID NO: 68520 - DNA, 790 bp, Heterodera glycines
  Genomic contig location: Contig_ID=SeqID_40088; Location=418..1207; Strand=-
  SCN-specific regions: Sequence locations=1-337,373-595,629-726,749-790
atgctttgctgtacagctctctcaattcaggcgattcggtgattaaaaaagatgaatttgtccgcaacattaatttcagaaccaattcgtcggccttttgcttttgatcatcagattgttgaaaaaatttcgtaatattttgttgcccctaaatactttaaaaattatagaaacttttaaatttagtacttctttgtttgctttttctttggttttttcccattgctcaaattcgtcataatgcttcgaccttaaatgatcccataatcctttagtcgacgatttcttacacgaaaaagaattatgacaaaggttacataaagccgtttccgatgtttgtgattttttataaaaagaacaaaattcaaatttcttataacttttttgccttttccccaacaaaaattccattcttagaggtgtatatttaaccccgaccccgagtcggggttaagggtcggggttcggggttggaagcgtcggggttcggggttttccccgaaaatggccaaaaatgtcggggtcggtgacgcaaccctagataaaagtgacaaaaaatgttctcgtgtcacgcggggccaagcagtgatcagcggaatgaatgaatgaattattgtttgagaaatgataggtcctttcttgaattattaattgaaattgaatcagttttttgtgtgatgggcctgattgggaaggttttttttgataaatgtatcaattttaaattgaagaatctttattattgttttgatttaaattacttatctctatttttgtttaccacaataaa

SEQ ID NO: 68521 - DNA, 487 bp, Heterodera glycines
  Genomic contig location: Contig_ID=SeqID_40090; Location=1157..1643; Strand=+
  SCN-specific regions: Sequence locations=1-125,165-207,229-264,288 -321,343-363,385-487
atgaatacggcggacaccgttttacatgaaatatttcggatcaaccaatcgtatacagaattcgatttgttgcagcagccaatatcttgtattatagcgacatatagtacacccgttgggacaggtaaaaattaaaagtttattttaaaaaatatattttttaaggatttaaccctttggattattgtgaaattaaagagttagggagaatttgtgtcaaaaatatggacaatttttgtaagttaaacaaaaaataatttagcaccaaaaaattttaggtttattttatgccttggttttaagcagattttatcaattaattaacaaaaatgacgaagagaaaatttcgatggatcaatttcgtaaaattataaagaatgaacagagacaaagcgaagcagtaaaaaaattaattattgatgctaaaattaatatgaatgaaaaaacctatggtttaaatcatttgcaaatcgttcaggatttttgg

SEQ ID NO: 68522 - DNA, 1364 bp, Heterodera glycines
  Genomic contig location: Contig_ID=SeqID_8558; Location=2628..3991; Strand=-
  SCN-specific regions: Sequence locations=1-465,594-651,673-1003,1025 -1038,1226-1247,1270-1364
atggccagcgaagaaattgatgaaaaaagcaatgagaaaaaatatacgcttaaacaggtaaacaaattgagccctaatcgagcccgaacgggcacgggatcgggcgcgcggatttttgaaaatttgggacaatttcaacagaaagttttccagcgacgctggattacgcaatttttttttattttaccaaaattgccaatgttaggtcaaattttaaaattttagggaattttgtaggcgttccggaaatttttttttttttttgtaactttaacgaaattgttctctgtttaagattgaattgaatggcggctcaattggcggctacggcactcctcagccccttaccgcacttcatcgccgaatgctttccaatgtcggcattgacaattcaatatcggtgatgccggaaaatctgaccagcgaaatgttggccacggcaatgtacagagcatggtcagtttaagagagagagggaaaagaaagagatagagtgggtaaaaaaggaaagagagaaaagagagagtgacaaaaaaagagagtgacaaagaggacgaggggattagagagaaaaggggtaagagagagagagacaggggggggagcggggacggtaggggtcagttgcgtctgagccaagcataaagcaccataacttttttctttgtttgtcaaattttataaatttggcatcattcgaaagctctacatgtttagaagcttttgataagatattgctaagcgattgaacaacttataaaaaagttgcaacatgaacactaccaaaaagtcagaatttttgcatattttaatttataacttttttatatgtcggtatgtctttgtgatttttggatagccgatagagcttgttaagagctttcgaatgataccaacattgttggatttggtcaacaaagaaaaaagttatggtggtctaaacttggctcagacgcaactggcccgtttcgagcgaggaggtaagaggttagagagagagagcgcaagatagagaatattatgactcatgataaagaggagagagagggagagaaagagagcgacatggagaggagagagagattagagagaggagagagataaaaaaagaaaaaggatgagtggatacgagataaagggcgaagagagagagagggagaggggggggggagcgggaaagaataggggatagaaagagagcgtgagaccgagagagagagagagaaagggggaagagagtgagagatgaaaagagaaaggagagggaaaaaccgaatctgtcattgagttaaaagtcaaccgattgataatggtaaaggttatacttcagcatttaaatggttattccttgtttttttaataaa

SEQ ID NO: 68523 - DNA, 264 bp, Heterodera glycines
  Genomic contig location: Contig_ID=SeqID_8558; Location=2290..2553; Strand=-
  SCN-specific regions: Sequence locations=1-264
gattctttttgtccacccaaaaattcgcatttttttgctcgtcgaagcgcgcgcaattcaatacgcaatggaacgcatttttgagggaaagccaaagccgaaatgcgttttcctcacattggaagagggaattgaccggtgaattagttaaatttaattaattcgatttttaaaatgatataataaaggctaaagctcaactcggacaattttttgattttggatggcaaattcactgttgccgtttcaatggcccgcaatgcc

SEQ ID NO: 68524 - DNA, 204 bp, Heterodera glycines
  Genomic contig location: Contig_ID=SeqID_8559; Location=161..364; Strand=-
  SCN-specific regions: Sequence locations=1-72,94-204
atgccatatgccattaattatggtactcttatcactagggatgggaaatttaggtaaataagattcacggaatttaaaaatgctgatttttctgtttatttagtaatgtttttaaatcttgaaaatttcagggaaatatttttccgtgaaattttcaagtttattaaacacgggaatgtttataaaaacgttttggatacataa

SEQ ID NO: 68525 - DNA, 163 bp, Heterodera glycines
  Genomic contig location: Contig_ID=SeqID_8559; Location=1060..1222; Strand=-
  SCN-specific regions: Sequence locations=1-163
gaagtgaaatattgtgtggaaaacattgaaagggacgaaaatgttttaatggagcgaattcgcgacgcaaaagattgggcactgactaatgggctgacttttccggtgccaagaagtaaactgaaatgtgacgcatgtggcaaaatcaatgaagtataatgtt

SEQ ID NO: 68526 - DNA, 438 bp, Heterodera glycines
  Genomic contig location: Contig_ID=SeqID_40092; Location=474..911; Strand=-
  SCN-specific regions: Sequence locations=1-438
aaaatggtctaagtaaaaatcgtaattacgctcaaaaagcttctcaaacaattttagcgcttccaattccttctacaatcgcctttatacatcctattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctactattgcctttatacatcccattatgagcgctaaaattatcagagtgccgaaaatcgc

SEQ ID NO: 68527 - DNA, 307 bp, Heterodera glycines
  Genomic contig location: Contig_ID=SeqID_40095; Location=8..314; Strand=+
  SCN-specific regions: Sequence locations=1-209,231-307
cacccggaagttcactcgttgcaacggatccaatccaattgggtcccgctgatcagactaaaactgatcaattttgatcatgaaattgatattgtgttcgcttcaattcctggagagcagcaaattgatgccgatgatttacggcagcagaatattttgacaaaatttgaagaaatgatagaaaaattagacaacaaaatcaaacagctaaaagaagaagaagacagaaatgatcaagcctcattaacaaatgccaaggaacaaatactaaagtcactccgatcactcgctggtaattaattaatga

SEQ ID NO: 68528 - DNA, 625 bp, Heterodera glycines
  Genomic contig location: Contig_ID=SeqID_40095; Location=413..1037; Strand=+
  SCN-specific regions: Sequence locations=1-288,317-556
atgaccaagaagaataataattttcataaattacttttgctactcaaactgtgggcaaaatgtgagttttctaaaaaaatacaattgcaaaaaaactcacaaagcgattttacttcataaaattggtcttttacattaaaatttagctaattacatttataataatgcaatgggcttcttcaatggcacatcgttgggcgttttggcggcaaaaattgtcttactgtatcccgaagcgacagtaccatttctgttggaacgtttcttcttcacttattattcatggtcaaactttaattaattaattaaaagcaattgatgaattcagggaatggcctttgcccgtacaaattgccgaaatccgacccaattcatcattaaattggaatgcatgggatgagcaaaaacatttgttgtcccaatacggtagcggcggtgcgtacagtaaacttatgataccggtgatcactcccggcttcccggaaagtaacagtacatatctaattaattggcaaacaacaaaaatcatcaaaaatgcacttgatgagggtatttctttttttattatacataaatttaaataattttgaaattttgaaattttttttattaattatcaaattaa

SEQ ID NO: 68529 - DNA, 1299 bp, Heterodera glycines
  Genomic contig location: Contig_ID=SeqID_40097; Location=71..1369; Strand=+
  SCN-specific regions: Sequence locations=1-95,127-299,336-390,686 -704,838-962,1034-1118,1242-1273,1297-1299
atggcgcgtgcgtttgcttgcacccgcgtgatttctgtcaaattgcgtgtactccgtgtacaggttgcacgattgacctgctctccggtgcggaaaagctgcagcagcagcaacagcagcaagcgagtgcgatcaccttgtccgcaccagcaacagatgacccggttatgggtcgcgcttcggctaacagcagcccgcagccgcaacgctcagcgcgctcgggtgcgcctgccgcgggtgagacgctgtgcgtgcgactcgcgctcagcaacgaagtgccaatacggtgacgcgcactcaaaaaaattttaaatttttttttttttacaataatagagctgtgcttctttttgcggaaggaattttcgcgtcagaatgttatgcaatgtgattttaaaaaaatatttaaattaaattttcattaaaaaaaattcaaaaaataatttaattgaagcaaaaaaaaaatttggaaaaaatttattttttaaatttattttgacaaaaaaaataattttggttttgattgtatttaatataatttttattaaaaaaatataattaaattatattaaagtttttttttgtttaaaaaaatttctattaaataattttctttaaaataataaaaaaaattaaataaaataattatttttattgggaaataaaattattttttaaattttttgaacaaaaaatttagtgactttaattctttttaaatatttaattaaataaaacatgattaaactaaataaacaaaagttatcttataaacacaataaaattttgtttgtaaattgctaattttatattattttattttaattattaattattggcatttttcaagccacccgaatgggaaggaaagtgccgacatggtggtccgattcaatccggccaaaaatgtgttggccgaactgttcatcaaagtgtttgccggcttttccatggagtgatttttaattgtttaattacaaaattattattttaattacctaattaattatttgttcactaattaatgaattaaggcgccatttgcgtgtttttgaagtcaatcagctgttgccacgttttgtgacatttgtccaaatggacccagcctttggaggtggttattttattatttgacaattataaaaataatttattaattttatatatttttaattgctaaagaaataattcttcagagatttgtttattttgtaaaattaaatataattaattaaaaaaaagcctaacgaatatactttatggaggtattaactaagtttttgcatcaaaaatttataa

SEQ ID NO: 68530 - DNA, 749 bp, Heterodera glycines
  Genomic contig location: Contig_ID=SeqID_40099; Location=36..784; Strand=+
  SCN-specific regions: Sequence locations=1-33,55-81,103-397,422 -459,481-507,529-636,658-749
  Gene Ontology: Biological process=protein biosynthesis
aaggctaatgccgaggctaaagccaagaaagacgcagaagagaaggctcagaaggatgccgaggctaaagccaagaaagacgcagaagagaaggctcagaaggatgccgaggctaaagccaagaaagacgcagaagagaaggctaatgccgaggctaaagccaagaaagacgcagaagagaaggctaaaaaggatgccgaggctaaagccaagaaagacgcagaagcaaagaaaaaggatgaagaaatgaagaagcaaaaggctaagcccgaagaaaagcctgaggcacctgccgaagccgtagccgtagtgccggaagcgaagaaggcggaagagactaaggaaaagctgaagcaggaagagaaaccagtgaaagtgccaccatctccagcagaaaagaagagaaaagacgcagaagagaaggctaaaaaggatgccgaggctaaagccaagaaagacgcagaagagaaggctcagaaggatgccgaggctaaagccaagaaagacgcagaagagaaggctcagaaggatgccgaggctaaagccaagaaagacgcagaagagaaggctaatgccgaggctaaagccaagaaagacgcagaagagaaggctaagaaggatgcagaggctaaagccaagacagacacagaagagaaggctcagaacgatgccgaggctaaagccaagaaagacgcagaagagaatgctaatgccgaggctaagccaagaaagacgcagaagagaaggct

SEQ ID NO: 68531 - DNA, 526 bp, Heterodera glycines
  Genomic contig location: Contig_ID=SeqID_40100; Location=23..548; Strand=+
  SCN-specific regions: Sequence locations=1-313,335-526
atggggagacggcggcggttcgatgggagtgggattacgaaattttgggcgattttaacagaatcttcattagggtggatggtgtcaagtgcattgggtgagtaatagaaaagcatttgattttgtttaataagtcaaattacgctgaatttaggtattgtctccgtaaggagagaagctggacaaagcatcgaaatggggggagccttctgacaatgaacggtcaaaagaacaaaaaaagtgatcagctgctgaaatggactaattgggaaatggtcgatcataatttatcaatgataaaacgtaatttatgaaaaaataacagatacatataagtgcaaaacatagtatttttgttgagaaattttcccaaaaaatgtcgaaaaattgaaaaaaaagtgacaaaacgccaaaatagtgaattttcactattttagggaccgggtcgtttcggcgccgacgattcggcgacgacgtttcggcgccagggtcgtttcggcgccgcgccaagccagaaatttaaaaa

SEQ ID NO: 68532 - DNA, 244 bp, Heterodera glycines
  Genomic contig location: Contig_ID=SeqID_40101; Location=135..378; Strand=-
  SCN-specific regions: Sequence locations=1-244
atggctgcgctccgccgagcccccatctcctcctgcttgccattcctcatcttgatcataaattttcctccaactattcaggcatggcagttgaagcgagcggaagacaaccttttgttggcttatgacccaatcgcagaaaattatgtgggtaatcagcagtgctgttcgagagtctcgggtcccgacttgagaaaagactcgggttttattggtctcggtctcgagtcgagaaaagactcag

SEQ ID NO: 68533 - DNA, 457 bp, Heterodera glycines
  Genomic contig location: Contig_ID=SeqID_8561; Location=6..462; Strand=-
  SCN-specific regions: Sequence locations=1-114,150-157,180-245,288 -294,318-457
atggctaaatacggtataagaactcgtttttagaagaaaacaagcaatttctagagaaaaacgaccaaaaaatcaaaaatttccatttttgcttatttttgacataaatttaccaatttttaagaaaatttaaatttaatcaattttttcgacaaaattttgctaaaaaatgtcttttcggaaatttttacggcctttggggtcaaaactgccaatttatctgatgggggccgttctaataggggttttttgaaaaaatgcaaaaatatgtacataaaacatggacataatgccaaaatatggaaaaatatggacataaatcacgaaatatggaaaatatggatatagaactccttcctagaggcttcaaaccaagctaaaaacatgtttttcatgcgtttcaggcctccaacagtccaggaaaaaatatggatttccatattattacaaaccctag

SEQ ID NO: 68534 - DNA, 1464 bp, Heterodera glycines
  Genomic contig location: Contig_ID=SeqID_8562; Location=789..2252; Strand=+
  SCN-specific regions: Sequence locations=1-220,242-338,365-562,587 -777,799-846,880-1089,1114-1172,1195-1327,1349-1358,1380-1464
atgaacacaacggcaccaactgacattgacctgtttctttttttcctcggcggtgccgttgaactgttgaccaattttgttggcattccgttatccattgccaatttgattttggtggcacgcacatcggtcatccacccgaacatgaaagccattctcatcttccagagtctctttattatcttggtaaattaaattcaattaaatcaaagtatttaaataaaaaacaagaaatgattattattctaaatttaagcgtggttcctgtcgttttgtcatttgtcttttcaagttcttcctttgggacccaattggtgcagaatctacgctatttttcccggcacttttaaaaatgtatttcattggcatttatgctcgtaattttgtgccccatgttctggtcgttgaacgcattttgtccactttatttgtccgaacatatgaaaagaatcgtggcaatctgttcagcattctgtggatgccttttgcggtgagataatcgagacttaattgccaaattgataacgaattataacgaaaaagtatcttcaaattcaagtacaccaaaaggaatttttgaaaattttgttaagcattaagaatacataagcgatcaaaaattctatttgcagttgatcatcccaatttatattgccaccacaacatcttcaccgcatgatcataaccaaccaataacgaatctgatcacaactgccgtccaattgctggtcggaagcattgtgttaggcattttctaccaattaagccgatacaattccaaaatttatcaaaaaatgttccaaaatattggctcgaataatctgtcaattcgttatcaggtaatccatataaattaattatataatcattatttattttgaaagctctctgaaaacattcgcattggcaaacagctaataccgccactgtttctgaatttgggcaacattttcgcgggaacaatgattttattatgggactttcttgatttgccattttatatttatatattcaatttggctgcgattatcaactcaattttcggccttcttatcgaatttttcattataacgtaaacaaatgtaaaacttaaaatattaatttaatttaaaagttttaagatgccatccatttttgaatagggatttgtgccaatttttgaaccgtattggtaaaatgtttggatttaatcatttggcctataatcatcgaattggtgatgcaactgtaacatttggcacaaataatactgctccttctttggctgctgtcaatggcattgctcaacggaatttgatcagcggaaaagcattgattgataaccaaacaaaaccagaagatcattttgccatgctgaaagaagcatgggagaaggggccgatgaaatgacaaaatgccaattcgcaaaattaactgaaaaactatttaacatttttgaatttccgttgtgaattaatgcattta

SEQ ID NO: 68535 - DNA, 604 bp, Heterodera glycines
  Genomic contig location: Contig_ID=SeqID_40103; Location=155..758; Strand=+
  SCN-specific regions: Sequence locations=1-42,66-604
atggacaaattggggcgactggtgcagatgtgtgccacgttcccccatgtgaccttcttttggcttccgccgccattcgtccgtgatcgacaattcgaacacgaaacactgatcggcaaaatgcgagacttctttggccaaaagaagaacatccaatttgtggccacaacggcgacaggccgttcgcttcttgaaatttggcgctacggcaacggctacaacactgatcatgtgtcgcctgagggagtgatgaaagagaagggactcaacatgttgaaggcgtggcttttgacgcaagtcaaggaatttccgggtgatcaggagttgggcattgagaagaagaagccggagagtggagagaagggaaaaggagcggggacggcagcagatcgacaacacggccgcaccgagccgcctccattccgacgcgacgggcccgtctttcgccgctcgaacagccgaccgttcgttcagcacccgtactcgcgcaccgccgttgatcgccaccctttccgcccctttcgcacgccgaatttgccgaatcccaatcgccgtcactttgatcgctgaggacatcgctcgttgcaagccgaggatgtgataa

SEQ ID NO: 68536 - DNA, 180 bp, Heterodera glycines
  Genomic contig location: Contig_ID=SeqID_40109; Location=678..857; Strand=+
  SCN-specific regions: Sequence locations=1-35,114-180
tgtaacaagtccaagtacgacgggatcaacaggttcaactatgacgacaacaacaacgacgaccactaccaccaccagcagcacgccaacgacgccaaatgggacgacgacgaaaaattggagcgaatcattagcggctgctgttggcggaaagaccacacttgtgctgatcatcgttgg

SEQ ID NO: 68537 - DNA, 189 bp, Heterodera glycines; identical to SEQ ID NO: 40111
  Genomic contig location: Contig_ID=SeqID_40111; Location=1..189; Strand=+
  SCN-specific regions: Sequence locations=52-53,81-87,114-150
  Gene Ontology: Mol. function=NADH dehydrogenase activity; Cellular component=mitochondrion; Biological process=ethanol fermentation

SEQ ID NO: 68538 - DNA, 1923 bp, Heterodera glycines
  Genomic contig location: Contig_ID=SeqID_8563; Location=478..2400; Strand=-
  SCN-specific regions: Sequence locations=1-328,352-381,403-858,880 -1075,1097-1709,1734-1923
  Gene Ontology: Mol. function=3-methyl-2-oxobutanoate dehydrogenase (lipoamide) activity; Cellular component=alpha-ketoglutarate dehydrogenase complex (sensu Eukarya); Biological process=coenzymes and prosthetic group metabolism
cgaatttcattttatatgaccaattttggcgaggaggtaaaagaaattgggaggcaaaggcgactcattaaaaggccagtcacatgggctcggccgccgcgttggaacttcgagatttggtctacggacagtacagagaagtgggcgtccttctgtggcgcggcttttcgttggaccaatgcatgaaccaatgctatgggaacgaattggacgaaggtgggcgagcaaaacaacacgaaaataaacccgacaaatgctaattttacgcaattacttccgtaaacatttcgaaagaaactgacagtccattgaatgccatctttgccaaattcttttttgtctccttttgctgtgccattttctcctcttcaggcaaaggcaaacaaatgcccgtccattacggatcttccccgctgaatttcgtcaccatcagttctccgctcggcactcagcttccccaagcagttggcaccgcttacgccttcaaattggccaatgcgcaacgatcggctgacgagaaacgcgtcgtctgcgtttattttggggaaggggccgcgtcggaaggggacgcgcacgcggcgtttaatttcgctgccgcattggtgcgaaagaaggaaaattgtgaaaaaaacaaaatttattacagaaattttgattagctatctctctcgaaatcattaagcgttgtcccgttttgttcttttgtcgaaacaacggatttgcgattagcacacccgcttctgaacagtacgcgggcgatggaattgccggcaaaggcattggttacggaatgcacacaattcggtagaaaatccattgaaatgagaattcaattagggggggggggtgagtttgaatttggaaactcagtttggataaggaattttgtgtcaatctttgattagaggagcctaacaattttattctaacattttcgccccggaaatttactaaaaatttttcaaatctgagtttttcataaacagttttaaattaaagaaaccatctctcttaactttaggagaattaaatttgatttaatataattaacctttcgtattaaaattcggttttcaaaatgactttgtttgcctttgtgccttagggtggatgggaatgatccgttcgccgtgtacaaagtcacttcggaagcccgaaagttggccttggagaacaatccggtgatgatcgaagcaatgacttaccgcgtcggccaccactcaacttccgacgattcctccgcttatcggtcctttctttctcttccgctcgctttttggttatccaaaaaaacactgatcagacccatggaagaagtgaaagaatgggccgaattggaccctccgatcggtcgctttcgacggtttttggaacggcgtcaatggtgggacggtgcgttctttgttaggctttgcattttgttaatttgccatttatccattcacaaaaacatatttcgttagatgcgcaagataaacaatgggttggcacggttagtgaaataattgttaaaggaatgaaaaaagtgaccattcccaaccctttggaggttcggcgagaagtgatgaattcatttgcgaaggcggagaaattgaaaaagagagcgcccgaggaattatttgtcgacgtttacgcagaaatcccaaaacaccttaaggtgggggaggggggggggggggggtaaattagcaaagggatgtgccaaagagagaattttgaaaaataaaaatacttttcatttcataatcgtagaaaactacaaaaaaagaatgcaatttctgttaaccatttaaatttttaataaaagggagagaaaggcaaaaagaaattgtcattttgcaggatcaacaagcgcaactgcgagaacatttgtctgaatttggaagcgaatattctcagatggagcattttcaaaaataatct

SEQ ID NO: 68539 - DNA, 1658 bp, Heterodera glycines
  misc_feature (1638)..(1638): n is a, c, g, or t
  Genomic contig location: Contig_ID=SeqID_8564; Location=93..1750; Strand=-
  SCN-specific regions: Sequence locations=1-24,46-120,153-176,198 -462,484-954,992-1053,1075-1100,1150-1366,1388-1398,1420-1520,1542 -1658
atggcctggacctggatccaggaaaaatccaggcctggatccaggtccaggtcgaactctaataagaaatattggaaaacgagaatggcgcaggtaggctcaaaaaagaacaattttgagatttttcttaaatttaatataatgaaatttgttgcaaaatttttcaaaatatactcttctttgggttggtttgttttgaaactaacttttgtccaacgcgataaatgccaggccgaaaaagtatggacgtacccatggggatgggttgcgaattctttaaaaaaagtgccgacactttttccccagcagatacttcccaccgtcacttttctcccccaccaaattcgacttctttatcccccccccctatttttccatttcgaatacctttttggttcgttttttggctgtcccggaccaattcggcctgctctgttcgtattgaagaaagcaaagtgcgacagatcgttcttttgtgtgcaacaaaattgatgatggagcgaaacagcgaccgacaacagctaaaaaagggcgaaatgagaaaagaaaagcccatcgtttctcagcggaatggctgcccatcaccgacctgcactcgtaaataacggaacattcgtttttcaacagatttttcacttcgtccgttcctccctggtaatatcggaccactgactcagccccgtcgtcagaatttgaggcgggaaagttgggaatctgtgaagctgagtcttttgagaaattaagtgacatttctgaaggataagagcagttttagattcattagtcaatcatttgatgacattaacggacggtgagaagaacttctcacaattcgacttggttcattttcgaaaatggcgaattgcgcctttaatttatttgttttacttttgtgacttttcttacttaagcaattctttctgcgcaacagcaacggtacagtattttagaaagaataattttaaattttattttaaatatcaaaaataatgtttttctgttttctaccgtataccgaattcggtgactctcgattctaccgtagttcactttaatttgaattatatgattaaatttttagtttttatgccattaatgagaattttaatcatttttatttaggtaataattttttaattaattatttttggctaaagtttaattatgatgaatttatttaaattccgagacatcgttttattacggaccattgcttttcctccgaattttgtattaaatcgtggaattaattaccgggaaaacagcaccatcggatcaaagcaaagtattggaaatgcagacgaattcaaattgcgcgaatttggccaaaaatacctcggcaaaagagaagttggtctgctaatagaaaaagcaacaaacagttgatggacaattaatatgttatttttatcatattcataagaacttcccaaaaattaatggattcctacaaaaacttaattaatttcagcaatattcaggtgaagttcacagagaaattggaatttcgaagcagtgccaatgaagtgccaatgccaatttaccaatgcattaattcgcgaggagaatttgttgacggaagcgaagagtgtcctctgccgaaggttttaataagaaaaagtccaacagaattctctntttcaggacattgcagttaa

SEQ ID NO: 68540 - DNA, 358 bp, Heterodera glycines
  Genomic contig location: Contig_ID=SeqID_40113; Location=175..532; Strand=+
  SCN-specific regions: Sequence locations=1-358
atgggatgtataaaggcgattgtagaaggaattggaagcgctaaaattgttggaggagcttttggagcgtaattacgattttactaacaccattttttgctaggcttagatcacatgcgattttcggcactctgataattttagcgttcataatgggatgtataaaggcgattgtagaaggaattggaagcgctaaaatcgtttgaggagctttttgagcgtaattacgattttacttacaccatttttttctaggcttagatcacatgcgattttcggcactctgataattttagcgttcataatgggatgtataaaggcgattgtagaaggaattggaagcgctaaaattgtttga

SEQ ID NO: 68541 - DNA, 439 bp, Heterodera glycines
  Genomic contig location: Contig_ID=SeqID_40113; Location=443..881; Strand=-
  SCN-specific regions: Sequence locations=1-439
aaaatggtgtaagtaaaaatcgtaattacgctcaaaaagcttctcaaccaattttagcgcttccaattccttctacaatcgcctttatacatcccattatgaacgctaaacttatcagagtgccgaaaatcgcatgtgatctaagcctagaaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctaagcctagcaaaaaatggtttaagtaaaaatcgtaattacgctcaaaaagcttctcaaacaattttagcgcttccaattccttctacaatcgcctttatacatcccattatgaacgctaaaattatcagagtgccgaaaatcgc

SEQ ID NO: 68542 - DNA, 642 bp, Heterodera glycines
  Genomic contig location: Contig_ID=SeqID_40115; Location=422..1063; Strand=-
  SCN-specific regions: Sequence locations=1-567,636-642
atgggcgaagcattgaaaaatagaattgaacaaattcccgaagaagaaaaaacaaaaggaaaaacaagaggcgaaatattaaaagaaaaaattggggctagtaaaccaatagaggaagaaattgtaggtgtcaaaacacgtggagaatcattaaaggatttaattgtttcaaaacaaattgaaacagtcttatttaaatatttgaaggagcggcggaaattttcaattgattttaatgaccaaagaattgactttattgagttgtcggctcaactcggctacattctcgggttcgaagacccgacaaaaattctgagtggagctatagcaaagtattattgtgacttaaagggtggtatagacagcctttgtgtgtacattaatggaatcactgagaatgtaatagtaggggaccaactcgcttcacttttgcgaattgttgtcgttgaaggaaaatttggagacgtgattgagagtaaaggaaattaacgagattgaaattgaaattaggactagggagggaaggcttattccattccaatggggtacaacattacttgtattagcatttaaaaaatctattgtattttagtatttaaatattcatttttacattatagtatatattaataattgaataaa

SEQ ID NO: 68543 - DNA, 377 bp, Heterodera glycines
  Genomic contig location: Contig_ID=SeqID_40119; Location=288..664; Strand=+
  SCN-specific regions: Sequence locations=1-2,25-44,97-171,206-224,265- 294,320-377
atggaatatctgaacaaaacgaatgaaagactgaaggcgacgggtaaagaaaaaaatgaaaataaataaataaataaaaattaataaaaatgacaaaatattttagcatattattaccgccattcaaagactgctttggacgaagttcagaagagaatcgccgtaatggaagtcatcgtgggcctgctcatctttctgattttcacttcgccatttgcttattatttttcgttttagccatttaatttatcatttttatggcaatctccttaaatttgctaccttaacaaatcacttttcttttgtctctcttttttatgtaactcattcagctaaaaattgaaaaaaatgaaatagtctctccaagtgttttttaa

SEQ ID NO: 68544 - DNA, 748 bp, Heterodera glycines
  Genomic contig location: Contig_ID=SeqID_40120; Location=1..748; Strand=-
  SCN-specific regions: Sequence locations=1-46,80-91,121-152,174 -303,325-426,459-513,535-580,602-616,639-748
  Gene Ontology: Mol. function=GTP binding; Cellular component =cytoskeleton; Biological process=microtubule-based process
aagagagaggtggtttctctacacataggccaaggtgcactaaatcaatttataattaattaaaaataactattaaaaagcgggcgttcaaattggcaatgcttgctgggagttgtactgtctcgagcacggcatcaactcagagggccgatttgtggacagtgaggagggtccggccgacaattcagtggacacattttttgccgagacgcgaattaagcataaaaataacgttttaatgtctttaattgtttcagataaatacgtgccgagggcgttgttcattgatttggagtcgacggtaattggtaagaagaataatttgggatcaaatcaattaagaattaattaggggaattattagacgaagtccggggaggtgcctacagacagttgttccatcccgagcaactgatcaccggcaaagaggacgcggccaacaactacgcccgaggccattacacggtcggaaaggagctgatcggagtgtgcatggacagaattcggagtagtgaagcgaagaagggaaagaacggcattccaaccatttaagaagtggcggagaactgttcaggccttcagggatttctcctgttccattcgtttggcggtggaacaggcaaaagaatggcacaaaacaatgccaaaggcaattattaccaattaggaagcggattctctgcgcttttggccgagtgtttgacggtggaatacgggaagaaggccaaatggaattttccattatccg

SEQ ID NO: 68545 - DNA, 1273 bp, Heterodera glycines
  Genomic contig location: Contig_ID=SeqID_1141; Location=440..1712; Strand=-
  SCN-specific regions: Sequence locations=1-14,178-381,409-818,840 -1233,1256-1273
atgaagcaaagttaaaggggaggcgcgaacgccgtcccccgcactcaaaaatttagctgtgggcctatcccagttcgggaccgccctgcgggtcagccccgaccgaaagtgcaatggtggagcctcgccacaggagccctgccttggtgatcgcaggaactccccagccaggtaagtttaaagagcagcagcaagtccaaaggacaggccgtaaaagaggggaaggggagacggggtggaaagatggggagagatggatagaaaaagggatgaatgggtactctctcccaatgactactcgtctcttttcacaatgatacgtgtgctttttccttcccatgctcgtctgtcacttggataaaatattatgcactcttttgcacgctgtctttttcttttccttagaaagaacaacagcagcagttagagattatgatgcacaggatggcaaaaagagggaagagaccatgagagaaagaaagcaaagaaatgagagatgcaaaggaaactcatctcaattctgatcaatcattatcgggttaataaatacagctttgttgattcactgctttaaaaaacccacaaaaacccaaacaaaaattaaggaattaattaaggaccataccctaaggcaaataaaaatgcataaaagatttatattctacgaacaaaaaatggtttattcatatgaaaagcatttttttatttaaaaaatccaacaattaatttgtacccaaaaatttattcatttgtcgacatttcaaacaaatttcatataataaaatttagtgtggactggtaggatacggtttttgagcacattttttaaaaattagaggacaattagtgtatagtggtgccggcaggcaccgccccagaaattttggaaaattaaaaaaattatgacctggtttgatactgcattttacgaaaaatgattgatttacttgtaccaaatcaacaataaaaaaatagaaatctagtctctttctcattttgaactggggaatatattttaactatttttagcattgcttcacagcccgcggcaaaacttcaagcagtccaacaacaacaacacccgcctcaccagcaacggcattgcgacaacacaccgactacgccagcaacaagcgcaacaagttttatggcgatgtcatcggcaacacctggcacccgaaactgtagcaacggcacttcacaatgttcgatgagcatggcggggagcacagcagcagcaatgggggcaccagtgatgaccatcacttatcgg

SEQ ID NO: 68546 - DNA, 1149 bp, Heterodera glycines
  Genomic contig location: Contig_ID=SeqID_1141; Location=2982..4130; Strand=+
  SCN-specific regions: Sequence locations=1-46,70-181,203-1027,1057 -1067,1089-1149
atggctctctcaccgccaaatttgcctattgaactgctccgtcttctgctcctcctcctctttgtcttcacttcaactgtctgtggtaaaaataatttcgacggaaaattattgtggggcataagttagctgggaaattcttaaaaactgtcacattttggcattgttcggtcggtagccatgagtttcctctattaaacaaattttgaaataatttataatttaccaatgctaattgagaaaaataacaaaatttgcatgctcttcagcaagttttgtaaattttttttgcagaaaaacgatcaaattggctttttttgttgttaaccaaatccagcagtcttggtatcaatcgaaagcttaacatgtttagaagatatttctaagctattgcttcgcgattagacaattaccaaaaaagttataacatgaaattccaaaaaagtcgaaatttttgagtttttttcttaataacttttttagaagctaaaatttttgtttgttttttgtaaggctaatagagcttctgaagggctttcgaatgataccaagattgttagatttggtcaacaagaaaaaaagttataataaaaaaactgaggctggcgccaaaacgtcggcgccaaaacgacccagtaattttaggcacaaattttgtccccaaatgacctggacggacttgagcgatcaattgacgatttcaaagtgtttttggcagagcaggaccggatgagtgcctttctctcaaagaaacccaaggcccatcttctactcttccactttgtgccatttgcacgacaacatcaattcattggccttttggatgagcagggtgaaaaataaattgcttaattagcacaaacttttaatattttcaaggtgatgaagcgcttcattcggtgtggcgaagactcgaacaatggtggaaatgtatgcctgacgcggaacaaattttgcaacaattggagcaccatttcgtcaacaattggctgctggacaccggaaggattgacgaattgaagcgggtttgttttttcaaaaggtttcccttttctgaattctcatctttagaattatgaagaaaggaagggcgaggatgacacggatgaagaagcggcggaagaaattgattacgaatgccaaattgat

SEQ ID NO: 68547 - DNA, 485 bp, Heterodera glycines
  Genomic contig location: Contig_ID=SeqID_1143; Location=1..485; Strand=+
  SCN-specific regions: Sequence locations=1-357,378-485
tttcagttttttgttcaaagagcaccgctttgacgagccgttggacggcgcgcactttcaatggacagccatttacgacgacgacagcccattttttggccatgggtttggtgactgtgtatggtttaggtgttaggaccttgagaaggagaacatgttcaaatcggactacgtgcgaccagcgggaattaagcccaggggccgacccaaacaacaaatgccaaatttattgctgtaacaatgccaattctgtagtaacagtacaccaccgtctgctcgtacttttccgttttggggatctgctgatcggcgcccttattcggacaaattcatttttacggtggccatttttgtcggtaattaattaattaattaatcagtggtaattaactcattagccattcattattcattgctaattttaagcactcgttgccagttggcactgaatgattgacagaaaagaagcaattgttgtgatgata

SEQ ID NO: 68548 - DNA, 397 bp, Heterodera glycines
  Genomic contig location: Contig_ID=SeqID_1144; Location=439..835; Strand=-
  SCN-specific regions: Sequence locations=1-397
atgtgtgaaaacttcttcgacgcgtgcgcaccgcacgcgtgggcatgtctgacgcatgagcacatgcaatacgcgatgatgcgcggcgccgcgaggggggcagagaagcggcacggaggagatagcgtacaacgacagatggcagagcagcaccagcagcgagagagcggacaagagggagagtgcggcggcggcaaagaagcagagtgccgcgcgtttgcgctccaattggtgcacaaattggacgcattggcatacaaaacggcggaggggcagacaactgaagcggcagaatgtgacgaggacgcgtgcgacgccgcgggcgcggaagcgtcggtgacgcccgaacgcatgtgcgcgtggatgcaattcgcaagtgcctacagcgggctcaccg

SEQ ID NO: 68549 - DNA, 651 bp, Heterodera glycines
  Genomic contig location: Contig_ID=SeqID_8567; Location=701..1351; Strand=+
  SCN-specific regions: Sequence locations=1-160,182-651
acacaagtgctttgcaaaggtcggcagaaaattggtcttgtttattttcttttgttgtcaaaaaaggctgatgctgaatgcttttctttttcgaaaatcgatccaaattcttgcgatgttttgccgtttcattgtgttgctttaaatcccagtattgcgaacatggaatctgtgaaaaatcgtcatgttgctgccgttgttattgcaagtcgtcgttgtctttacctgctgttcgcaaacttgacaaaaaattattttgccattgtcggtataaattgctccgccgccaatttttctgatccagtcacgaataaatgcagattttgattgaattttgggcattttagttagatatttcctttaaaagtatggattatttggtatatttgaagaaaattagtgaattttccttttgtaaattaaaaaaatcgcgaaataagggcgaaaataagggtgaaatgtcaaaataagggcaaaaacttattttaagggcgaacacccaaaataaggatttctaaggtcgaataagggcgttaaaacgcaaaatttttgaacaaaaaatgtgtttttcgtgcatttctcgtcgagttaaagccgcagaaaaaataaggaaaaacttaaaaatcccatccctagtaatgagtgctctta

SEQ ID NO: 68550 - DNA, 438 bp, Heterodera glycines
  Genomic contig location: Contig_ID=SeqID_40122; Location=364..801; Strand=-
  SCN-specific regions: Sequence locations=1-438
aaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtcaagtaaaaatcgtaattacgctcaaaaagcttctcaaacaattttaacgcttccaattccttctacaatcgcctttatacatcccattatgagcgctaaaattatcagagtgccgaaaatcgc

SEQ ID NO: 68551 - DNA, 548 bp, Heterodera glycines
  Genomic contig location: Contig_ID=SeqID_40125; Location=356..903; Strand=+
  SCN-specific regions: Sequence locations=1-136,158-548
atgactgaatacgttaattatgacgagatgcataaggcaatggaaaaatcatatggaaaattatgcgaacggaattacatcgatttctctgaattgccggtgagtttaaaaaaattaattaattgttccatcaaccttaattaatgttatatctagggttggtcacgaccggttattaaccggtacccccggttttcggttatgccggttttcgacccccagtttacggtttcggtttttggcgcaaaaaagccgggttttggttcgatgaaattattagaggtgcaccgtgacccacggtcacgattcacggtaccaattcacggttattccgtgaaaaatttacactggataaattgaaaatttacgaattacatattgttttcatagagaaatttggtcattttttgggcaaagttgctaagaaacagagcaaaattttcaataatttcccccggcggcgcctatcctatcggcaccgccggctccctcccctattcctgaaacttttttgaacaaagccaactacctatattggagaggaacaa

SEQ ID NO: 68552 - DNA, 785 bp, Heterodera glycines
  Genomic contig location: Contig_ID=SeqID_40126; Location=88..872; Strand=+
  SCN-specific regions: Sequence locations=1-38,60-119,141-785
ctgatcatctgctgcagatgagtgagtcatcgcccctttctccgccggcggaggcggcgcatccaatcgccccgggcacacttttccaaccgatttccgttgccggcggcaacaaccgcaactccaccgggtccacgaacagcagtcaagcaagttccggcttcgaaagtgccaaagtaggcccaatgaatgccaacgggcacacattgattgacgtccctcttccggattcagagttccagttcgcaccatttggcaacttcgaccagttccggcagttgttcatccggcatcggttcgtcgaccgctgcagctgtcctcccccattgttccgtctttccccccaacgcttcgcccgaagctcccgccagcgcttcctcccgcctctcttccgctggctcttcaactcattgtcgttcttccgcttacttttccatctccgatgggttggattcgtcaattggccctggcgggactttgacagtccaaaaaaggacaaaagaaaaatgcccccgagtaaatatcaccgaaatgatggccaagggcataccggtaatatccaaccgaaggctgttaaatttataatgggattaaaaaaggaggcagagatttatgctgagtggcttcaaaggctgtgcctttccgagtatttggccctgtttcttggccagggctatgatttgccgacattggcacggtcatcgccggaggatttgacaactttgggcattacgcggcccgaggaccggaaaaggcttttccaagacatccagacttggcgaaat

SEQ ID NO: 68553 - DNA, 610 bp, Heterodera glycines
  Genomic contig location: Contig_ID=SeqID_40128; Location=131..740; Strand=-
  SCN-specific regions: Sequence locations=1-265,291-338,360-610
atggcactatggctgagttgttgttgtgccatcatcacctttttcacaatggcaccgctgattttacaatggcaccattgcgaggcagcatatgatcaggaaatctttgacactatccaaatgatccacatctgccagtttattcatgaccacatagcagaggagggcgaagtcgaaaatattgccgtcattacatgcggcaaagaaattgaggtaatttgtgagttcccggctaattaattagtgtattaatatgttttttcgcaaatataataataataattaaaaaaggccaattcaattaataatttgattgacttaaataaaaagatagaaagttttgatttcgacattaaattacgaaaatttaaatgtttttctatttttttaagccaatggcgaaattattacgtaaccaaaccgaaaagtatttgatttaatgggttggcccaatttcatgctgctcagcaaaattggcaaaacaaaaaaaatctgtttttttttgtcttgatcgttttggtttttgatcagagccgagtttccttctcatgactcgagcccacgaaatgtttcgcgaatgtacattacaaaaatactaggcataaataaa

SEQ ID NO: 68554 - DNA, 728 bp, Heterodera glycines
  Genomic contig location: Contig_ID=SeqID_40131; Location=6..733; Strand=-
  SCN-specific regions: Sequence locations=1-31,54-250,288-728
atgtctggttcctattttgttttggccgaatttattttggccatcattttccactcggttgcaattgtgcaaatctttctgctccttcgctcaaatgtgcgcaagaatatttcgttattcttcatggcattgttgatcaattggttgtgtgccgcacttttgctgttaccatatgaaattcatgcaatcattatttggcacccaacggaaggtgatcactgatcagtgaaatatgtttaaattcaaagtctccaaaatcaaccattaaaatattaaaaggcaaaatgctaattaggcaataaaactacgcatttgcgtgcaattaggcaataaaactcctcaaattagggtgaaaatttttcatttttccgattcattatgaaatttaacaaaaatttgtttattgattgtgtttttttcatttccaattttaaaactgatcaatttttgtaactggaccgttttgtgcaaaaaatctttttcaggtgtgctttacgatggtgccacacttttcttcatagcgctttcggcacatttgctgctctcaaccatcccaatgtccgtgtttttcatgaccattgaccgaatttgtatcatatgctttgagcataattatggctctcagatcaagcgtgtgttaaaaaggtgcttccttagcgctttggctgttggcattctgttcaacttcatcggaatgctctcggcaatgccggtgccaaccaacacgg

SEQ ID NO: 68555 - DNA, 934 bp, Heterodera glycines
  Genomic contig location: Contig_ID=SeqID_8569; Location=82..1015; Strand=-
  SCN-specific regions: Sequence locations=1-343,365-541,580-688,710 -775,798-895
atgaatggggaggacgacggagcgagagacgcggagggatccgctgggatggtcgaaattgaacaccccgacgacgaaaaattgccaccactcgtcaaaattcaggtaaaatgacgcgcaaaaagcaaaggcaattaaaccatagaaaatcggaaataagaaaggatgtgatatccttataatttaggcccgaaaagtgaactgcaaaacatccgagggacaattgcatttggtggattggtatttgagtacgtttgttttaaaccaaatgaataattaattgttagttggcttttttgttttagtgcaacagagcaaacatttcaagcggatttgggaggagcacaaaagcaaaaagaaagggaccaatggccgttcccgcaaattcacttttcacatggaaaacattgacgcggagacatttcgacgtgttttggaatggcttgttgatcatgacggtgaggttattaaggattattaagttgtcaatggttgaccaatcggtactttttggggcaattgtgaagattattggtcccagaaaaaaaagaataaaaatttaaaaaaaaacaatttttaggggttatttgatgcgctgagcacgaatatcacatccatttcgaccaatttcgaaccaggacccgaatacgaacaaaaagtcgaaaattcaatttttcgatttcgcacttttattctaaaattgattaaaactagcagaaaataaatcacatgtaattttagcggcaaaaataagtcattttatgtagattcgaacatacataaagtaaaaatttaaattttcgactttgttcgaaatctggtccggggttcgaaatggataccttattcgtgatcagcgaccttgaaaacctcagggaagacttttatttagatgatttttaaaaaataatttatttttaagtaaaaaaataaa

SEQ ID NO: 68556 - DNA, 602 bp, Heterodera glycines
  Genomic contig location: Contig_ID=SeqID_8569; Location=4128..4729; Strand=-
  SCN-specific regions: Sequence locations=1-602
  Gene Ontology: Mol. function=growth factor activity; Cellular component=extracellular; Biological process=cell-cell signaling
gcgcccactcggcccattgttgccccgcgggatttgcgtaatgacccgactaattaccaccaaatctttttaatgaattgatttcggatgtgcgcgggaggaggaacggtgtgtgagtgaacagaatggcatttccctttccacccaaatgttcccgacgcaccatgcaacaaaaagagtacaaaaactggcaaaacttaatgtaataaaattgcaaattaatattttagcgtttccacggcacaaaaatgccaacggaatgccccgacggcactttctgtggttcatcgacggacatttgctgtgcccactccctcccgacaaatgaaggcgaacaaacgacgaccttcggctgttgtccgttgagcaaagttcgacagacaaaaaacgaaaaaaaaagacaaatccatcaaacttagggaatttgctgcaaggaaagccaaaagtgttgtccgatgggttacaaatgttcagcggaagggtgtgaacgaatggaagtgagagaacgaattgtccgtttgtttttggacaaaaattgaaacgaaggaacggagagaatgcaaaaacagacacaaaaagacaattgattaagcagtcaaaaa

SEQ ID NO: 68557 - DNA, 256 bp, Heterodera glycines
  Genomic contig location: Contig_ID=SeqID_8569; Location=5120..5375; Strand=-
  SCN-specific regions: Sequence locations=1-256
gacggaagttcgaagtgtcctccccgtgcccacgtgttgtccgctcggcgacggattcggacgccgtcgaaaagacttttggcgactcgaaactaacgctcagcaaagcgtaagaagctcactcattggcatccttttttcatccgttttcgatatcctacggctgctgcccagctgaacgggccgtttgttgcgcggaccacgtccactgctgtccccacgggacgcaatgcaacgcgagggggggcgagtgcga

SEQ ID NO: 68558 - DNA, 671 bp, Heterodera glycines
  Genomic contig location: Contig_ID=SeqID_40133; Location=44..714; Strand=+
  SCN-specific regions: Sequence locations=1-74,110-287,309-523,549 -589,624-671
ggattgagtgttttgttgaagcgagatgggggtgctgatgaggacgacgaagtcgtcaacactcagccacgtcctcccgcccctccccctccacctccaccaccacctcatcacccatctcaacaacaccaccgtcgccctcccagccttcccgatcagcaatcttcctcatctgacgatagtcatccgcctcgtcctcctcgtccaccacgtcctcagcgaacaaagaaaaaccatcaatcttctctgaaacatggtcgtttgaaccaatggcagcaaaggcgtcgtgacttacaacaacaacaaccggtagtacgtgatctcctcgctgaagcagcagctgctccgttacctgaaagtgacgatgaacaaatgctggaaggtgggtatctgctgccaacaccatcacaaaattatggagacataccagtattgcctgactatgcagatgaaattgaggaaatggacaccgcccaacaaagacttgcaagcagaagaaagttaaaagaggagcagagactagataaaaataaaaaatataaaatttactattcccctccaccatctcccacactaccacccgtgtacaaacgaccagatcatcctcctccacctcctccgcctcgttctatacccaaagttgaactgaaaagggatccacaaccaacaaa

SEQ ID NO: 68559 - DNA, 957 bp, Heterodera glycines
  Genomic contig location: Contig_ID=SeqID_40135; Location=99..1055; Strand=-
  SCN-specific regions: Sequence locations=1-406,522-617,640-870,892-957
ctctgtgcctacccggtggagaagaacaccatccggccgcgtgacctcagaaggtttgttcatttctgtttaaatcccgctaaattctatgtaaatttggaatgtggaaaaaatgaggccgaaaaaaggctgtccgtcacacggacaggagaggggttgtcccggaagcaggacaaaatgccacaggcgaaacatcatagctgtaatagcctaatcgaaaaataattttcttttcgaatgagaagttttatttctaaaatgccgaatttccaaaaattttgaaaaaaatttttttacgatattgttatatctatttttggttaagggtgctcggcaactcactctgggaattaaaccacccagaggacgccttgtacgagtatgaaaaggctgatgagcagccaggggatgaagaggaagagggggaagaggcggaagaggaagaggcggaagaggatgatggcggcgcggcggagggaagtggggaaggagaagaagaaggggaagaggaggaagaagagccggaagaagagccggaaaatggccagagatttgattatgtttttaaaaaaaaaacattttgatttgtgtttcgttttttttgttggaaaaaaaatttgttgttgttgttaccacaatcggaattatatttggttttgtggttaatggaagaatttgcaagaaaaaagaagttaatctccccccgtccatcaaattccacatataaaatctgctcaaaatttgcttttgattaacccatttttagcgcgcgtttgggtgttgtaaatttcttatagcctcgctctataaaattgttttatttgcctaaccattttccacaatgcgcgcccgctgtcagtccgtccaccactcggccaacaactgctgctggtcatcacacgctcggacgccgcgttaactgtcggaaaaaatatttatgtaaatttaggaaataaa

SEQ ID NO: 68560 - DNA, 411 bp, Heterodera glycines
  Genomic contig location: Contig_ID=SeqID_40136; Location=162..572; Strand=+
  SCN-specific regions: Sequence locations=1-350,381-411
atgaaaattggtaagatccaaataccttaaaaaaagaaaataaaaaatccaaactttttaaaatataggaaaaaaagagaaattggtcattaaaatgcagcatttctgaaaacttagcacacaaaaattgatctttagctattttaggcacatttttttttaaaacaaattttaccctaatttgcagaaaatgataacgaaaaatgtcgtttttgtagatctgtttttgaaaattttaagaaagccaacccggaacgagaatggctctcgagcctgagatgataaaatgccgagaatttctcgactcaaaaaccgagaatctcacccatcatcatattaagctccccttcattttaaattataaatttattaaaatatttgaaaattctatcttcatgtaatctgattgga

SEQ ID NO: 68561 - DNA, 227 bp, Heterodera glycines
  Genomic contig location: Contig_ID=SeqID_40139; Location=1..227; Strand=+
  SCN-specific regions: Sequence locations=1-227
ttatcaaaaaaaggagatagccatttttctgggataacctataaaatataaaatccttctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 68562 - DNA, 304 bp, Heterodera glycines; identical to SEQ ID NO: 51570
  Genomic contig location: Contig_ID=SeqID_40139; Location=304..607; Strand=+
  SCN-specific regions: Sequence locations=1-304

SEQ ID NO: 68563 - DNA, 209 bp, Heterodera glycines
  misc_feature (152)..(152): n is a, c, g, or t
  Genomic contig location: Contig_ID=SeqID_40139; Location=936..1144; Strand=+
  SCN-specific regions: Sequence locations=1-209
aaaattccctcaaaaataaaaggtctattgcgcaccgccctccctatcatgctcgagagcatttgtatgtgtataaaatttatcaaaaaaagagatagccatttttctgggataacgtctaaatataaaaatcctctgtgaaataaaatggncgattgtgcacagccctccgtctcatactcaagcgcttttgtgaggtataaaatttc

SEQ ID NO: 68564 - DNA, 2517 bp, Heterodera glycines
  Genomic contig location: Contig_ID=SeqID_8570; Location=372..2888; Strand=+
  SCN-specific regions: Sequence locations=1-1642,1681-1853,1882 -2109,2141-2517
  Gene Ontology: Mol. function=zinc ion binding
atgggtctttgtaagtgcccaaaaaggaaggtcacgaatttgttttgcttcgaacatcgcgtaaatgtgtgcgaattttgtctgctttcgaatcacgaatcggtgctcttttttattctttcttttttgcttaatgctcttttagtgtgtcgttcaaacgtacctttcttggcttaccgacagtgattatgatgccaattgtttgctctgtttcggcatgtttttgttttttatttttttagctttgaatttcagaatcgcttagctccaaagagacattgaggttgaggtgtcttcatttattccactgggactgctttgattcgcgggctcgtcagttgccccaaacgacggctcccgccggtaaattttgctgtgaatggattgatttgactttatttaatcccctctttcaggttacaaatgtccgagttgtttggtttgtatcattttgtatcaattgcagtttgtacgaccataaaattaaataacattgtgcttcctaaagttatgaagagttaaaattgttattttattttatgatcagataactgtaatagagccccatttagacatttcatttaacttttttttctgtttcaggaatgcattttcccatccgaaaaccaatcgtcaccagttgttgacaaactcagggccaaacttcagacagtcaattggggtcgctttggtcttggccttcccagtgtttgtttgatataacatacctattttaattagttatttaacacttacattctaatagagtttaaatttaactgaaattcaaatattattttagtttttccttttgtttttagatccccgaaaatgagcaaaaagttttggctgccaaagtcattgaaatcgcttcgaattctaatcaccgaagcgatgaaaatgtcagcaatcgtcacattgaagctcacacacagtcgccaatgatcgccaattctattacttgccatgaagatccattcgaagcgaacactttcactggtaatcattttgccagaaatgaaaatgattttttatttttagcgaggtccaaatttcccacgaattcaaatggcaattcttcgaacagaatttttatcggtaatgaggacgactcaaaatatgcgaaggctgctgcggcagaaaaaaatattcggtcagtttttttaaattgaaaatccgcattaaaatagcgaatgtgcacgttgcacaaattgaatgcctaaatttgctcaattttcgttgtttttaacagtgttttctcttaggaatcgcttcgttcggcttccccgtcctctcaaacgtgtgttctttgccttactcgtcatcgctttcctttacttcttcctcggcttgtttctcaccggcaatgactcgtctcgtggtgctggcgatgatgaccctttgttcgacccccgcgccaatccgaacataaaagtggccaaagaacggtgataaaacatacgagacaataatttattaatgggacactttttggtgaatcgactgttcaatatttattatatatgaaaccaattatccttttgcttggacgtggggaacggatttgatccttttttaattgtgattttgccgtaatattttttgattagaaataaagagattgtgagtagattttatcatgaataaaatcaattaaaattaaataaatacaaatttttacaacaatattttatcactgtaaattcactgctctgaacccggacttaaacccaaatagaagaccaatggttaaagccggatctgggattcgtaattataccaaatggagaccccaaaaatagcccatttaattttacatttttttagacataaaacccttttttctatgtccgcccctctctctgtctttctctttgtcccgccaccgtcgcgcaccaccgcgtggccatcacttggaatgattgtccgatttcattttcaatttgctctccgtccaatgccacaaatcctcccatttccggcgctggttgaattcgacacgctttcacaggcattacctttagggtgggttatttataagtaaaaactaagatgagagaacctcaaaggccgggtcttccaaatgagcagaggaatttatactaaaattgacataaaaacaataataaattttgaaaaaataccttaacaaaattcgggccatgtgtgctcgggaacggagattcttccaacgaacaaacgaaaggtaaagcaccgcttcttgaggtcgggcggagggaacaaagggaatgtcggagcccaaatgagagagggcggagaggaggacgaagcagaactcgcctggagggaggcaattagcaatcagagcagaagctacccaagacgaagaattaccgtcaattgtgagccaatgggacggaattggctcgttcagaggcggcatctgccaattaattggactattcgtccgttctgtttatctatgccatgtaatagtggttaatagtggcacacctgctcctcctcctcctcccctccggcatcttccttcccctc

SEQ ID NO: 68565 - DNA, 872 bp, Heterodera glycines
  Genomic contig location: Contig_ID=SeqID_8571; Location=34..905; Strand=-
  SCN-specific regions: Sequence locations=1-478,500-872
atgacatttataaccagacaaacggaggaaccgatgagaacagcaaagggagaaaagggacaatggcacggtcaacagaagccgagacgaactttcgacacagaagcgagacgcactctcgacacagaggcgagacgcactctcgacacagaagcgagacgaactttcgacacagaagcgagacgcactctcgacacagaggcgagacgcactctcgacacagaagcgagacgcactctcgacacagaagcgagacgcactctcgacacagaagcgagacgcactctcgacacagaggcgagacgcactctcgacacggccatgcaaattattgctgccattagcaaaagtctgcccccaactccacctgagtctgctcgcaaaatacggcacccaacacaaagtccactaaaggggcatttccaagtcggtcattcgacgaccattccgaaaccatttcgactcgcttccaggtgaagtgttgaaaatgcataaaatggcattttgaattaataaaaaggtcaccggtgccatgccgattcgctaaaaggcatttggaggcgatgttggaggagcggaggcgaaaggaggaggcggagaggaggagggaaccgttccgagcaaagccagtcccccaaagcacttatcgagcggattcggacattcgcatcggacagctgaaaaggaagcgcactctttcactgccggacaaagcgaagcagcaaaatgtgccaatgcgaggccaatcggtgccactttcgacgtacatccgaccgaacagcgcaatggaagagacgcggaagttgcggagacagcggagggcagtggaagaactggcgaaggccacagggccgagaggaatggaagtataa

SEQ ID NO: 68566 - DNA, 631 bp, Heterodera glycines
  Genomic contig location: Contig_ID=SeqID_8572; Location=102..732; Strand=+
  SCN-specific regions: Sequence locations=1-177,199-575,597-631
  Gene Ontology: Mol. function=enzyme inhibitor activity; Cellular component=cytoplasm; Biological process=protein folding
atgtgtggaaaagcggtggaagttggacgagagaatcgggcggactatgcgctggtggcaaagtgcgtaatctttataaataattgctgatgggggttaaggcgggtaataattgcctttctggccccataaaaaggccgattttgagtagttagttttttttagggcgctgatcacaaatctgacaaccatttaaaagcttaggaatttgcctgtgtgttaaagcctttgttatttttcgcttttaagggcttacgctcgaatggcaaacagttacaaaatgaaggacgaccccaagaaggcactgcacttctacgaaaaggcattgtcggaacatcgcgacccggacattgtgaagaagcacaaggaattagcgaaggaagtcaaagagatggagcagaaggcatacattgacccggaattgtcggataaagaaaagaacttgggcaaccaattgttcaagaaaggcaagcaatgggagaagggacgaaaacattgggaaggaaaccaatccgaaattgggaatggcaaatcaatggacaatttggcgttgtgtctttaccatttcatcccttttaaatttttgaggcgattaccccggggctatgagacattacaacgaggcgattaa

SEQ ID NO: 68567 - DNA, 67 bp, Heterodera glycines
  Genomic contig location: Contig_ID=SeqID_40142; Location=464..530; Strand=+
  SCN-specific regions: Sequence locations=1-67
ccgggactcaaatgtcccgctcaggccaaaaaatttttctatttccgggaaaaaatcgaaatttttc

SEQ ID NO: 68568 - DNA, 317 bp, Heterodera glycines
  Genomic contig location: Contig_ID=SeqID_40144; Location=683..999; Strand=+
  SCN-specific regions: Sequence locations=1-118,145-152,174-263,285-317
atgcattttaatttcaatcatcagaaactgctcaaatttgatgtccgtccgcattgggccaagtattatctgatgaaaccttgccaatttctgcccaattatcctcgccttgaggaatttaggtaaaaaataaaataatgcatgctaattacttttatatataaatgttaaaattgtaataattgttaattagccactgtgcataagaaaattatttgcagacaattggcagaagcaatggacccagcgcataagtttcgaaacaaattcataaaagaaaatgtttttaatgagatataagaaatggaaatgtacca

SEQ ID NO: 68569 - DNA, 768 bp, Heterodera glycines
  Genomic contig location: Contig_ID=SeqID_40146; Location=411..1178; Strand=+
  SCN-specific regions: Sequence locations=1-21,44-64,86-172,194 -528,550-768
atgcttccaataaaattttgctttttcaaattatttctttattggcaatttacgctgattctgagccagcaaatttcgtccaaaaaagaatgccgagaatttgaacagaatttattggtattgtttggaggaaataaagcattttctggtgccattgaatttgaaccccttgaaaaatggaccaaagaatgtttcgctgattggttttgtgaaaaaatcaaaacaaaatttgaaaaaagtgctcaaattaatggcgaaattgaggaaaaaatgtcaaaaatgcaagccaaattttgtgaagaaaatgaaaaaggaaaaagcattgaaaaagcgatgaaaagcgttgaaaaagaaacggaagaaataatccaaaatatgaaaatcgaccaaaaaatgcaagaaaaaatgcgaaaaattatggaagatggcataaataaaaatgcattaatcggagagaaattgaaaaaaataatggaccatttcaaaattcaatcattttcggatttgataaatggtaaaagcattagttttggatttattaaccttcaaattcaggggtatttcaaattttgttcggtgaaacggaaaaaatcaaacgcagtcattgataaagcacaaaaggtacagaatttgtgggttttgtgattgattcttgaacagaaatcacaaatcaccttttatttcggggtttttgtgcctaatgtgcctatttcgccatttttggcccttttttcaggattttcagaaaaatccttaaacaaaaatgca

SEQ ID NO: 68570 - DNA, 263 bp, Heterodera glycines
  Genomic contig location: Contig_ID=SeqID_40148; Location=832..1094; Strand=+
  SCN-specific regions: Sequence locations=1-42,64-146,242-263
atgaaagtaagaaaatgaaaattttctttttttaaacatattttcagggaagggggaagcgtagggaacgaactgctccaccaattacccaaactctgtttgtcataatcgttctgagtcgatccacaaaaaaaactcagtgattgataaaataattaaatttaattatataaatcgatgtcaatgaatttaattatacgattaaaatttaaacataaattaaaaaagaaaatataaatttcaccatttaaaatgcttccgaa

SEQ ID NO: 68571 - DNA, 750 bp, Heterodera glycines
  Genomic contig location: Contig_ID=SeqID_40149; Location=223..972; Strand=+
  SCN-specific regions: Sequence locations=1-296,318-356,379-635,657-750
  Gene Ontology: Mol. function=sodium:chloride/potassium:chloride symporter activity; Cellular component=mitochondrion; Biological process=transport
ataatgttcgtgctgcattggtccacttcgttggtcacatttttcgtgttcattgtgctcttcgtgttcatcaagcacaacaaatcgcacatcaattggggcacgtccaccgaggcaaaccgttaccggcgcgcactgaactcgttgctgaaaatttcgcgcacggaggaccatgtgaaaaactacaggccccagttgttggtgctgagcgggaacccggtggcccgtcaggtgattagcatttcgaaggacagacagaccaactgctgattttcaaggacaagggcggggagggggatgttcaggaaattaaggaaaatgatatacggacaatttgtgcaaaatattgggtccccccaaataatgaaaatgtaacaattattagggggtataattaagagaataataaattagtcgcaaattattaattggaccaattcagaaagcttaattattagtatgggaataaattgcccggtgggtgggactcaaatataaggaaggcctcaaaagaatggttgttacagggagtgtgcgactccctcaaaaaaatttcggaaatcggaattccggcggctaaaatttcgtccatcgtatatcggaattccgagcccaaaattcggaaattggcaatcggaaatccgcaccctacacatccctgctgtcttaattgttttttcaaaattcacctcaggcacttgtcgactttgcctactgtatctcaaacggtagaagcttgcttctgtgtgg

SEQ ID NO: 68572 - DNA, 1569 bp, Heterodera glycines
  Genomic contig location: Contig_ID=SeqID_8573; Location=1..1569; Strand=-
  SCN-specific regions: Sequence locations=1-145,175-688,710-1368,1416 -1569
  Gene Ontology: Cellular component=integral to membrane
gggatgggatgttcagatatggcattctgacaattgctgcactttgtcttacgtcaatttcgtccaatatgatcgcatttaatttcacccaaattgtgatgagaaggaccaattgggagaacgcgtcctttcccaagaattcgtccattttgctgaaggaaagtgacgtgcatttgaaggtaattagtggttggagtgatcaaacggggaaacaaactgatcaaaaaaattgaaaaatgaacacaaaagactgatcagccttgaaagtggaaaagattgatcagtaaaacatgagaaatcgtatgaaaaatgagactgatcagagccaatgatcggtcagtgccaaaaaaggaaaaaatgccacctctttctgatatgatatcccaaatttgccatcggtctgatcaacctccactctgttgtcaggaggacgtgctgcccgggctcgtgctgaacagcagccacgtggtgcctccgacggtgccctattcgtcgcgggaaaagtcggcgctgctttacgctgtcggcgcggccagcatcgtcagcacttttccgttcagtgccctgtacacgcgcttcggcgctcgtttcgtgttcttcggcgccggcgtcgccagtgccgtggccaccgcacttttgccgttggctgccgcccgcggcatgaccgcctttctcctcgtccgcttcgtccaagtcacctccccccataacccactttttactcccatttctttttcttgccttagggatttgcttacggcgcaaatttcgcggccattggtttcatttgccatcggtgggccaatctccgccagcacggactgtttctgtataaatgaaacagcaaattcactctttgctgccccttttcagctcttgtatgaccagttttacgcctctttcccaaactctcacaaataccgtggccggatttgtacgtttttgcttttccgtgcgatatctctttatctttcaattgctttcggtctcagctcagctcttccccgtcctttggttggccttcggtttattttggccatgcgatggtcgcccctttcctttttggcctttggctttttctctacacggactttcccgaaacacacaaatgcgtcggacggagggaaaaagcggccatttcggaaggaaaaagttcggccgaaagagcaatcagcggaaaagtgccgtactggtgagaaattaaactattttttggcatttatttctaatgcccgtcccatggcaaactacaatattttaatgtgctaattccttagacctcgcttttggccaagaaaagtgccaataacagagcaatatttgaaaaatcagcaaaattattaatgaaaatggctcacattttccaaaatagtggctgctcattgtcagtctcgccttttcctcctctttcctctcagtgccattctccaaaacaaagttgtgctcgtcgtttggctcaattcctttgctgatatcgtcactattgtgttcatgaccacttatatgcccatttacgtgtccaaagtcctcccgtacggcgtccgcgagacgggcatttggagtgcgctg

SEQ ID NO: 68573 - DNA, 782 bp, Heterodera glycines
  Genomic contig location: Contig_ID=SeqID_8573; Location=862..1643; Strand=+
  SCN-specific regions: Sequence locations=1-534,564-745,767-782
atggggggaggtgacttggacgaagcggacgaggagaaaggcggtcatgccgcgggcggcagccaacggcaaaagtgcggtggccacggcactggcgacgccggcgccgaagaacacgaaacgagcgccgaagcgcgtgtacagggcactgaacggaaaagtgctgacgatgctggccgcgccgacagcgtaaagcagcgccgacttttcccgcgacgaatagggcaccgtcggaggcaccacgtggctgctgttcagcacgagcccgggcagcacgtcctcctgacaacagagtggaggttgatcagaccgatggcaaatttgggatatcatatcagaaagaggtggcattttttccttttttggcactgaccgatcattggctctgatcagtctcatttttcatacgatttctcatgttttactgatcaatcttttccactttcaaggctgatcagtcttttgtgttcatttttcaatttttttgatcagtttgtttccccgtttgatcactccaaccactaattaccttcaaatgcacgtcactttccttcagcaaaatggacgaattcttgggaaaggacgcgttctcccaattggtccttctcatcacaatttgggtgaaattaaatgcgatcatattggacgaaattgacgtaagacaaagtgcagcaattgtcagaatgccatatctgaacatcccatcccggcaacagcacactctagtcgaactttcgttgtcattttcagctttttcccgccttcttccgccaattgagtga

SEQ ID NO: 68574 - DNA, 558 bp, Heterodera glycines
  Genomic contig location: Contig_ID=SeqID_8573; Location=3895..4452; Strand=-
  SCN-specific regions: Sequence locations=1-169,191-451,473-504,526-558
atgcattttgcacagattgagaagtttggcaatgtgatgctcgtgcagggcgatgacccggcctattttctggccgcccattcctgcgacattgtgttcgtcgaccgcgaaatgccttaccgaaccgcccatttgcttttccgccggggcagtcccttcacggcacttttcaacaaagtgattttgggaagtgtttgaagggtaacattggcaaaaaacaaacgcactctctttggaggtaatcgaaagtgaaaaagtggccattcggcgctcttacgaccgttaccgaatgctgcgcgagatgatccggaatcaggaatgtgaagagaagatggcgaagagtcatctctacaagcccttgggtcggtggtgcccttttcactctttagagccgaaaaaaacaaattttaagggtttgtgccgatgttcggactgttggcaatgtgtggcattagcagtggcaccgctctgctgattttcgccatcgaatgcgcaattggcagcagaaaaagcaaagaaatttcagatgaaattgaagaggagaggttcagaaaatga

SEQ ID NO: 68575 - DNA, 621 bp, Heterodera glycines
  Genomic contig location: Contig_ID=SeqID_8574; Location=256..876; Strand=-
  SCN-specific regions: Sequence locations=1-85,107-407,430-454,487-621
atggcacggcgttctcggcgccattgccaacggtaagcctttcactctgggcaattggcattggtcacattttcgggtgaaggcactgtggacacgggctgcctgttttatcagaagtcgccgccgcggatggccgactttgattattctctgccaatttattcggtgcgtttcgacttggaaataatttcataatctcgccataaattccgatttcaatttcccctaatttgtcagactctttcccgaattgccatccgtgaccacaacagttttccgttggctgaaatttggcgtctgttccatccgttctccgtcgacacgtggttagccatcgtcttgttcattgccctgcacagttttgtcttcatggtcatcgaaaaaatcgaatttttggtcaaccgccgcactgtcgcacaaatgccaatatttcacaatgttattaattagtgtcttttaattaattaaaataataattaattaatagcgttctatgtaattaagaaattaaatatcagtcaatttgtaatgaatgttaatttatttattcaaagatcctttggcgccttcttcgccttcaattgctgcagccaaaatcggtccgtttggccaccgtttcgg

SEQ ID NO: 68576 - DNA, 538 bp, Heterodera glycines
  Genomic contig location: Contig_ID=SeqID_40153; Location=43..580; Strand=-
  SCN-specific regions: Sequence locations=1-538
atgccaacgcttctgacaaagttgtgcgcattaattttgatttgtcaaattacacttttggcttcaacaaatccattggaagaagcgcctcaaaaaagtttggccaaaaagcgtcttaaaatcctcgtctattcgcccacaattggatggagtcacatgcaatttatgggctcaattgcggacactttggtcggggcaggccacgacttggtaaatcaaatgattaatcaaaagttgatgaactataaaatttggggaagtgagaaaatttttgatttaagaaaaaagataaaaattttttacgaaattattttgaaaaaaaatcttagttgctcaatttatttgcaagccattgatagcgcatttagttgacaatttggggaaaaaacgtaaataatgcttttttatgccggaaattaaatattcaaaaatttcaacatatatgaacaatttttccacaaaatttcaaaaaaatttagcacatttttcgcgtttcaatgaacaaaagggccgaggcattgcccaaggaagtgtttaa

SEQ ID NO: 68577 - DNA, 602 bp, Heterodera glycines
  Genomic contig location: Contig_ID=SeqID_40153; Location=650..1251; Strand=+
  SCN-specific regions: Sequence locations=1-87,139-168,190-330,411-602
atgaatgttgaaagaataaaaatgaattcaaataaagtgatttcttcatatcgataagataaaatagaaaaaaaagtagaacaacggaattaataaaatgaaattaatttattttaaaattttcattaatgaaataaacaaatgctgaaaaatgaataaacgacgaagtgttttcaatttagtattatcagtctcaaaagtaagttatagtttcagattttttttaataggaattcaaactacagaacacaaacatgtgattaattgtttgaaaatttcgggaaggaatgcatgtgactttgttttggatttgataatcctctttttctgatttatattattttattttaattattttttaatttttactgatataatattttaaaaatttattattaatatatttttaactttttgttgacttcacacgattacgataaatgccgaaagccgatcgttagggggtgtaaaaaattatcggtctcgaatctcggcgagtctcgaagaccgagacccgaaaaaagcccgagacttttctcgagacggagacactcgagcaccaaactgaaaaggattcggcggatgggcaacacgacagaaaa

SEQ ID NO: 68578 - DNA, 926 bp, Heterodera glycines
  Genomic contig location: Contig_ID=SeqID_40155; Location=390..1315; Strand=+
  SCN-specific regions: Sequence locations=1-313,335-477,499-613,635 -766,793-875,918-926
attttattcatctccctttttgatagaaaaagcatcagagtgcctaaactaacatgtaaataaaatttggtgcgtttcagaaccctttctgaaaaaaatatttatgaaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 68579 - DNA, 456 bp, Heterodera glycines
  Genomic contig location: Contig_ID=SeqID_40158; Location=168..623; Strand=+
  SCN-specific regions: Sequence locations=1-42,101-178,290-413
atgcgattgttctttattttaacaggtcattatcattatcggattattattattttttttcatttaattaattttaatttattactttattaataattaacttttagcactgaatatcgccgcgtgttcaaaaaagaatttcgcattttattcaatcgtttttgcaacacaaatggtcatttttaataaataaaattttataaaaatattaatctatttgtatttaacttttggaaaataaaacagtttttaaatatttttaaacaaattttaaattaaaaattttttagctgtccaaactattgacacaatccaagtgcgaagtgccaacacaaacaacaacatgaacaacatccgatcaagccaacagatgaatgtgcattcgatcaatttgaatcgctattgaaatggacttatatatttttttattttcttttatcgttttttttttaaaaa

SEQ ID NO: 68580 - DNA, 717 bp, Heterodera glycines
  Genomic contig location: Contig_ID=SeqID_40164; Location=246..962; Strand=-
  SCN-specific regions: Sequence locations=1-404,426-557,584-666,709-717
tcccgaaggattcggtctccccataaatctgggcgcatcggttcggggggcctaccccgaaaacaaaaaaatcgattttttcaagtgtccgtttggggtactcaaccaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtcaggttggggtactcaaacaattatggggagcaacctctaacgcagaattaaagtacaggctatagtgaagctattccgtaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 68581 - DNA, 228 bp, Heterodera glycines; identical to SEQ ID NO: 65316
  Genomic contig location: Contig_ID=SeqID_40166; Location=215..442; Strand=+
  SCN-specific regions: Sequence locations=1-228

SEQ ID NO: 68582 - DNA, 486 bp, Heterodera glycines
  Genomic contig location: Contig_ID=SeqID_40169; Location=65..550; Strand=+
  SCN-specific regions: Sequence locations=1-35,73-78,101-115,137 -240,268-274,316-390,471-486
atggccgaccggaggacaattgagcgcttcttacgtccgccaccgccgccgcaaccgcagcagcaacagcctaaaacttttttggttaaaacattaaaaacagtcctgaaaattcgggaaaaattaggaaaaaatttccaaaacatcgattgcctggaccttggcaatttgatcagcagtggtgggttacaacattggcacggcccgacacaggtacagccacaacagcaaggcttactgtaataatttaaaaatataaaaaaatttcagagaatttaaaaaatttcctcttaccaacagcagcaacaactggcatcagcaaaatgttggttctggtcaatgtttgcaaacagaatgaccaacagaaatgggaatgtgaagagcaattgcattttattttttaaattttgttttttaaattttctaaatttaaaattatttaaaatatatttttatttattattatttttgagggggggggggtaa

SEQ ID NO: 68583 - DNA, 142 bp, Heterodera glycines
  Genomic contig location: Contig_ID=SeqID_40170; Location=271..412; Strand=-
  SCN-specific regions: Sequence locations=1-142
cgcgaagcgcccgtctgaggtctcgaagctgccttaatagcccaacaaatttagaaacgggcgcgaagcgcccgtataagcccaacaaaatttaaaaaacgggcgcgaagcgcccgttcgaggccgcgaagcggcctaaaag

SEQ ID NO: 68584 - DNA, 1446 bp, Heterodera glycines
  Genomic contig location: Contig_ID=SeqID_8578; Location=206..1651; Strand=+
  SCN-specific regions: Sequence locations=1-22,45-56,79-260,303 -671,694-698,720-846,868-1085,1114-1446
atgtgttagggccaaaccaaatttaaaaatgggagaatgaaaaacagagtgagtagaaatctgtaacttagaaacaaatttattttcattcatgtattcgtttttttctcaaggttgccaatttcctggagaccttagcctcacagtttagttttcgtttttccaaacaccaatgaggctaactaaattttcaaaataattattggagaaaatcctcaaaaatgatcctattttgttcgaaatcgtttgattacaaactctattaaaaatgattttttaatttaattttaattttttttaaaggcattcctccgatcatttatttggcactgaacaagacggtccgtcgtgatgtgtacatcatgatgatgaagccgttgtccaagctgttctactgctgtatcaaagcaccagctgatccgagcaccacccgtctgttcaatacggtcacagtccgtcgaatggcggctggcggcaaagtggtgccagcctcgtccaatgtgcacacagcgaaaatttcaaattcgaatatgaaatattagttttttttttttggcattgtgttagtggcataattcaaaaaaaatgcgagttaaaatctaagtgtgttgattttccaggattgtggtcattttaagttttgacattactgaagaacccaaaaagtgccgatttttatttaatgtattttttgagtcaaaatttttgggcttaaaaaattgccacatttatccttttactaattacgccgctggattagcaacttttcactaatgattttaatgattattcaccgttaattggatccaaaaaatctaacccaaccgtgcccaatgtgcacacagcgaaaatttcaaattccaatatgaaatattagattttgagtttggccattgctgaaaaccccccccaaaaagtgctgttttttaagattgtgccattttttttagtgttggactaatattttaaagtatccttttcagcaaatctcattaaaaattacaaaaaaaatttcgacagcgcccgtctgcactgccgaatcccaaaaactcctcgaattgttttcaaattttgcaggaaaaaactttataattaaaaaaaaaaattaaatttgagagccagttaaagttgaattaatttaaacagttttatgcctttaaaaattcgaaatttcaaaaatcaaaaaaatggaatgcactttttgggtcaaaatttttggttttaaaaaaatttaccaaactcacccatttactaattacgtccctggattagcaacttttcactaatgatttttcatgttcattctccgttaattgatcccaaaaatcttacaatgttgttaatgagaatatgtttgaattttatgtataattgcttcgtcagcacatatccagtcaatccctgtttttatcttaaaaaaggtgtgcatatttaatatttgcttaa

SEQ ID NO: 68585 - DNA, 934 bp, Heterodera glycines
  Genomic contig location: Contig_ID=SeqID_8578; Location=2507..3440; Strand=-
  SCN-specific regions: Sequence locations=1-31,53-234,259-430,454 -497,574-625,647-934
atgcatgattcaactattgaaaatcttcacaggacaaataatgcaattgagggatggcatttggcttttaggcaacgctttgctggattgcatccaccattctctaagtattgcagcactaaacttcgaaagaagttaatttatttagatttatcagagcactaaaagtggaggaggaattccaacagaatcgcattcgaccttatgagttggaccccacaagggggttgagcgagaaaaggaagaaaaaatatgaggaaaatgaccgtgctatcaaagaattaattttgcgatacgacaatgatgatgaacgcgacaatgagactttgcttcgtcatttaaatgcattacagtatcgcctcgcagagtggtttcatgaatggggtgaaatgtaaaaaaatgacgctcgttgggccttgagcaagccattggaaataaaaaatttatttttgtgtattaattgatgtattgaaaaagttaaatattatgatgaagagaataaaatatcttattcttaaattgataaaatctaatagtaatatttattcaaaattacataaaataaatttaaatgaaatgtagggcaaagccgcaaatgtcgggccgcaaatgtccgattttagcttgggccgcaaaattcagcaaaaaattgggccgcaaatgtccgaaaatggcccttaagaaatgggccgcaaatgtccgagccgcaaatgtccgggccgcaaatgtcgggccgcaaatgtccgatttggctggggccgcaaatgtccgagccgcaaatgtccgggccgcaaatgtccgggacgcaaaagtggggtaacccccaaaaaatctcgttttgaaaaaagttagttagactcattggccttcgaaaaaactaaaaccgcgaggctaaggtctctagtaaattggtaactcttggaaaaaaaataaa

SEQ ID NO: 68586 - DNA, 198 bp, Heterodera glycines
  Genomic contig location: Contig_ID=SeqID_8578; Location=3453..3650; Strand=+
  SCN-specific regions: Sequence locations=1-198
atgagaaaaaagtggaacagcacgttcaccatcaacctctcggaaaagataggtactgtaaaaaacataacccgtaagttcaaatattttttagaaatcggcggaaatataactttatttttagtttttatttttagttcagtgtttgaaattaaaatttatggcccagatttgctccagacttttgaaagtaggtga

SEQ ID NO: 68587 - DNA, 422 bp, Heterodera glycines
  misc_feature (33)..(33): n is a, c, g, or t
  misc_feature (52)..(52): n is a, c, g, or t
  Genomic contig location: Contig_ID=SeqID_40172; Location=17..438; Strand=+
  SCN-specific regions: Sequence locations=1-226,266-422
atgtcttccgttgggccattcgtaacatttgcncaattccattcgtcgcttntcgttcttcttccgactccaaaacggtgcctttccaatattcccatgcaaatggtccattgtttcgacgatcgtttcgatgtcgccattcattggctcatcaaaaagccatcggtcaaacgccgtcaaaacatttttaatgcgaaaagaatgcgacggattcttcaaatcagagatttttagaatatttattaaatggaacttaagaaaattaactcacaatttgcaacggaatttccttttccgttttatccgttaatttttcgccctttggacttagacaagaaaaaaggcgaaagtgagcaatgaaagctatcagaattggcaaaaaagaaagaatcattttcgaaagagaaaacatttagaaaata

SEQ ID NO: 68588 - DNA, 339 bp, Heterodera glycines
  Genomic contig location: Contig_ID=SeqID_40172; Location=604..942; Strand=+
  SCN-specific regions: Sequence locations=1-155,201-247,317-339
atgccggaccggaccggactggtattttcaaaaatgaccggattcgggatccggtctctcataatccggtcaatccggtaatccggtcaatccagattttcaaattgccggatccggaaccgaattccggattggtaaaaatttatatttcacatgttaatttgggaaaaaacccttaaaatttcatctattatatgtagaaatttggtgcaccagaaaatgtcgtcatagaaaagacaatgcgccgaaaaaaatatataaaatttcaatttttcaaaaaaaatttaaaaaatttattttaaagttttttatttttgaaaacctatgtttaatgaaaaa

SEQ ID NO: 68589 - DNA, 411 bp, Heterodera glycines
  Genomic contig location: Contig_ID=SeqID_40173; Location=664..1074; Strand=+
  SCN-specific regions: Sequence locations=1-167,190-411
  Gene Ontology: Mol. function=microtubule binding; Cellular component =microtubule cytoskeleton; Biological process=gametogenesis
atgaaaaagcaaacactgctgatgcgcaaccaaattgagcaagtttatgcggagagggacatcctcactttcacggacaatgtgagttgacaaagccatgggacggaaaaatgttactgtttcagcctttcgtggtgtgtttttacggttccttcgagaccaagcagcacctttgcatgctcatggaatacgttgagggcggtgactgcgcttcattgttaaaagtccctaaaatttgttttcaattgtaccaattcatttcagtccgccggaactttgcccatcgaattggcccgcctttatgtggcggaaacggtgttggccatcgaatatttgcactcgtgtggcattgtgcacagggatttaaagccggacaatttgctaatcacttccatgggacacataaactga

SEQ ID NO: 68590 - DNA, 318 bp, Heterodera glycines
  Genomic contig location: Contig_ID=SeqID_40173; Location=1..318; Strand=-
  SCN-specific regions: Sequence locations=1-192,216-318
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgataagagagcatcagagtgctaaaattaagttgtaaataatgcgggggtgagctttagagcactttctgaaaaaaatatttagaaa

SEQ ID NO: 68591 - DNA, 470 bp, Heterodera glycines
  Genomic contig location: Contig_ID=SeqID_40179; Location=91..560; Strand=-
  SCN-specific regions: Sequence locations=1-162,200-218,275-302,411-470
atgagaaggataatttcttggtcaagtttcaaatgcgaattccgtcgccaaaaagtgacgggtaatgttggaatttggtccgagtaggggtcgttttggtactaaaatgtagtgacattaaatttacattttaaatcgaaattagctggtttacttgaacattaatatatgcaatttaaaaaataagtgaaaatagtttattggattcgggatttcagaaaaaaaaataaatttattgatcaaaatgctataataaaaataatcaaattaaattctaaatacagcaaaatatttgcctaatcattttaaaaatttattttaattttcgaaaaaaaaacttaaataaaaaattatatttaaaaaataataatagaaaattttttttcgtattaattgaatttttatttttaggtaaatcaatcgcgacgtatgatttcgaggaagcggaggcggaatcttatctttgttaa

SEQ ID NO: 68592 - DNA, 3038 bp, Heterodera glycines
  Genomic contig location: Contig_ID=SeqID_8580; Location=43..3080; Strand=+
  SCN-specific regions: Sequence locations=1-1037,1059-1146,1168 -2281,2303-2376,2427-2442,2464-2485,2561-2645,2718-2805,2838 -2869,2930-3038
atgacaaatcgactcttcgctcatttctcggagcccctactttactacagtcggttcatcaaaaagatgcgcgaacttagggcgccattggaccaactttttgggaaagacgaactttggaattggggtgaagaccagcagaaagcttttgaaaaagcaaaagagatcatgttgtctgatctgcttttacccacttcgacccctcgcttccaataatcgtcgcagctgatgcttcaaaagatggaattggagcgaccataagtcacattttcccagacaaaacggagaaggtcattgagcacgcgtcaagtgttctttcagaagcacagcggaactacagccaagtcgaaaaagaagctttggctcttattttcgccgtccaaaaatttcacagaatgatttttggaagaaaattcacacttctgaccgaccataaaccgctgatttccatatttgggtccaagaaaggaatcccaatttatgccgccagtcgactccaaagatgggcacttattttgtcaaattacgaatttgacattcgctacatcaataccactgcgtttggtcaagtcgacatgctttcacggcttatcgcgaattatccgcgacccgaagaagatattttgattgcaaaaatttgcaccgaaactgaatgtttcatcggcacaattttgcagtcacgaattgatcaacttcccgtcactgcaaccgaaatagcagaaatgactcaaaaagatgaaattctacaaaaagtggcaaaattctccaaggaaggatggtcacaaaagtgtaatgaccccgacctcgcaccattctttccaaaacggaacgaaattttgcaaatcgagaattgtctgctttatcaaaaccgagtcatcattccaacagtgttacgagacagaacgttgaaagcgcttcacatggcacacccaggaatagtgcgcatgaaagctctcgcacgccaacacgtatactggcctggaatggactcagctatcgagaaattggtaaaaagctgcgaagaatgccaaatcgcccagaaagcagcaccaaaaacattgctttctccttggaatgccaccaaacggccattccaacgtgtgcacattgattttgccggcccatgccaagatggccatgtttatctacttttactggattctttttcaaaatggcccgaagtttatcagatgaatacaatgacatcaaaagcaacgatcagtgttctccgattaatcatccatcgacttggcatcccagaagaaattgtctcggacaatggacgacaatttcgttcgtcagagttttccgaattttgtaaagaatttgggattcgacatacgttcacaccgccatttcatccacagtcaaatggccaagtcgaacgctttgtcgacacctttaaaagggcaatgcagaagtgttcgaaaaaggacaaaaattgggctgagaaaatgctcctgtcctatagaacaacaccgaattctgcaattaatggacattcaccggaccaattattctttggtagaaaactccgcactcaattgtctcttacacatccgacaggaaaagtcaatgagacaattgacaagaccattttccatcaaaaacaggaaaaataccgcacaaaaatggcacaaaatttcaatgaaaagcatggagttaagtcaaatgagtttcttccgactgacccagtgcttgttttgaattaccaacatggtaagtcacattggctccaaggcacgatcatcgaacgcctaaacaattcgccgacttatcgcgtaaatgtgccaagactcggacgaaacattcatcgacatgccaaccaaatgcgccgtcgatatgtcttcgaagaaagtttaggatttgttggtcccgcccaggtggcaaatgacccaaatcatcattcaccggcacatcaaaaccatccaacaccggcacgccaaaacacgacaccgaaatgccaaaagcggaagcagcccgacgaaatccacccaactactgccaattcaccaccaatggcattgagacgctctagtcgcaacaccaaaccgccgatccgcttctcgccaggctgacgccgttcaagaattgaggagggagatgttggatagtgaataatttgaatttatggcgatctgacttattgactttatttgttatttctatgtccatccgccccctccctcgtccataaaagtggacacctcctcccactttttgttctttcctttcatcattcatttatattttatttcccaatttgccctccgaccgaatcaataaaattatttatttatttctttttctttgtgtgttctaagtggaagaacacaacagtcctcaatcattctcagccggcctgcttagtcctcgtaattattaaattagaattttaattaataaaaacaattatttataaaaatgaaaacaaatatgtatcataaaatcaagaaatgcaacccaaaaagatactagaaatttcaattttaataaaatattcaaaaataaataaatgtccaaaattaattatttttattcttgaattttttattttttagcccgcttaattttaattagtcatattaccaaaaatatttgagcattctaagggggcttaaatccaggcccatgaataaattgagtaaaaaaaatataataaaaaatacaagtttatcaaatctaataaaacttaaacttaaaattaaaaaataaatgaaattgttcagtttatttttaataaagcaattggttcgccaagctacttttcggacgaatcatactcatttatggtgttatcacctgaggtttattcaccaaatgttgcatcaaaattatcaaacagtatttttgtgagtttctctatttgaaatattttatttaataaattatttatttataatgataaatttcagttaattttatttttggaaagagaggcatatttaatttaattaatgacgacaaccaaattttcaaggaagtaaatgtttgggttctaagaataattttttcttagaattttttgttacatttaa

SEQ ID NO: 68593 - DNA, 280 bp, Heterodera glycines
  Genomic contig location: Contig_ID=SeqID_8580; Location=3516..3795; Strand=+
  SCN-specific regions: Sequence locations=1-29,51-63,153-251
atggatgaaattgctagactaatcaaaggaaatgtttcaagggtaaggaaattgattttgttgaaaaaatgaaataaattattttttagattaataaatttgtaaaatgtgaaaatatttttttgaattatacttgaaaatttataaattaagaaattgaaaaatgccaacgacaaaagattctgcacatccgggcatcgattcggacacatccgaacatttttcaacccgaagggtcatgaaacttgacgaaaattatttgtatttataaattaattta

SEQ ID NO: 68594 - DNA, 630 bp, Heterodera glycines
  Genomic contig location: Contig_ID=SeqID_8580; Location=3824..4453; Strand=-
  SCN-specific regions: Sequence locations=1-244,338-342,367-630
atgggtagccgccgtatcggagaaatggtatttctcggaaaaaagggaaagtgttcatcggctgttgattatgttcaagcccgatatatcgcgcaattggttgtaagttgccttctttaggacaaagcaaaaactaccgatggacaacaaagtgaaacggcaaattaaagcattgatcaccgatgcataaggggtcgctagtcaaatattggacgattaccgtgaactaatattaacggtttggtttttattaaattatttatatgcttatattatataaaattttcaaagacttaaattttttatatataaataattttgagttaaataattttttggttgatttttaaaaataattctcaaaatcttattgacatttaattttttaatcaattattcgagtcaacttttttagggtgccgctgatctcgaacagacgaggtttctatccttcacagaaatttaccagtaagtgttttaatttaattctaaatttagtaaatatgaccagatattaacgttcaggcatttggggccaccaatggaagaagactagcaaggatgagcaatttttgataagtttggccttttaaaattttcgagctataatattcaaaaagttagaataaa

SEQ ID NO: 68595 - DNA, 304 bp, Heterodera glycines; identical to SEQ ID NO: 53844
  Genomic contig location: Contig_ID=SeqID_40184; Location=65..368; Strand=-
  SCN-specific regions: Sequence locations=1-304

SEQ ID NO: 68596 - DNA, 228 bp, Heterodera glycines; identical to SEQ ID NO: 65316
  Genomic contig location: Contig_ID=SeqID_40184; Location=697..924; Strand=-
  SCN-specific regions: Sequence locations=1-228

SEQ ID NO: 68597 - DNA, 1358 bp, Heterodera glycines
  Genomic contig location: Contig_ID=SeqID_40188; Location=123..1480; Strand=+
  SCN-specific regions: Sequence locations=1-376,398-417,448-593,615 -958,980-1122,1145-1358
agagtggttgtctgtctggaggacaccatccacattcacaacatcagggacatgaaagtgtgtggtttgtaatgttgtactggctttttttgaaaaaaaagattaaatcgttcacgattactagtaaatgccaaattccccccccccctctcccccagtgaatattgtattgatgctgcctaattttatgcacattagctttctcccttgggccaaacctttttcaaatgttttagatatcccttcgttcagataatgcacatgctgaaagacacaccgccaaatccgaacggaatcgtcgacctgtccatcgcggacagcaactgttttctcgcttttccgtgttcgtccagcacgggccatgtgtaagcgtgcacattttgggaaactattttaatatttaaaagtgatttgcccttttttaagtttttttttaaatttttaattccaaacaatgcaactgggctaactaatgatagggcgtgaaaagaattcgagagcagccagttagagacagacaagacaattactatagtagcgacccttttgagttttcagcgccatgtccctggtgtcctagtgtattgcattgattttgcttcttttcaggcatatattcgacgctgagaatttgaacacagtgtgccaaatcactgcgcacgacggagtgctcgcagcaattcgtttcaatcccgagggtaacaaaatggcgacggcatcggagaaggcactttttcacccgaatatgtctcttgtttcagggttttctaatttttagggcactgtcatccgcgtcttttctattcccgacggagagcgtctgtacgaattcacgcggggcgtcacccgctacgctcagatcaattcattggcattttcacaggactcgcgtttcctttgcctgtcctccaacactgaaacggtcggttcaatcaaaaaaagggaatttgacgggaaacaatttgaatttttattcccattttttttttgtttttttaaggtgcatttgttcgctctccttacgccgtttgaacagcagcaggcgtaccaccaccactcgcatcaccaccagtgccaaaagtggggcggcttccaagcatttcttttagcttttcatgggctatttaaaaataatttgtttttctcccccataaataattggctgttaaacttttaaaaaattccaatgtaaatgtttttcaggtccgatgaaacttcccaagagggtttaagcagttgggtcagttatttgtcgcagcaggcaagcgcatatttgccccaacatgtcaatgagctgatgcttcgcgaaaagaagacggcgccggcgcgtctgcccattctcggcactcttagtagag

SEQ ID NO: 68598 - DNA, 168 bp, Heterodera glycines
  Genomic contig location: Contig_ID=SeqID_40190; Location=224..391; Strand=-
  SCN-specific regions: Sequence locations=1-168
atggacgaagaggaaactctgaaattgatcgattatgacggtgccactttcataccggtggggcttttcgaaaacccgagaaaactggcaaataaagttgtgccacgtgagttttacgtggccaccccaacgtatgtagcaatcgaatattatgaggaggatataatg

SEQ ID NO: 68599 - DNA, 1306 bp, Heterodera glycines
  Genomic contig location: Contig_ID=SeqID_8581; Location=467..1772; Strand=-
  SCN-specific regions: Sequence locations=1-195,217-560,594-595,617 -623,822-1086,1112-1306
atgataaaaagaggtacaaaaatgattagacgaggtacaaatttgattagaagaggtacaaatttgattagaagaggtataactgtgattaaaagtggtacaaaagtgattcaaagaggtatatcagtgattaaaaaacgtacaaaagtgattagaagaggtgcaaaagtgattagaagaggtacaaaagtgattcaaaaacgtacaaaagtgattcaaagaggtacaactgtgattaaaagaggtacagcagtgattaaaagatgtacagcagtgattaaaagaggtacagcagtgattaaaagaggtacaacagtgattaaaagaggtacaatagtgattaaaagaggtacagcagtgattaaaagatgtacagcagtgattaaaagaggtacagcagtgattaaaagaggtacagcagtgattaaaagaggaagaacagtgattagaagaggtacaaaagtgattaaaagaggtacaatagtgattaaaagaggaagaacagtgattagaagaggtacaactgtgattagaagtggtacaacattgttaggagaggtacaatattgtttaaaattaaataaataaggaaacgtttttattaaaggttaaaaatcgagtgcattttaatttaaaaattttttaataacaaaatactcttttattaattaaaaacaaccttggaaattattaattgaatatttatttaatttgaaattaaatgaattttttttacaaattcaaaaataaataatgaaattctttaatttaaaaaaaataaatttaaataatttaaaagaaattttcaaattaattaaaaacattgtaaaataagccaaaaatacaaagaaaaataatgttacaccgtccggattcgaacctgctgcccccccccccccccctcagaacatgtcccagaatccccaatcacacagggattctgaggtcttgacgatgtcaaaagtaaaatctgatcacgtattcgtgatcagcggcccaaataacgcctaaagacatgtttttggaagatttttggtgaaaatttttttcacttaaaaatcctggtcacccccctttggtcccgaatcccaaaagcacttttatttttgtatcttttttttaaaatgtgatagaaatgccaaataaaatttatataatagagcaaaaaattgcggatttttgtagtattttacttttacagtatgacttttcagaaccgagttatgaatttttttctgaaaaatcgaaaatttccagaaattctggaataactttttttcttttgaacattataaaaccaaataaa

SEQ ID NO: 68600 - DNA, 225 bp, Heterodera glycines; identical to SEQ ID NO: 50965
  Genomic contig location: Contig_ID=SeqID_8582; Location=2878..3102; Strand=+
  SCN-specific regions: Sequence locations=1-225

SEQ ID NO: 68601 - DNA, 682 bp, Heterodera glycines
  Genomic contig location: Contig_ID=SeqID_40196; Location=65..746; Strand=+
  SCN-specific regions: Sequence locations=1-311,345-409,431-682
atggatatttacagggaattactgaaattgaagaaatgcgttcaaagcttttggctggacttgaggaaagattcggtcatttggagaatgagaagtgtgtacatatttttaaatttcttttaaatttcttttttagattacatgctctttcaacattcttggaccctcggcgaacaactgagtattaatggctctgagcgtattacatctgaacatgttgaaactgtgtcgctttttgttgttccacctcctcccaaacaacgacgtacattacttgattccttgtcagaaatggcctcaaccagcaaatcttttggtaatttttaaaagatttcttttattatgcatataaaatttaaagtgcaaatcgaatcgacatttgacgatgaactcaaaaaatattgttcggttgatttgattgggcaggaattggaccctttggattggtggaaaataaacgaaggactatttcccattatcgctgcgcttgcaaaacgatatatttcggccccggcaacaacgattggaagcgagcaacttttcagtgttgcgcgtgatgtgtttgactatcgtcgatcaaaattgaaggctgaacatgccgaaatgctcatttttttgaacaaatcaattccgaaaattcgattttattgatttaaaattttgcttttttattttttcttta

SEQ ID NO: 68602 - DNA, 479 bp, Heterodera glycines
  Genomic contig location: Contig_ID=SeqID_40197; Location=1..479; Strand=+
  SCN-specific regions: Sequence locations=1-90,123-131,175-479
cagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 68603 - DNA, 124 bp, Heterodera glycines
  Genomic contig location: Contig_ID=SeqID_40198; Location=1..124; Strand=-
  SCN-specific regions: Sequence locations=1-124
tgataattacgtgatgaagccaagccgtgagggcggtggaaacaatttttggggcgatgaaattccaaaaaagttgcgcgaaatgagccgtgccgagctcagtggccatattctaatgcaaaaa

SEQ ID NO: 68604 - DNA, 752 bp, Heterodera glycines
  Genomic contig location: Contig_ID=SeqID_40198; Location=750..1501; Strand=-
  SCN-specific regions: Sequence locations=1-190,212-442,464-632,656-752
gaaaaagtttgatgacaaagacgcaattattttaattgtcgctggtaaattataccgaaactatgaacaatatcagctgaattatttgatggaaaatgtttcaaaaaataaaataaaaattgttcaaatgtcattaacagaagccgctgaagagtaagtaggcattttacaaataataatttaagcataattaattcttttaatttatttgagtacgctaattaattagccaatccaaaatgtgtgctaatttgttttaaaaaaatcgtaaaatagcactctttttcaggctaacgcaaggcaatgaccattcattgctttatggcacacaaaaagttgcaattgctttctaccgatcaatttcttccctgagagatgaacgcattttcaacgctcggcttatgatcgaacgatcaacagcaattgtaagattttatgttgcataaaaaaaaattttaattatgtaaaacgactgtaaaagttaaatttaacagttttaaagctacaaaatttaaaaattatcaacttatattcgtttaaaattgtttattttgtaaaaataacaccaaaaaatccaaatttaactaatttttgtattaaaaaatcaaaagcaattttctaatgaaaaaaagataatttaaaatcatatttaattcatttgtagaaaataccaactgtggcaaatgcacttgcaagtcaaaagaagattcagcaggtgattttatgaattttgatataaataacacattaaa

SEQ ID NO: 68605 - DNA, 696 bp, Heterodera glycines
  Genomic contig location: Contig_ID=SeqID_40201; Location=120..815; Strand=-
  SCN-specific regions: Sequence locations=1-337,362-696
atgacggcaatggtaagtgattggtaaagtaattttgctttttttattggactgatcgaatcgaaaacgtcggggggggggggctaatcgctgtgagagtcggtgttggtcgtgcggagctaacccccgccggtggatttccgatcacactctctcttttctgatcagtttctttccgatgtctacgacttgtgcgtccacgtgcggtctgtgcgcgacgggcgcgtgcgcggacactcaggacggatgcatcggactaaggcacatgtgcgaccagaaggagttcgaggaggacatgcaaaagtgcgcacgcacttgcaaattctgcacacgtaggaaataaatatttaatttttaatttggaaatgattgaagtgatcacccttccccacagcaaaatgtgctgatctgaccaacgattgtcagatcgccgatgaaagttcgtgcgaaccgccaccgcccgatcacttggaagtgaatgtgtgtgatttgttcagatttaatcacaattgattcaaaattcgaattcaaatttgcacatttcagccctattacgaggaaatggccaaagtgtgccgcaaacggtgccatttatgtgacaaagcaatgccattgaacaaacgaattgcaaaaaaagtggcggacagagccaaacgcattaacgatggactgagtgacgaggaaatgaatgaatga

SEQ ID NO: 68606 - DNA, 4081 bp, Heterodera glycines
  Genomic contig location: Contig_ID=SeqID_8583; Location=419..4499; Strand=-
  SCN-specific regions: Sequence locations=1-78,158-264,297-1059,1085 -1125,1147-1199,1338-1505,1527-1615,1639-1688,1712-2007,2039 -2067,2118-2127,2152-2711,2733-3066,3088-3441,3463-3793,3816 -3820,3842-4039,4061-4081
  Gene Ontology: Mol. function=peptidyl-prolyl cis-trans isomerase activity; Cellular component=nucleolus
atggccaacggtttcaattatggtgattacgatggcgaaataacgcttgactttgaatttgcacgacctttggacattgatgaagaagaaggaaaggaagatgaaaacacagaggaagaaaatagtaaaaaggaagaaaaagaggaagatgagaaagttggtaaaacagagagttcggacagacaagcagacagcgttgaaaatagtgaagcaaaaaaagaaacaaagacagtgcaaatgaaaaaaatggtgaaaaagctaacgaagcagcagacagagaaggaggagaagctgatacagtatttgtgtgaggtcagacagtgcgactcgcaaaagacggaagagtgctggatgaaactgttcgacgcactgaccgcgttggatgacgaggaccgttacgataacatgcgacagtattgctcggccaacaaatcatggatcagatactgtagcaacatggcaatgtgtgatgacattgatgtgagtttaaaagttgaacggaaaatgctctgctggggaattgacactttaaagccttataattagggctataaattatatgcttttgcatattttttctgcgcatatgctacgaagaaaggggctcaaaaatagcatttctgcgataaaattttttgatttggtgaagttttttagtgcatataaaagcatattttgagggttttcgagaataaatgcatattttgccattttttcatttttagagcatatttaagtcatttttggcaaattttcataagaaaaatgcaataaaaatgaaaaatacacccctaaggatcgactttttgggaattaaaaaatacacccttgaaaatcgaaaaattttgaactttttgtaagaactttttaaaaaaaattgttgatataagaaaatgtaattttgttttagcatatacttataatttctaaataattaaatttttgatttttcctttaattttttggggagtttggactaaaaagactgtcccaattcctctgcgctcatttccgtttcactcttggctggaaatggcttaatttctcggtattaatgagttttaaaaatatttaaaaattaaaacagtccctctcggcaacgccaaacactaaagtcgaattacataatttaatttttaacattttgaagctcttttatatgtcgatatattctttttttatagaaagtcattgtgttcaaaaagaagacggaagaagatgaagtgataatagaagaagacgaggaggaaaaggaagatgataatgaaaaagaaaaagcacaaataaaggaaagagaagaagcaaaagggaaagagaaaaaaacaaaacaaggaaaaagcagtgacaaaaagccgatgcaaaatgaaggttaaataagttaatctcaaaattttaaattacctaccacacgtataggagtggaacagttttatggttaatcgaatttctgagcctttttttggccaggttttcgtatttttcgcaaaattcaaaaaatttggacggataggggtgggacagttttaaatttctgcgccttttttgaccaaatttccgtatttatcgcaaagttctaaaaacgttggaattagcctattggaccggcggaactctaatttttcaatttttatattaaaaacgaattccagtctcaagtgaaaagattgctaagccaaaaaaatcatcaacaaagccaccatctgctgctggtgtcaaaaagaagccgaataaagaagtaccaccaattaaccttatggatgaaccgtatgttggacaaccgcaagcgctacagtattcggtgtcaaacattggatacggtaatcaaatacaggaaccgtatacaactcagcgaaatgattcgctcatgtatacaactgggtcaccaatgctaccgcattcgatgtcatctattggaccaagcatgacactgtcagactccgtttacccaacaccaacaaacaatataactccataccaaacaggttatgaacaaaacaatataacacgaaatttaattaaaaaataattattttttaatcacgcttaaaaggttacgaccgaactatgaataaatatttgaaattattaattgtattttaaataaaaattgaataattcagtaccaagtgtacaacaacaacaccaacatcaaatacagtacccaccgacgcaacagtattcgatgtcatttaatggagtgccatctccgcagtaccaaacttacacatcattcagcatgccaccgaactcaagtcaatacagagatattggtctgccacagtctcatttagcttcaactgctggtggcagtgggtctttagcaccgctaaaccaatatccaccggtaatattgttaaacattttcaaaaatttatgattcgaatatatttttaagcgttttaaaaatttatgattcgaatatatttttaagcgttttaaaaatttatgattcgtatatatttttaagcgttttaaaaatttatgattcgaatatatttttaagcgttttaaaatttatgattggtatatgtctgagaaattttggattttgatcaaaatctgactttaaaaaactctttagaatcaaaaattgccagttttttttcgtttgggaaagcactgtggcaaatgctttcaattttgttagggaattttgttgaatggcattgaaaaagcataaaagggtgaccaatttcttcattttagcaacccggaatggcggggccaccttcatttgttggaaatgatgctaatgctatggtgaataataactatccaagtagcagtgaccaccacaagcagagatcacgtcgccaaaaaagaggcgaccgaagtccctacgatttctcaatgtataataattctgataaatctgcttctactcaatcagtaccatcatcatcatcatcaaggagacaaaaagcaaggacaccaaacattgtacagaaagcaaatgttgtaagtttgaaaaaaatttaaattgttcgcctaaaataataaaaagaatccaattacatatgggaaatttaccaaggtttctttgatttacatataaacccatattgaccagaaaagaaagaattggttttgataatgcctaaaatttgaaaaatgtcattgtgtgattaaggacacccctaacacaaataaaggactaattagtgcaaaaaattaattattctcttaaggaaaaaaagattgaaacgcctgaagaacacatgagcaatcacctgaaaatgtacatgcaatgtgtgaagaaattattgacggtaagtttaaatttgtttttgattttaatgaacacttaattagcaactctatgagaattaattaaaaaaaccaattcccaaattagttgaccttttcaaatatttttgtacctttattgtcttatttaacactttcatgatgactaatcaggcagactaattttaaataaatatccttatttaaatttttactaaatgatccattgttttttttctttccaaatttaacacttttaacggacgccagtttttcatcaaaaacaaaaccaaatttttagaattttttttaggaacatctgctggtggacaatcggaatgaagacaaagtgtccaaaaatttccgtcaactcctctacggagtgatgttgccaaagccggtgttcatagcccagcagttgaacatggcactgaacggaatgccaaaggatggcattgacattgcctcgctgatgtcggcaccgtcctactcaatggccaacccatttgtagcagcaaaaaaaattattaaagacaaaggattgagtgaaaagagcacaaagaacaatgagatggaaacgaaacaacacaaaaaagggatgctggcgcagccgccaataaagcaggatttgcgggttctgttagaaattgccagcacacagagcaggtggccaacaaaggggggaggactgggcaaggccaaggtcgggcgggtacttgggattttttacaattcacttgaaaacctacaaaaaaattatttaaaagggcgattacttggattttttgtttgacttaaaacccccaaaaaattcgatttttaattaattaataaa

SEQ ID NO: 68607 - DNA, 873 bp, Heterodera glycines
  Genomic contig location: Contig_ID=SeqID_40202; Location=366..1238; Strand=-
  SCN-specific regions: Sequence locations=1-662,684-723,814-873
atgaatcctcagcaaaagctcactcataccgcggtgattggacgggcagtgagtagcagtggtcggccgggcacttggcaagatttaggatgggtaagtcgtacaaagtggcaacatcctgtttagattagtatagatccagagaatgatcccttgaaaataacgtatcatggaattcaatcttgtctcccgaattagaattaagtttatttgcatgaaaattactggatatcatgatctcaaactgattttaggcggttcagaataccaaaaaagtttcactctaatctagtgaataacattggaatctattttccgaatttaaccattttcatggatttttactgaatgcaaattctgatccaattataagccaaaaaatctagatttccagaccctgcctgactcagaaatccttcagatacttgaatctaacgaaaaagacaacttcaatgccatcgaccctaatttgtttgttgatccgagcacaaaacgattttggctccaatacggctccttttggatgggcattttccaagctattttttctttcccaaaataatatccaatgcaaaaaagagatattttatcaattgtaatctctcatctctaatggattaaaaattttgattatagcaaaaattagatttcaataatcaagaattttgtaaaactaaaaaatagatttcgtttcaaaaatctgctaacttttgagtttttgagtatatttataatgaatatttttgaaatattttaaaatttcattatttcacttaaaataatgatgtaatgagattttaaattaatttaatagacaaaacttggaatcaagggtttttgtcttcttcaaataattacaatcaatgaaataaa

SEQ ID NO: 68608 - DNA, 268 bp, Heterodera glycines
  Genomic contig location: Contig_ID=SeqID_40204; Location=12..279; Strand=-
  SCN-specific regions: Sequence locations=1-117,141-268
atgcagaaatatttatgcttttgtcaccggaagcgacttgacgagcggacaaaggtagacagacagcccggaggaaagaaataagctaatcctgtggaggaacaatgaaaatttctcaaataattaaattttataaatttgttgaattattcctaaattttccccttttcaggtaaatattttcccgaatttccatttcattgtcccatcggtgcgggtcattagtcaaaaaaccgtggttggcgatcgacgaaaagtgcaaatttga

SEQ ID NO: 68609 - DNA, 611 bp, Heterodera glycines
  Genomic contig location: Contig_ID=SeqID_40207; Location=277..887; Strand=+
  SCN-specific regions: Sequence locations=1-98,125-185,236-611
atgaatagtgaagacactaaggaaatgtggagaagaatagattgcttttatgctggtagaagagacgaggtcaaagatcatagtgagtaggatacgcatcaacaaaagagaaaataaaacacaatcaattctcattgagaccatagacaacaaaattaacctttttctctttttttactcattaaacttcattagaatgaaaaatagaatttgaaaattttaaaaataaaatagctataaatgaacattggggactcgaacccatgacatcacatctataagggcaggcacactaaccacttgaccaccaagttacttgctcacatcccttttaataaccttttccctttctttctttttttgaaaaaatcctgatcaaaagtgcttgagctccctttttagggcacttcccggacccggacccaaacaattttggtatcattcgaaagcccagactttgtagactgaggcaaattgtttcgattttcgatttgactatttttaaggtatgcaaaaaacgttcaaaaatggaacatctcaaaaaagtgcaaattttgactcgtttttcgaacacagttcgaacaattcttaaccgattgggatgccgataa

SEQ ID NO: 68610 - DNA, 328 bp, Heterodera glycines
  Genomic contig location: Contig_ID=SeqID_40211; Location=509..836; Strand=-
  SCN-specific regions: Sequence locations=1-220,262-328
acatcgccgatcagctgctggcattcagcgacgcgcacatcgctttggtgttgaaccgtcctgagaaaaacgaaaaactgagcgaattggccacggaacactcggagaatgtttcacagtttgacaggcattttttgcatttgaaatggtaacaattaattatttgttcagtttcggtaccggggacaatgcgcggattacgcgtctgctgggcaaatcgttgtgcgatggcattgtggcatttcaaatgggccaattcgaacgcacattcgacttggtctatccgatccgaacgcaattgtacaaaatcagtgggagcaatgcgcag

SEQ ID NO: 68611 - DNA, 414 bp, Heterodera glycines
  Genomic contig location: Contig_ID=SeqID_8585; Location=1437..1850; Strand=-
  SCN-specific regions: Sequence locations=1-171,193-361,384-414
gctgttcccacttcgatatgggccgccaacgatgatgacatgtacaagccgaagcagtacgaccagcaggaacagccgaagcaagcggagcgaccagcagcagcgtacggcgctaagctggccgacgacgacatgtacaacccgaagcagtacactgaacagcagaaggcagcggcggctggtggtggtggtcgaccgacgtatgaagccgcacttgccgacgatggcttgtacaatccaaaacaatacagtcagaaaccacaacagcaacaacaaactggggccgacgatgatgacctgtacaagccgccgcaacaatacaatcaacagcagcagcagaagatgggccgaccgaaatcgtatgaagatgagcttgacgaagatgatttgtacaacccaaagcaatacaattag

SEQ ID NO: 68612 - DNA, 77 bp, Heterodera glycines
  Genomic contig location: Contig_ID=SeqID_8585; Location=423..499; Strand=+
  SCN-specific regions: Sequence locations=1-77
ttttttcctgagctccccgtggcctgaaacgcacgaaaaacatgtttttttgggctgttgttaagctacttttcgag

SEQ ID NO: 68613 - DNA, 95 bp, Heterodera glycines
  Genomic contig location: Contig_ID=SeqID_40212; Location=118..212; Strand=-
  SCN-specific regions: Sequence locations=1-18,46-95
atgcgcacgtcccttttgatccccctcagccttttctctttgatcactttgctgttcattgtcagctttagtgaagcggacatcgaaatggacag

SEQ ID NO: 68614 - DNA, 291 bp, Heterodera glycines
  Genomic contig location: Contig_ID=SeqID_40217; Location=725..1015; Strand=-
  SCN-specific regions: Sequence locations=1-101,140-291
atggactgacaatgagtgcggtaaatgggcgagaaaggaatgacggatggatgataataaacaaattggcattcactgaaacattccattcattcgtcagcatttaaaaatgttttaatttaaattaatttataattaacaggcgcaatttattatttgattttattaaaaacaaaacaaaaaaacatgctgagtaaagcgcgcatcattgtggaacagagcagttcaaaatttttgtcattttattataaaatgccacttatgtttctacctctttttaggcaactcctt

SEQ ID NO: 68615 - DNA, 138 bp, Heterodera glycines; identical to SEQ ID NO: 50950
  Genomic contig location: Contig_ID=SeqID_40220; Location=318..455; Strand=-
  SCN-specific regions: Sequence locations=1-138

SEQ ID NO: 68616 - DNA, 681 bp, Heterodera glycines
  Genomic contig location: Contig_ID=SeqID_40220; Location=457..1137; Strand=+
  SCN-specific regions: Sequence locations=1-60,82-681
tgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaac

SEQ ID NO: 68617 - DNA, 270 bp, Heterodera glycines
  Genomic contig location: Contig_ID=SeqID_40220; Location=974..1243; Strand=-
  SCN-specific regions: Sequence locations=1-270
tcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttt

SEQ ID NO: 68618 - DNA, 214 bp, Heterodera glycines
  misc_feature (34)..(34): n is a, c, g, or t
  Genomic contig location: Contig_ID=SeqID_40221; Location=1047..1260; Strand=-
  SCN-specific regions: Sequence locations=1-214
aaacaaaaaaatcgattttttcaagtgtccgttntgggcttttcaaacaattatgggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaaca

SEQ ID NO: 68619 - DNA, 302 bp, Heterodera glycines
  Genomic contig location: Contig_ID=SeqID_8587; Location=46..347; Strand=-
  SCN-specific regions: Sequence locations=1-302
atggtggtgacggtttggtggcacaaagtggcggttggtccgaggtaagcccgagtttgaaaaactcataaaacttttttcctaggttggaaaaacgggaaatttttggggctaaaaaaaattgaataaatttttgcacgcgaattattactcaaaatcccaagaacaatttatcacaaaagaatttttttttatgtaaaaaaccttttcgatatttaaaaattttctttttcagttttttattcatttcaccggcggcgctctcggaggcattgtgggcaccagcttcacttatcctttag

SEQ ID NO: 68620 - DNA, 1336 bp, Heterodera glycines
  Genomic contig location: Contig_ID=SeqID_8587; Location=388..1723; Strand=+
  SCN-specific regions: Sequence locations=1-488,510-557,579-637,661 -912,948-1057,1086-1272,1294-1336
atgcatttgccttggacatttggaatcattcatttttttagatttatttatactcttaaaattgaaagtgttgtgatggaaagtaaaacccggattcgaaaaggcaaatttcgaatttacagaaaatttaaaaattccgaagctccttctttcatttttttttctcgaaacaaagtcacttatggcgatttcaaggtcggagaatccgattctgacaactatttcgacccaattccgaactccgaacacagtctcgaacaaaaagccgaaaattcaatttttcgaattcgcatttttggtctacaaatggttgaaaagtactttattgaaacagtgatgatttttagtttgtttccttaccattaagccggttttaaatcaaaaatgcaaaattcgaagttacgactttttgttcgaaaacgggtccagggtttggaattagaccgaaatagatttcagaatcagatatcccgacagtgaaaacccttaaaatgactggggaccagctcggctactaggtatgcagtgttaaaatttttcggggggattaccccttcacaaacaaacaaaaaattttcgctgacccgacgaatttgttgagggaagtgctgaccaactctgtcccatttcgttgttttggcacttggaaagtgcagaaaaatgggagttaaacattgaaatatcatttttatccacgccgaaatcttaatttcttgaaaaattatcattttttgttgtaaaacgaggggggggggggggtgggggtaagaaagccaagaaaatgacatgagaaactgaaaagaggtgtatgtttaaatggaaaaataggtaatttgatatgcaatatttcataaattacatggatttcgattaatgtaaatcctaactaaaataatatttagtttaacaaaaaacaacactaacaacaacaaaaataacaacgacaaaaaatcaaagtgaaagttgagcaggaagcaacaatatgtaagcgaatggtggtaacaaaaacaaaaaaataatctgtcaaaatctatgatgaaattcaaaaaaaacaaacaaaaaattttaaatgaaaaatttttataggcggctaggcgagagttgggtagggtataattaattgccgatggacagacaatcttgatcgattatcgtgccacactgcgattttttcgtgcaaagaactgcttcaactcctcatagcagccgatcatgacggcacaagcgggtgccacgcgcgcaacacgcggcacggcgcctggggcacaaagagaattaaaaacaacaaattatcggtgaaagcaaacaaggcaattttgttccttagccctagaca

SEQ ID NO: 68621 - DNA, 1273 bp, Heterodera glycines
  misc_feature (6)..(6): n is a, c, g, or t
  Genomic contig location: Contig_ID=SeqID_8588; Location=209..1481; Strand=-
  SCN-specific regions: Sequence locations=1-224,248-374,449-505,557 -566,610-803,828-975,998-1072,1130-1273
  Gene Ontology: Mol. function=transporter activity; Cellular component= mitochondrial inner membrane; Biological process=transport
atggcnccgcttttggctggcactgtcgcccgcacgatggccgtgtcggtggtgtccccgctggaattggtgcgcaccaaaatgcaatccgaacgtctctcctatagcggtaaaaatgcctaaaaatagccaatttttcgaggaaaattttaccaagaaatgataaatttgcagttttttttttcttgtgagaggggcgtaacaaaaaaaattttagagtaatcaaaaaaaatttttttttttttttgcaattttaattgagtttagaattgcgaggtgcaattgtgcggacagtcaaatctgatgggtacatggcactgtggcgagggtggacagcgacaataatgcgtgacattccattttccggtttgtcgaaaaaaaaatttttttttgtataaaaatattgttcaaaatttaataataattgaactaagattttttttaaattgtccaaaaaaaccgctgaaaattaaaactaaagttttctctggaaattctatgtttgtaaatattttttatgtaaaattttctcatattttaaaaatgtaaaatttatgggaatttcctttttttctaaaatttgtaaattatcattaaaattttttttttccagccatctactggtccctgtacgagttcagcaagccccgtctgatgcaaattgcccaccgccaacagccgaactttgcgctttccttcgcctccggcgctttgtccggctccgttgctgcccttctcacattgccatttgacgtggtcaaaacccaccaacaaatcacgttgggccaaattgatggtgcgtttaaaagtttttcaaaaaatttaagtgagcgaagaaatttaaaaggaaattcgtcaattttagagttttttgtgccattccctcattagcggacacagctgggagagcacaccccaatctctcctcatttgtctaactgtctttcctcttattttcctattttctctagccgtccctctttttctctttaactcgtacatgggggagggggtgtaccattttgcccattttttagaaaaaaatttcgacgattctattttcttgcgattcaaaaaaaaaaattcttgaaattttctaataaaaaatttatgaaaaatttttaaatttgcaaatttttcaaaaaaaaaactttcccagctgaacggcatgcacaccatgagaaggcagcaaaaatgtcgacgcgtaacaccaacatgttcggagtgatgcgcgagctggtcaacagcaaggggcttggcgctctgttcaccg

SEQ ID NO: 68622 - DNA, 1407 bp, Heterodera glycines
  Genomic contig location: Contig_ID=SeqID_8589; Location=373..1779; Strand=-
  SCN-specific regions: Sequence locations=1-915,949-1407
  Gene Ontology: Mol. function=transporter activity; Cellular component= mitochondrial inner membrane; Biological process=transport
atggaccatctttgccgagtttgtggcaacagagcggccggcattggcactggcagtgaacagtgcgaatggttcaaccgaccgggccatttcagtggcacgctggtcggtggtgggtttttcaggcatttttgggttcccctgctattcgacatttcattatttaaggaccatttgggatttttgcggcccaaatttaatagtcggccttttgtgccaattcctggtgtaatttgtcccaaaaattggggaccagtcaaccaatttggtttcagtaccccaatatctgacagaaaaaaatttctgtcatcttttggaccttacaatcagttttatctcgtcctgatccgttttggaaactatggttggttgcatcttattcaaaaaaattttttttcaggacgctttcgtgaaaattgttcgaattgagggactccgttcgctctggtcaggattgtcgcccacaatgtaaaaattcagcaaattaaaactggttttaactcgaaaatctttggctaacaaaaaggacgaaacatgatgggataagggcaaatcttattaaaaaaaatttgcaaattttggcaaagtaatgtttaaaatttttttttactacaacttcaaaattgttcataaaaaaatccaatcaaaatttttttttaacaattttagggcttttttttgaaagtttttaagttttggtatatttttttaaattttctcgcgtgcggttggaactaaagcatgtacttactcttttttgattaatgattgaattaaaaaaagtgcccttttaaggctcagtgccatccccgccactgtgttttacttcacaatgtacgacaacatgttgtgcatgtggcgcaacgcattggccagcaacaaaaacaacagcactttcagcggtgccggtgagtgtaaattagaaaaaaaaaatttttttttttttttgctgcttttcggcagtcaaaaatttgtacggaattttgccgaaacctaagcgaaattttttttttcattatatacctatgcactaatttcagcgttcatggccccgcttttggctggcactgtcgctcgcacgatggccgtgtcggtggtgtccccgctggaattggtgcgcaccaaaatgcaatccgaacgtctctcctatagtggtaaaaatgcctaaaaatagccaatttttcgaggaaaattttaccaagaaatgataaatttgcagttttttttttcttgtgagaggggcgtaacaaaaaaaattttagagtaatcaaaaaaaaaatttttttttgcaattttaattgagtttagaattgcgaggtgcaattgttcggacagtcaaatctgatggatacatggcactgtggcgcgggtggacagcgacaataatgcgtgacattccattttccg

SEQ ID NO: 68623 - DNA, 56 bp, Heterodera glycines
  Genomic contig location: Contig_ID=SeqID_8590; Location=363..418; Strand=+
  SCN-specific regions: Sequence locations=1-21
gtcccggttcccggtcccggattttgaaaagctcaggtcccggtcccggtagggca

SEQ ID NO: 68624 - DNA, 748 bp, Heterodera glycines
  Genomic contig location: Contig_ID=SeqID_40223; Location=92..839; Strand=-
  SCN-specific regions: Sequence locations=1-87,115-319,341-357,381 -676,706-748
  Gene Ontology: Mol. function=DNA-directed RNA polymerase activity; Cellular component=DNA-directed RNA polymerase III complex; Biological process=growth
atgggcgaacacggcattgagttggacagacggcacgtgcaattgttggccgatttgatgacttaccggtgagcacggggagcattaaaaattaaagaaaaattttgaaatttttcagtggccaagtgttgggcattacgcgtgatgggctggtcaaaatgaaggagtccgtgctgctgttggcctcatttgagcggaccattgaccacctgtgagtttgacattcagacctttttttgggccttggaaaccgggaattattttatttgcccgattttgggggggttcgtgcctgatttttcaggaggattttgctcggtttactatttttcattcaaatttagggactaatttcttaataaatttattaaaattcttgggatttttgtcaaattttatgatgaaatatttttctagaaattttcttttaaaaaagttttaagttagaattattttttattttcggggagggcggaagagtcggggggggggggggcgctgagctgcaccgcaaaattcccacacaatttttgtagttacgaggccgccttctttggccaacaggaccgaatttcgggtgtcagcgagtgcatcattattggcacaccgatgggcattggtaccggcatgttcaagctgttgcaggtcaacgaatttttttatattaccttgcatgtattaaaaaaaaaattttttttttttttagaatcagaaacccgtcaaatttgtgcagcaaagtgacaaacag

SEQ ID NO: 68625 - DNA, 250 bp, Heterodera glycines
  Genomic contig location: Contig_ID=SeqID_40224; Location=369..618; Strand=+
  SCN-specific regions: Sequence locations=1-152,175-250
atgatgcgatctattgctgaagagaaaggcggtttactttcttcgacattccaatttcttgtacaaagtgattcgagtgaattaaggtactttcgttagttaaaaaagtaatatttgcttgaagttaattgccaattaaaagatcattggcgcttttagaaaaatgattatgtttcaagttcctattcatgaaaaacttattcttttgcttctaggagtccctgatcacgaatctgaacatctattttga

SEQ ID NO: 68626 - DNA, 1082 bp, Heterodera glycines; identical to SEQ ID NO: 40225
  Genomic contig location: Contig_ID=SeqID_40225; Location=1..1082; Strand=+
  SCN-specific regions: Sequence locations=1-336,358-971,997-1082

SEQ ID NO: 68627 - DNA, 330 bp, Heterodera glycines
  Genomic contig location: Contig_ID=SeqID_40226; Location=522..851; Strand=-
  SCN-specific regions: Sequence locations=1-39,67-258,280-330
atgtcgccttatgggcacggaaccgtcgccgcggggtatcagcagcagcagcagcagcaacaacagagtccgttcgccgcgctcaacttcatcccttacggtgccgcaccgcccgagggcatcgaagaacggcataatgccaaccacaacaacaaaatgatgatgatgaacagcaacgagcgtaaacgacacagcatcaacacgactgcagcagcagaggccgcactgatgggcacgacgggggtgcccgaattggagttgggcccggacggcgccaggggcagcgtgtccctgcaaatggcttacgagccggccaatttggcattacag

SEQ ID NO: 68628 - DNA, 434 bp, Heterodera glycines
  Genomic contig location: Contig_ID=SeqID_40227; Location=753..1186; Strand=-
  SCN-specific regions: Sequence locations=1-56,83-158,180-183,205 -209,235-389,419-434
agttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcacgttctaaagaatatttatgaattaattttgcaaaataatatataattgatgaaaaagtcagaatttcgaaaaattttaaaaacaacaagcgttggcattttttcaggttaagttagtcctttacaatggagaaggcctgcaaaatttggagagttatatcgattttagtgcgctaagttcgatgaaactttttaaaatataagcctaaactttttggcctgtttaaaaaggaattaaacatttttaaaatatttattcatctcccttttgatagaa

SEQ ID NO: 68629 - DNA, 646 bp, Heterodera glycines
  Genomic contig location: Contig_ID=SeqID_40229; Location=252..897; Strand=-
  SCN-specific regions: Sequence locations=1-646
aaacaaaaaaaatcgatttttttcaagtgtccgtttgggggtactcaaacaattatggggagcaaaaatccaacgcagaattaaagtgcaggctatagggaagctattccggaaggattcggtctccccataaatctgggcgcatcggttcggggggactgccccgaatttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaac

SEQ ID NO: 68630 - DNA, 152 bp, Heterodera glycines
  Genomic contig location: Contig_ID=SeqID_40231; Location=71..222; Strand=+
  SCN-specific regions: Sequence locations=1-152
ttggatgagacagtggccgagagtttctacggcggtgtgctcgcattatattcaatttcgcaaataattgcttcaccgctgctcggctattggtcaaatcgtgttcaaagtcataaattacctctgtaagttgtcataattttaaattacaa

SEQ ID NO: 68631 - DNA, 589 bp, Heterodera glycines
  Genomic contig location: Contig_ID=SeqID_8591; Location=1..589; Strand=+
  SCN-specific regions: Sequence locations=1-47,69-395,417-589
  Gene Ontology: Mol. function=protein binding; Biological process =positive regulation of transcription
agctgcaccgagcccattttgagcatccgccgcctcccaacctgcgcaaatccaacttcttccacttcacagtcaatctgtacgaccgcgacaatcagcccattgaggtgggccgtcagcaaaaatgccaacaattggctggatttactgttttggaaagtcctacctattcagggttgaaaaaaattccggctaaaacctgctcatttgtgtgttggttgagtcgattaagcccgaattttttagtaaaaatttggcgattgccatagaattggcggctgtcatttaaaatgccgtcatcaaatatacagaataccggaaaaagcttgtttttcggataaggaacaaagatggattcagaataattttaactctctcatatttcaaagtcagtcaaaccctaaaatacaaaaattggcacccatcgccggggtcattaactcattaattacactcaattaattactgtgccaactcgctcagattgagcaggccatctttgccggctttgtggagaaggaaaaggaagtgcacggggagaacacgcgcaacggaattcattatcgcgcatctctgcttttcgctaacg

SEQ ID NO: 68632 - DNA, 118 bp, Heterodera glycines
  Genomic contig location: Contig_ID=SeqID_8592; Location=174..291; Strand=+
  SCN-specific regions: Sequence locations=1-20,51-118
atgactcgcgcatacggtaaactccttggtccgtgtttcaagacgggtcgaacagatgaccggcttatacaccgagaacgcacaactgagagtccgagatggaccgcattggttgctg

SEQ ID NO: 68633 - DNA, 475 bp, Heterodera glycines
  Genomic contig location: Contig_ID=SeqID_8593; Location=1347..1821; Strand=-
  SCN-specific regions: Sequence locations=1-53,76-115,137-183,206 -330,352-475
atggacggcattgtgccaccggcggatgaggatgaacaggtgccaactatggatgaagaggagacggatgaggaagaggaagcgatgccaccaccggcagttgttgaggatggagcggtggaggatgaggaggagggtgccaatgccatttctgacggggagacagggggatatgggaatgataatgatggcatggcatttttgggggtgttattctggattggacagtaatatgcgcacggcatttggcggggaaaatgaggacggcatttttggggtgaaaaatatggcatatttttttgatgacttggatagcatttttgtatgtcaaattgcaaaaatgtcatttttgatgggcttgaaacaattatgattgggaagaaaatgccatttttagacaccaaatcaataagactcaaggaatgatggcattttttctgaagttaaggagcgaatttggcatttttcgattaaa

SEQ ID NO: 68634 - DNA, 1104 bp, Heterodera glycines
  Genomic contig location: Contig_ID=SeqID_8594; Location=320..1423; Strand=-
  SCN-specific regions: Sequence locations=1-112,182-377,452-1104
atgtggccacccccaattctttttgagcggacaaatggtgaagagtccgtttttgtaatttcactgcgcgcacgcgcacttcttgctgaccaagacccgcacgagatggtccttttttaattttgaatttaaattaaatatttaaatggatttttaattaaatggttttaaatttattttagcgagaaaatgtccgcgcctatttttcggaacattgtgacacgattagcgaagtccacgaatgcgatttgttttttgttcaactgaatggaggcgaaggctggtttccggaggacgatcaaattgtgagttttaaacagcatttaaaaatgatggtgtttggacgtttcctaaattggacaggccaataaaaatgctatttttaaaattaaattttatattatttttaacattggcaaataattacataaatttattaaaattaataattgtttccagttttttgcccttgttaggcaatggccaatatgagttttttgggaaatgactagcaccacaaatatagccaatgtttttagagttaaaaaaatattttcttattttgtattattccttatttttcttccctccccctccggcatttagcaatgggattttgccattctgcaatttgatgatcacgtgaaaaaacgacacaaatttgatcgcataattcgatgggtcaattccggactgaaggcggtaaatttgttaatcttttttcttagatatttagttctaatgaaagaatattgtatcaatcaaattaattgcgggatttgtgagattaatcaaacccatgagattccgcaaaaattagagttcaaaccttgcagccgggatccgcaactctaccttattaacttttttaaaaaattgaccccaaaaagcgttgtttatttattttttggacaaaatttgttttatttttagttttttgagatttttccaaatttttatttgaaagtatatcgtaaattaaaattcagggctcaagttgcagctgccctatgtttttttcattctattttagattgaagaaaaccgagtgcccgcatccccgagggaacgttcggattcggacgaaggatttgattaaataaa

SEQ ID NO: 68635 - DNA, 920 bp, Heterodera glycines
  Genomic contig location: Contig_ID=SeqID_40232; Location=121..1040; Strand=+
  SCN-specific regions: Sequence locations=1-82,104-110,133-166,197 -265,450-665,688-715,749-753,779-920
  Gene Ontology: Mol. function=protein binding; Cellular component =nucleus; Biological process=eye photoreceptor cell development
atggatttcgatcactcaccgactttgttcagtgaaactggatcagaaacagaaaaaagtgaaggaaatgaagaaggcaccaaaagggagcagaaggagaaagacgcatcaacaaaacaaagtgagaggggaaaagcacaaaaagtaacgaacttaattggaaaggtgacgacgaggaagaggaggaggagacggacgagtcatcaacagcagaagagaaaggaggagaagcattgtcagaaagggaagaatgttggaagagaatggaagaagaggaggaggatggggaagaggagggtgaggaggaggaagaggaggagggggaaaaggaggaagttggaagagaaaagggacagagaggaagagggaaagaaaaaggaaacggaagagatggaagaataaagacagcagagaatggaagaggaggaggaggaaaaccaggaggggaaaacagaccaacgactgtccgttcaatgaaaaggaaatgcgccaacacttcggccggtggtcctctgttccaatatccttccgaggtcagtcgaagggccgaaaaacgaccgaccgaattcgattcacagatgtacgccgctggagaacaattttccagagaagtgaaaactaaaaatgaaaagagttacaacaaaattttaggaggaagacgcacagcaaaaaacacacggaaacaaacggagagggccacggacgacaatcagccaaaaacaggtgggggaggggagggcgagggaggagaagcgggcggacggacggacggacggacaattaagctggacattctgaaccgaatgttcgacaacacattcaaaccaacgaagcacgaaagggcccaattggcacaagactcgggactgagcatgagagtcattcaggtgaagcgaaatgggaaaagtgcgaaggaatga

SEQ ID NO: 68636 - DNA, 582 bp, Heterodera glycines
  misc_feature (33)..(33): n is a, c, g, or t
  Genomic contig location: Contig_ID=SeqID_40234; Location=91..672; Strand=+
  SCN-specific regions: Sequence locations=1-135,158-315,337-403,426-582
atgttgtccgacaattggtccctccgagctgtngcaaaatggacaagggaatgtcgccgcagatccctggtgccccatcagtgccgaagtaaatttgaggtcggcacagaggagcctgaaaattacaattggcattcctgttatttttatttcacatttggactgaaatggtccgctagtcccggaaaaatgaacagatttttggggaattgggtggccaacattaccgatgaccatcgtaattttatcgttgcagccacctacctcatcgcctcccttatcgcccgccaacaccaacacaatttgggaggcaaattgctgctgcagtttcagatcgccttaatttatcaaaaaaaaatcactttgactgccattttcccaacgctgttcgtcccgcctgaacctgaagtcggcctcgagcatggcacgagcattgatgcaaacaagttcacacgtctgtccgtcccccatccgttgacagtccgcccacttacaagttcccaccttcagacgcttcaccgctctcgtcggtccccaaacgtcaagtccctggccggcgaacgaccgcttcacgggctttga

SEQ ID NO: 68637 - DNA, 65 bp, Heterodera glycines
  Genomic contig location: Contig_ID=SeqID_40237; Location=164..228; Strand=-
  SCN-specific regions: Sequence locations=1-65
tgcttcttgagaatgtcgacgattacgcaggcgaacattgtgaggccctcgggaaattgcaaagc

SEQ ID NO: 68638 - DNA, 332 bp, Heterodera glycines
  Genomic contig location: Contig_ID=SeqID_40238; Location=212..543; Strand=-
  SCN-specific regions: Sequence locations=1-33,56-64,92-123,147-332
atgtctaaaataaagtcaatagggtaattacaatccaattttatcaaatttttccagcagctcttcagggtatttatttcttttttgagatctgatctcctaaaatttttgcaccatcacctgatataaattttttaaattaattacatagaacactttattaattatcatagttattaaggttttgtgatagctaatgtcgtacaaattcaattaaaaaaattttcggatgctttattcagataaaatattatataaggatttatccagtattaaagttggtaaataattgctatattttgcttacaagggtcctcacaacaaataataaa

SEQ ID NO: 68639 - DNA, 76 bp, Heterodera glycines; identical to SEQ ID NO: 51235
  Genomic contig location: Contig_ID=SeqID_40239; Location=991..1066; Strand=+
  SCN-specific regions: Sequence locations=1-76

SEQ ID NO: 68640 - DNA, 156 bp, Heterodera glycines
  Genomic contig location: Contig_ID=SeqID_40239; Location=1422..1577; Strand=-
  SCN-specific regions: Sequence locations=1-98,125-156
ttcataaatattttttagaacgtgctctgaaacgcaccaaatgttaattaaaagttaaataaggctctctgatgctttcactatcaaaaagggagatgaataaatattttaaaaatttttaattcctttttaaacaggccaaaaagtttaggctta

SEQ ID NO: 68641 - DNA, 1839 bp, Heterodera glycines
  Genomic contig location: Contig_ID=SeqID_8595; Location=1..1839; Strand=-
  SCN-specific regions: Sequence locations=1-304,326-452,474-834,856 -1556,1600-1839
tttagtagcgtttgatttttattttttttttgacagctctaattagaaatttctaaaggattcgttgggaggcgaccgatgtgcgagattcggtggtactcggaattggctcgataaatcccgaatgtttcgagtaggatgctttccttttggctgtttttacactgattaatttagatttctactcgaagaatttaattccaaaggcattttgagagagataaatgaccgtaaaaacgaaacaaatgttcgacgccggaagcgaaaagatttgttacgactacaaattcttcggatcattgaatttaccctttttcgtgactttttgaagaattgtgctattttcgagcgaaattctggcactttgcctcagtcattgctcgaattgttcgactccatccgttttcatacagaaaatgacaatgtatggatatcatgtaattgcatctaaattctaaaaatttcatataaaaaggaccgcgacctgaacgttttgaccagtttgagactacattttgccaagctcatttcactgatcatcaacggcacgccaagtgagagagaaaaaattggaggttattaattctgttatcagttgaacaacgcgagaaactgttaccaccggacataaaacgttcgctgttctttttgtttttgtcgtggtgcggcagaaccattggtacaatcgacaaaaggttcggttttcttgctgattaaagtcattttacttttatgattcagaaagggcgtcgatgttggcatttctgttgaacaccatgccattcgggcgatgtgcgcactcgccacccttggcccaatgttcgaatgtccgggcagaatttgtgaagaagaagcaatgttccgttggttggaaacacttctctcgtcaacgaattcaattgtcagaacaattagcaatgtcaattatcccatttttgtaaattaattttcacaggtcgatgaaatttgtgagcagatcctttgccatattctccatttgaatgaacataatccgcgggtcggttttttctgccgttttggtcaataagccattgccttttagcttttggagcttgttgtccaaatgtgttacaccaaaaatgacttggtcggcatccgttgtttcaatgcaatttcaatgcttttctcacaaaggttttctttgtcaatgctgcaatccaatttgaattggttttgtcttattttagggaattcccctgcgagtacatttctcttctgtgtctttgccaatccttcgcttcgtccattgaattggcctccgtccgtcaaacggcctttttgctggtccaattgttgcgtcatcaattccttaacaacactttctctcccacaactctcacgccgataatggaaataagcagcagttttgcaacaaatggacagtcagaaatgtgagaggaatcattgcagaaaagttaaaactgttctaatttttagcactttcccgactaatcagtttggcatcagcaagagtttgtcctcccaataccctcagctgactatgcccatcttttcaggcaattcctttcggtcatcaattacttttcatattgaattggttccattttcagaaatttgctgtcgcctcgaatccgcccgacccaatcggcaattgtcgttactcgccattttgcccgaatggctgcggaatgtgcactttgtggaccccaactgtgaccttgtttcggtctctgttctggaaacggatgatgaagctgaaaaaagcggcactagcgcagaagaagaacaaagtgtcgcactgaacggatgcggatcggaagagagcactcagctgatcctcaacaatttgctttatct

SEQ ID NO: 68642 - DNA, 3427 bp, Heterodera glycines
  misc_feature (21)..(21): n is a, c, g, or t
  Genomic contig location: Contig_ID=SeqID_8596; Location=1..3427; Strand=-
  SCN-specific regions: Sequence locations=1-374,396-1063,1109 -1313,1335-1579,1604-1620,1642-2104,2126-2216,2238-2401,2431 -2738,2763-3139,3167-3311,3333-3427
gtcgaggcgatgattcgtatnttgcaatttgctgagggcacttagtggcgtttgtgagacatgccttccgtccatattgaaagtgatgatcatgtggtacgagcatcagcagcgtgtttctataaccgaaattgggtaacctttttttgtttggtttgttttaaactgttcaaaatttagcgatgctcgcgacagggcaattaaacggacattggcggccagttaccttttttgcattgtgctcatcgaaattcttcctcagctgcattttcacccatgcggatgtgacgagcagatcaattttatcatcgacaattcgtttaaacaaatttcttaccgagacccgtaagtcaaacacaataaggtcttaccggaaatgaattatttggaaaatatcctacacttagagcactttttggaaacaattatgacaacagtcttttggtggccgagctgttcgcggaagtcatcggcattttgtcccaaagtcattcgaaacaaattcaaaaaacttttttcgaccacctcaatgagtacagaaaggacgccctcaccagctcaattgctttacggtccattatatctcttctgatgggaacgaagtttttcagagttcaggcaagttggcgaagatattaatcatatttgaaacacaattaaatgcattttcagactaaccaagtgtcggaatttgaaattggagtgggttttctcaacgaactcggctcttattttttggaggtggatttgaaacaaaaggatttgaagcatgcgttggctggacttctggttgagattcttctgcccatgacagcggtgggttttaatcacccgggatatttgttttaaaaaaacaattcattaattttaactccgtcaatttccaaatttttattacatttacaattagtttttcgaaaggacaaaaatgggcggattaaagaaaaacaacatgttttttgttttttcttatctttcatttttagcaaatcagaacagaaacgaacattccttcactgatttcttttgttgacaactttacggcccaacctacgaattagtgaacaaaaaacagcacaaaaatggtatattttccctcttttttgggtcgttttttacctgtccattcttcaggcttcttaccctcttctcacgtgtcttttgtgcattagtcaagcaaattcttccttttccacttgggttcaatttttgaatttgactcttgcaaatttgaagaacaaagattcgatggtttcccgaatggcactcgaatcgctctatcgcctcatttggtcagaattcacttttcctcctcattttatttattttcttttagggtttacataattcgaataagttgtgaagggaatacggcgacaaggagccgtgagttcatttacaaatttatcaaagttaaaataaaatttcactcttatttgcccctttttattgcttttttaggcctcgaaagcatttgcggaagtcttttccctcgtggctcgcgaaacttagttccgcgtgatgccccgctgaacttttttgtcaaaattatccattttattgcacaattcaaagttgactttgcatttaaagtaatgtttttggatgaaaaatcaaaaagaataatattcaaattactgtcaggagattattttcgatttgattggatgtgcgcgagcagcctctcgccaattggccatttatcccgaacgaatgaatgtcggtctgcgcgctttgatggtcatcgcggacggtctccagcagaaagagagtcccccgggaatgtcgagatcacttggtttttgacttattaaaattgtttaaatttttccgtttaagcgccaaatactagcgggacaattcatcgaacaaagcgcaattacatcaccaaacctttgtcgatggatgttgcccgggccattggtctagaacaatattatccgcactgtaggaaggcatttgatgccattttgcgaacattggacggacaaattggtaatttacaaaaaaaaacaaataggaaattaaacgatttgacaggccgaccgctgatgatgacagcgccacaaatgcgggggaaggaatacaacgatttaatcggcgcggacatgaaagccaaactggacttgtgattgcacattttagtcaaaaaccatattcaattagtcaaggtttcggacgtgcattgcggccattcctcgtcttcttccggacccaatgtcccaccaggacttgattgactttttgactcgaatgtgcattcatgtcgacgaagaacttcgaacaacggcgtaccaatcgcttcagaatttggtcaccgaatgccccgaatggcgggaggacatcattcacaatttcattcgctttttcatcagttcgattcaggtgggtgactatttcgatgtcatttttacatttacttttaaaggatacttttcctgctttgattgagtcaatggttcgtttgctgttgcaacttctcactgtttggaaggcgaacattctcatggagcagcaacggaagaaagtcgaagagtccactcaaaacctttcggataattttacgaagcattatccgtccgccagcgaatcgacagcgcagacgaacccatcgatggccgagaaagcaacgccaagccaacaaaaattggtgatgcaagcagcggccaatatcatcgccacgtccacatcctcaacgggcaacacaacttcctcttgctctggtgccattgtttcccattttttcaacttttattttggttcagatgggtctccccaaatcatccgttccatcatttcctctctttccttcgctgataatatcaatcccacctttgttttgcattgtgttgaaggacttggcattgctttgctgtgtcaaactcgtctttcaactaaaaaggcggtcattcaattacttagagaggtcaaacaattgatagaactgttcaaaccatcggtaagttttatttggtcaatacaatattttgttttcaattactaacaattaaacttcagaatcatgaaatggcggtcattgacattttggattccgcgactccgtacgttcttgacaaatacgtcgtgcatcttccggcgctggaaaaggttttagcagctaatattaataaattaattgtgcttttttattttatagaaaaaatggccaaaagatttcgcattggtttgtgagcgcatttcgatgttggagacagacgcgaatttagtgaatgtggccaatggcaatgagtgagttgacggccttgaagcattttaaggcattttatttgttcatttcccattgtttgggtatatgcaatgggatccatgggcctgcgctttgtcgggttattgcgagaagaaatttttgcccactcagtgctcaacagcttccacggtcagctcgtcatttccacatattttttta

SEQ ID NO: 68643 - DNA, 1005 bp, Heterodera glycines
  Genomic contig location: Contig_ID=SeqID_8597; Location=89..1093; Strand=+
  SCN-specific regions: Sequence locations=1-616,638-1005
  Gene Ontology: Mol. function=ATPase activity; Cellular component =nucleus; Biological process=mismatch repair
atgccacgtatcatccagcttcaacaagaagttgttgataaaattgctgccggcgaaggtctttaaaacttaaattcctattttaaagcacttcaattttttaatagttgttgttcgaccaatgaatgcggtaaaagaattgcttgaaaatagtttggacgccggtgcaactgaaattcgtattgaaatcattcaagggggacttgaactcattagaattcaagtaaatcattatgaattattgaaatctcaagggggacttgaactcatttgaattcaagtaaatcattatgaattattgaaatctcaagggggacttgaactcatttgaattcaagtaaatcattatgaatctatcttcgaaatgatatttcgaatgaaggacaatgggcacggcattgcccgggaggacatgtcattggcgtgcagtcgttttgccacctcaaaattgcatgcggctgaggaattgcgatccattggcacttttggctttcggggagaggctcttgcttccatttcgattgtggccaacagcgtcacgataacatccaaaacacaatccgacaaatgtgctcatcgtgctttatatcgcggtgaattttggatatttacccggaatattttgaaaatattttaaaccaaaaaggcaggtgggaaattggagtccgattgttcctccgtggcgggtcttcaaggcacgactataaatgtggatcgcctttttcaaaatgccccggcaagaaaagcagcattacgttatccgaatgaagaagcgaatagaattgccgatttattagtcaaatacgccatccaatttccgtgagcaatgcaaaaaaaaaatcggcgaaattcattgttattttcactaaatgcagctcagtcagctttgttttccgtcgtattaacagcggaggaggaggcggcagttgtggtgactttcgcacaaatggaaacggagaccaacacagcacaattcgcacattactccatgccaaaatgtccaag

SEQ ID NO: 68644 - DNA, 49 bp, Heterodera glycines; identical to SEQ ID NO: 51181
  Genomic contig location: Contig_ID=SeqID_40243; Location=823..871; Strand=-
  SCN-specific regions: Sequence locations=1-49

SEQ ID NO: 68645 - DNA, 177 bp, Heterodera glycines
  Genomic contig location: Contig_ID=SeqID_40244; Location=1..177; Strand=-
  SCN-specific regions: Sequence locations=29-177
gttctccacaggatacttgtaaagcgattggcattatcagcaacaacccggagtttgccgatgtgcgtagcctggaagggctttccccgaccaataaacccagtgtaccgattctggcaattcctaccacagcaggtactgcggcagaagtgaccattaactacgtgatcactgacg

SEQ ID NO: 68646 - DNA, 650 bp, Heterodera glycines
  Genomic contig location: Contig_ID=SeqID_40247; Location=500..1149; Strand=+
  SCN-specific regions: Sequence locations=1-186,208-587,609-650
atgccacggcgcgctttgctttcaatccaaacggacattgaacaggcggcgaaagcattgagcacggaaacggtgggccaagtggcgaagccgagcaaacgtataaaacggaatttaagttggaaaaaattggaaggaaaagcggaaccgaaagatgcacagccaaaccaagaacagaatctcggtggtagtcaaaaagaaggaggagcggagagtgttgaacagaacgcggagccaattgacgcgatggactcggccccgccggtccaccaacgctttgagctaatagggattaattggacaattaaaaagacgattaccaaaataagaggaatgcctcaccgcgtacaatgtgccataagtcctcagacagaacaaccacgcgggaaggaaagggtcgcggagagaccagaaacagtgggggtgccatgtgtggctgaactcgtggcattcggccgtcagaattcgcagcccaaaagtgttggcggcaagccgcgacaacacattggtcattatgaaaagcaattaagaaagagaggtcattccgaataaaaagaatggcactaattctgccgaaccattaaaactaaaatatatggaaaatcggaccaaatcgacagttatggcaaaaaaaaaagcattggggaaga

SEQ ID NO: 68647 - DNA, 198 bp, Heterodera glycines
  Genomic contig location: Contig_ID=SeqID_40247; Location=41..238; Strand=-
  SCN-specific regions: Sequence locations=1-198
tcggatttgttgaagaggaagggcaagggagaccaatattggacaatcagcaggtgaaacaatgaaaaactggctcattatcaagtttcgcttttaagcaaattcaccaaaatcgacgggccccctcaatttgcggctcaaaagttttggattgtccgcccaaaatcccactacaaatgtgcgctgaaggcgactaag

SEQ ID NO: 68648 - DNA, 761 bp, Heterodera glycines
  Genomic contig location: Contig_ID=SeqID_40247; Location=310..1070; Strand=-
  SCN-specific regions: Sequence locations=1-364,386-761
agaattagtgccattctttttattcggaatgacctctctttcttaattgcttttcataatgaccaatgtgttgtcgcggcttgccgccaacacttttgggctgcgaattctgacggccgaatgccacgagttcagccacacatggcacccccactgtttctggtctctccgcgaccctttccttcccgcgtggttgttctgtctgaggacttatggcacattgtacgcggtgaggcattcctcttattttggtaatcgtctttttaattgtccaattaatccctattagctcaaagcgttggtggaccggcggggccgagtccatcgcgtcaattggctccgcgttctgttcaacactctccgctcctccttctttttgactaccaccgagattctgttcttggtttggctgtgcatctttcggttccgcttttccttccaattttttccaacttaaattccgttttatacgtttgctcggcttcgccacttggcccaccgtttccgtgctcaatgctttcgccgcctgttcaatgtccgtttggattgaaagcaaagcgcgccgtggcattttggtgccgtatctgctcaatttggtcactccgctttttctttttaaaatttaccctgtcttaggcctccgaagcactttttcgccaggcccaaaatcgccgatggatttgccgttctccgccaccttttccccattttcaatcgttgcttttcggcatttccgtcgcttctgccgttgctcttttgtc

SEQ ID NO: 68649 - DNA, 2859 bp, Heterodera glycines
  Genomic contig location: Contig_ID=SeqID_8598; Location=563..3421; Strand=-
  SCN-specific regions: Sequence locations=1-285,308-441,485-562,587 -620,642-722,762-792,826-992,1016-1237,1277-1377,1399-1832,1876 -1982,2014-2124,2153-2464,2490-2718,2745-2747,2769-2859
tttcttcacatcagttcgaagcgattcgggaaagaatgtgccaattgtagaagcaggtgaaccaacagcagaacgacaataatcagcatggtaaatacggtagtgatactgtatttttgtaaatacaatttaaattttgtaataactaataaataaagttcagtatttttcagtttctgctgatcagttcgaagcgattcgggaaagaatgtgccaattggagaagcaggtgaaccaacagcaggaagagaaggagaaatacggtaaattttgatttagaattgtacatatttttaatttctttaagctgatagccttatacaacaacaaaatgccgaacagtcagaattttgcgccaaaatcgatgaattgtcggaaaaatttgggcaatttaaggaaatgcacgaagaatttgtaatgaaaattgatgaggtggaaatgatttaaatttttaaaatttataaaattcaaaactaaattattagaattcaaagaataacaaaatctgacttaatttttaattttcgttaaacagaaaatagaaacaaataatgacaattacataatattatttttattttttattgtcacagaaaataaatgcgaatgccgaagttgccaatgccacccaaagaaaaagcactgaattggaagaacaacaaaacaaattgaaaaattgtgttgacattttgaactaccgattcggaaatggtgaaattgcaaaattaaaaaattaaattaatattaaaaaattaaattaataattaaaaggaaattctgtaaaaattactgtttaaaaattttaaaaaacaattttaataatttgtccctaatattttaagcacttattgaccaaatcttggaattgcaaaatgaacagaagacaattttgggacgattgaatgaaatggagaagaaacagcaaaaggacgaggaaaaggaaacggaaaattacggtaagtaaatgaatgcctactgtaacgaagcatttttaatcttttaaaactaatttcaaaattaggcgaactgaacgcaattttggaacggattggcattgtttgtgagtgaaaattggattaattgttaatcattttaacttattaggaacaataatttttttgctttaagctgatcgtcttttgcaaacgcaaaatgagcagacgaaactttgtgccaaaattgatgcggttgaaacgaactcatacgaactctttggcaaaagtgaatgtgaaaatccttataaatttttgataatttattatacaatattataaaacaaaaagacacattttattaattgggatacaggtaaaacttggactcagcccacccgaaaaaatgacatgaatttgttataaaactgcttaatattgaatattattcacaaaaatgtatgaaaaagtggcgacatatagtgaaaaatttttttttatcaacatttgaaatttttcaaaaaaacgtcatttttgagtgaatttatcaagaaatatgctgttatacatctatttaatactgtaattttagcaataatgggtgataatattcaaattaatgcaatttggaatagacgcaagctcttacatttttttggagatgagcaaaaagttataaattggagccttgaaaacggcttgttaacaaatgtgcgttactgctatggaaaacggccgacacggcaccacaaaaaggaaatgcgttttgacaaaaacagaggcagggccggctcattcatatgcagtacttgtagagcagaaaaagctctttttgttgattcgtggtttgaaaatgcacatatgccactgtcaaaaattttaaggtctttttttttgttgtttttaactatattttttatattttatgaataattattatttagtattatgtactcatttgcgcatcaagagaaatacaaaaaatgtattattgaaacaatggaaagtgaaaatgacacgatgttaggaatggacagtgtcgcggcatggtttaaaaaaattataaaatcaaattaattatcaaattaggtatcactactgccgggaaatgattgttgatgattttttggaaagagaacaggagcgaggacaaatcggagggcgcggctcaatagtgcaattagatgagagcaaatttggaaaaagaaaattcaacagagggagaagaattgaaggccattgggtcataggtatttaagtttaataatattgcgctaaaaaaccgccgcacactcgactacggcggccagtaggtggggcgagactacgggctactgaagaagtccgcgcgtgatccgcaggcggaaagtacgtgttctacaaagctgccacatggctgtcccttttgtctggtatgttgtgtgccactttttatgggcgtaagtcggtgccggaaagagtccaaaggagcgaccatttctcaattcttatcagtgatcaaggctaactccgtttttatctgaatctgcccgaattttttaaattttattttggggtttcgaaaaaattttaactctaatttacagtaactaattatatgtttcggacacgtagcaaatatctacggtaatctgccactttttgttcagtactcgccgaacttatcgcattggtcggcttccccatctgcttctatctgtccattcattcatatggacttcgaaattgggagtttgactggtcttacggtgtcgcttggggagcattactgtaaggaagcaaaaacaaaaaatatataatttattaaaaaaacccctaattaagctttgtatttggcgcacttttgttgctgatctgtgacaaagagcatgaggaggtgtactacaaggaaaagacaatttacaatccgccaaacggatttgcatga

SEQ ID NO: 68650 - DNA, 1047 bp, Heterodera glycines
  Genomic contig location: Contig_ID=SeqID_8599; Location=24..1070; Strand=-
  SCN-specific regions: Sequence locations=1-221,243-259,282-630,652 -799,821-1047
agagaaattcgtaccgaattggagaaacagaaactgatcacggaaaacattgtgttgaaggcgaagattgtcaatattgagcagcaccaaatgaaacagaacaagcaaaatgggaaagaggacgaacagcagggcgaaaacggtagggaaaattgatcatacggtagcagaaattatcaaagtaaagggcatttacaaacaagaaaaatacagtacataggttactgtaagttttgtttgcttttacattacttccaagagaaatatgttttaaattttgtaatagctaataaataaagttcagtatttttcagtttctgctgatcagttcgaagcgattcgggaaagaatgggccaattggagaagcaggtgaaccaacagcagaacgacaatcagcatggtaaatacggtagggtactgtaattttgtaaatacaatttaaattttgtaataacttataaataaagttcagtatttttcagtttctgctgatcagttcgaagcgagtcgggaaagaatgtgccaattggagaagcaggtgaaccaacagcagaacgacaatcagcatggtaaatacggtagggtactgtaattttgtaaatacaatttaaattttgtaataacttataaataaagttcagtatttttaagtttctgctgatcagttcgaagcgattcgggaaagaatgggccaattggagaagcaggtgaaccaacagcagaacgacaatcagcatggtaaatacggtagggtactgtaattttgtaaatacaatttaaattttgtaataacttataaataaagttcagtatttttaagtttctgctgatcagttcgaagcgattcgggaaagaatgtgccaattggagaagcaggtgaaccaacagcagaacgacaatcagcatggtaaatacggtagtgatactgtatttttgtaaatacaatttaaattttgtaataactaataaataaagttcagtatttttcagtttctgctgatcagttcgaagcgattcgggaaagaatgtgccaattggagaagcag

SEQ ID NO: 68651 - DNA, 622 bp, Heterodera glycines
  Genomic contig location: Contig_ID=SeqID_8600; Location=51..672; Strand=+
  SCN-specific regions: Sequence locations=1-622
atgtgccaattggagaagcaggtgaaccaacagcagaacgacaatcagcatggtaaatacggtagggtactgtaattttgtaaatacaatttaaattttgtaataacttataaataaagttcagtatttttcagtttctgctgatcagttcgaagcgattcgggaaagaatgggccaattggagaagcaggtgaaccaacagcagaacgacaatcagcatggtaaatacggtagggtactgtaattttgtaaatacaatttaaattttgtaataacttatgaataaagttcagtatttttcagtttctgctgatcagttcgaagcgattcgggaaagaatgggccaattggagaagcaggtgaaccaacagcagaacgacaatcagcatgggaaatacggtagggatactgtatttttgtaaatacaatttaaattttgtaataacttatgaataaagttcagtatttttcagtttctgctgatcagttcgaagcgattcgggaaagaatgtgccaattggagaagcaggtgaaccaacagcagaacgacaatcagcatgggaaatacggtagtgatactgtatttttgtaaatacaatttaaattttgtaataacttatga

SEQ ID NO: 68652 - DNA, 473 bp, Heterodera glycines
  Genomic contig location: Contig_ID=SeqID_40252; Location=118..590; Strand=-
  SCN-specific regions: Sequence locations=1-123,145-204,242-393,415 -426,448-473
atgagcacaagcacaccaaacatatcactcacaacattcggcgacatcacttcagatcaaagtaacggcaaaatggcatcacaatttaaaaaattacaaaagttgccattcatagagagaggaaaagaattttgaaattaaaaaagggatatacataattaatttaaaaccattcaaatgctttgccatttgaaagaaggcacaaaaatttgaaagttataatttaaaatgtaatattcttcaaaatcactaaatacgatacaattccaaaaatccttctcccttttcagatcatctttggccctcttttgcactgtccgacgatgaaaatgatttggatcggttgcagggccagcgaaaagcacttgacgcaaaaatagcggaattggagcgacggcaaatgataatggagggcaccgaagcgacgccaaaggcaaaaggcaatttcgaaccatcgacgaacaatggaaatg

SEQ ID NO: 68653 - DNA, 96 bp, Heterodera glycines
  Genomic contig location: Contig_ID=SeqID_40253; Location=1..96; Strand=+
  SCN-specific regions: Sequence locations=1-31,58-96
aagcctaaactttttggcctgtttaaaaaggaattaaaaatttttaaaaattttattcatctccctttttgatagaaaaagcatcagagtgcctaa

SEQ ID NO: 68654 - DNA, 373 bp, Heterodera glycines
  Genomic contig location: Contig_ID=SeqID_40256; Location=356..728; Strand=+
  SCN-specific regions: Sequence locations=1-373
gcacaacccctgtcgccacgggatttggacgaattggaaacgtcaattgatcaatttcgaacattcctcaacgatcagccgcggatgcgcactttgctagccttaaaaccaaaggtccacttgctgttgaaccattttgtgccgttcgccagacaacaccaatttttggcacttttagacgagcagggtcaaaaagcattttgaaatttaagccctggattttctaggtgatgaagcattgcattcggtgtggaggcgattggaacagctgtggaagacaatgcctgatgaagaacaaatgcgacaattgttggaacaccattttgtgtcaaattggcttctcgacacaggaaaaatcgacgaaatgaagcgg

SEQ ID NO: 68655 - DNA, 375 bp, Heterodera glycines
  Genomic contig location: Contig_ID=SeqID_40257; Location=125..499; Strand=-
  SCN-specific regions: Sequence locations=1-191,214-375
atgtggttgacaatcagatatggtgccaaggagtgcaaaattgaggttgatattggcggcgaaacggacggtgaccaacaaaaacagtcgaatgagggaggagaggaaaaagtagaggaacaaaaaaatgccgacgaaaaacagacaaaggttgcagaaaaggaagaaatggagggcggaggaaaaaacgaagagaatggcactgattgtgaagcggcgaagccaagcgaagcgaagcagcaaatgccaacaaatttgggggaattgagagagcgaatttgtgcggagaccggttacgaaaatggcacaatgaaactcatacacaaaggtaaaatgccaatggcagtgagaaaaacgatggctgggtttggttga

SEQ ID NO: 68656 - DNA, 469 bp, Heterodera glycines
  Genomic contig location: Contig_ID=SeqID_40259; Location=546..1014; Strand=+
  SCN-specific regions: Sequence locations=1-55,130-306,329-397,419-469
atggcggacagaaatagtgaattagagaaacaaaaaaaggtgaaaaaagggaaagattttaatattaattttatggaataaaaagaatattcaaaaacttaaaatgattttattaaaaataaattaaaagatgaattattttaggtgcttttagacttccgacaaaattcttgggatgctaaagcatgtcacgaggacctcgaaatttctagtgacaattctttgactgtcaaacgaaagggaactaatttgggtacttattgggaattaatttaattacttattaaatctgtcttattaaacatctaatttatttattatttattttcttcaacagctcagtatcgttccgtctttgctaatcatccaatttcgctgagcattcgtttccccgacattttttactttaaaatttcaatcaaacaaatgaaacggtaaaattaaatttgcagtagaaagttgaataata

SEQ ID NO: 68657 - DNA, 421 bp, Heterodera glycines
  Genomic contig location: Contig_ID=SeqID_40260; Location=35..455; Strand=+
  SCN-specific regions: Sequence locations=1-225,247-421
atccatgacaaaaccattcggcaagtgctcttcttcaagcagctcagctggcgattgctcaaaattgaggcgagtgcccacccgaagtgcggcgccgacgagcaaagggaaccgttgagaagcaaaacaaattcaccccttcgtttgctcaccgtcgacggaaaatgtcgcatttctatcaaaaaaagcagtcaaagtgcgttgcttttttgcgattgtattacgttgtgttctatagattgttctcttttggccggtaaaatcgaactgattctgaaggagatccattggctggcgacgatgctccacctgaggatggccatcgactttcacaaacacttggtggacctggccaactgtcagaagaaagcagattccgtcacaccttttttgggacaacgacagaacccgttcacggtag

SEQ ID NO: 68658 - DNA, 303 bp, Heterodera glycines; identical to SEQ ID NO: 60644
  Genomic contig location: Contig_ID=SeqID_40261; Location=81..383; Strand=-
  SCN-specific regions: Sequence locations=1-303

SEQ ID NO: 68659 - DNA, 304 bp, Heterodera glycines; identical to SEQ ID NO: 51570
  Genomic contig location: Contig_ID=SeqID_40261; Location=460..763; Strand=-
  SCN-specific regions: Sequence locations=1-304

SEQ ID NO: 68660 - DNA, 784 bp, Heterodera glycines
  Genomic contig location: Contig_ID=SeqID_8601; Location=147..930; Strand=+
  SCN-specific regions: Sequence locations=1-409,431-575,607-784
atgggtttggaggaccgcgaagtgtccattgaatgcatcaaaggcgcactgtttctccaaatgtttcaggaagcagtgaaagaaaaggcggatgaggagctgaaagcattaaacagtaagccagcaaaggttttccattgctaattccgggaccaggtcatttgggcgccgacgttctggcgccgacggtttggcgcctatttttgagaaaatcgaattttgcctttttgcatggcaggcgccaaaacgacccttgcgacaaaacgttggcgccacaacgatacggaaaccggataaaacataaatttttttcaatcccagatagccctaacagtattaaagttaagaaaacactgtcttctagtttatttttataggagcattttatttctgctgtttaaataattagttatttttcaaaaatttacttactatcaaattatcagacataatcacttttgatcacttctataatgctgtttaggcttgaaaaatcttaagtttgaacccgattttggacataggcgcaaatgccctggctcaaatgtggggtaaacattgttaagcaaattagcaattttttaaaaattcaaaaattatatattactgagaggcggaccaagcgtctcaaaattttctgaaaaattccattgaattccggtttcatccggattctaatgaaattacaatcagccagaaaaaaaaattcaatttgtaggatattgttggtttcaagatcacctagtaaatcacgaaaaccatatttctacaaaacaatattaaa

SEQ ID NO: 68661 - DNA, 1846 bp, Heterodera glycines
  misc_feature (1723)..(1723): n is a, c, g, or t
  misc_feature (1725)..(1725): n is a, c, g, or t
  misc_feature (1819)..(1819): n is a, c, g, or t
  misc_feature (1821)..(1821): n is a, c, g, or t
  misc_feature (1823)..(1823): n is a, c, g, or t
  Genomic contig location: Contig_ID=SeqID_8602; Location=1112..2957; Strand=+
  SCN-specific regions: Sequence locations=1-639,662-1339,1363 -1574,1621-1760,1801-1846
atgttccattctgtgcggaaatcgtttcgctcaaaaagttcaacggacccgaacaaaagatatggttttatggaccttttaaaggaaatggaggatacaattagaggaaatgaatttttcatgaaaaaagtgaaggcgattacgaagaaagccggaattaaagaaggaggtttcttaattattgcaaataattaataagaaaagatgggggtctttctgaatcgtttgggcaacgggataatttgtagtgatgctcgagaccgaaaatttcccaagactcgagaccgaaaacgcggaagtcgagaccgaaacgaaaaaacccgagacttttcgtgagtcaagactgagactctcgagcatcactagtggtttgggcaccgccgtttgtgcgtcatagtaatttagaccctaccatttaagctacagtagttttgagtgtctatgtttgtgccacggggtcccgcgttagttgggcgccttaggttagtgcactcatatgaagggatgggaatttaaggcacgaaaaatctacaaaaagtcgactaaaaaagtaaaaatttgtcaaaaaatcaggaaaaagtcataaaaaacgctaaaaagtaaggaaaaattaccaaaagtgaaaaaaaaaatttaccgttttggaggcggagattttaaagtaaacattttgcctgaaagaatctgataaagttgggcaattgtttcaattcccttagtcttctgaataattacgaaaattttctgttggatttctattcaattttcactgatcgaaccttttcaaattttgccataaaaagtgaaaaagtcccccaaaaaatgataaagtgccaaaaaaacataaaaatccaaaaaagtagaaaaaattcaaataaaaatgcatgttagaagcttcttgaacaaagtgtaggacagtttttaagtcatttgaaggtcatataaaatcggcaacaaaaagaagtcatttgactaaaatcaaatccctaattaattgtttaggattaattgtttaggaggattcggcgcattggaccaatattatgcaaaagaagctcgtctggtttttgccaaaggatcgggccaagattttctgcgcaatatcattgacctcagccagtggatgactgcgaaggaggtgcgcgagtgcgcggaaaaattcaaatggatacgcgggctcaacgccaaggagtcgtgggacattgaagtgaacggaagtggaaaagcgtcatcagtgtcggctgatcttcgcaaagaccaaagcgataaagctattaatgatcggcataatgaagataatgcttatggtggtacttttggtagtgaacgtggtggagaagacgaagatggaagtggttctggtagtgaacaacgtgagtatgacgaagatggaagaggttctggtagtgaacaacgtgaggatgacgaagatggaagaggttctggtagtgaacaacgtgagtatgacgaagatggaagaggttctggtagtgaacaacgtgaggatgacgaagatggaagaggttctggtagtgaacaacgtgaagatgacgaatatggaagtggttctggtaaagactgataaatcttaggaacagagagagagacagagagagagaggtgaagagatagaagattaagttagaagtgaaaattttagtttttatcccaaggttttcgttttttatttctatttttgtccgaattttgcacattcattttnanttggataaatgtttttttgggattgtttagggtggttaaaaaaatatatttttgaaaattaattgaaaatttatagaaagtggtaattttttgntngnaatttatttttggtagattttaa

SEQ ID NO: 68662 - DNA, 1129 bp, Heterodera glycines
  Genomic contig location: Contig_ID=SeqID_8603; Location=648..1776; Strand=+
  SCN-specific regions: Sequence locations=1-40,64-143,323-438,460 -492,549-661,683-841,887-1129
atgaacacttggaatttattcattttcaccaacagaacagtgatgaaatgggaaatgaacaaattgaacaagtggccaattggggtgatgaaaacattcataaaaatgctcagaatgacaaaaataaagaaaatggtcagcaaaaaaagagaaataattaaaaaatttgatgcaattaaagaaaagttaagggaaaaaggacaaaacacaagcaaagacaaagcaaaaattgaaatgaaaattggaaaattattaggattaaatcgaagtttaatatataaatggaaaaaagaattaaatttaaataaaaacaaaataaaaaagaatttttatgatgagaaaaagcgcaaattcattgaacgatttgatgaatttaaagaattatatggccaaggcaaacagaaagaatttgcgaaggaattgggcatttccaaacaaacatttataaaatggaaaaaagaattggtgccaaatgaccacaaaagtaaggcatttttgttttaatcatttaatataaatttacatatattcagaagaaaacaaattaagaaagatgaagcattatttgcaaataaaagaagcaaatccgaaaatgagcgacgaaataattgtgaaaaaatagggaattggatggacaactctgaatagatggaaaaaggaatttggttcattttaatatgtgatttttgaggtagcctatcaaagataataattagtattattgtttgtcataattaatggcattttacatttgtttgtatttaatggtcgtaaaatatgacaaaagctacagaaagtttttaaattttttttcaataaccctaacttcactagtatgttgttaaattttttaaaatttttggttaatttcattttattaattattgttccaaaatattgcatctatcattcaaaaattcccatctttactgaatggaaaggagtcattggtcatttttcagttctaaacacaatttaaaccataaaaattctcatttcgccagaattttcataaaaaatgctggaaatgattttacaaaaatgtaaaagttatatcaaattcaaaaatgtttaagaaacattattaacagtgataaatgtgcttcatttgatttaccaaaacaaaata

SEQ ID NO: 68663 - DNA, 273 bp, Heterodera glycines
  Genomic contig location: Contig_ID=SeqID_40263; Location=636..908; Strand=-
  SCN-specific regions: Sequence locations=1-273
atgaataccatcatcatctttctgatttcattttcctgcatttttctggcacattttctccaatttgttcatgctgctcctaaagtgacagtgtgcttcggatatggtgaaccgttcacagctaaagcttatttggggcatgtctttaagcgtaattatgatacacgtgctgttcaaacatacaacgggaaacaatgtgtgaaaattaatgcacaaaactggtcgcaatctgatggtaacgctgcaatctttttcctgcttgaaaatggaacg

SEQ ID NO: 68664 - DNA, 76 bp, Heterodera glycines
  Genomic contig location: Contig_ID=SeqID_40264; Location=232..307; Strand=+
  SCN-specific regions: Sequence locations=1-76
aattactggagttagcatcatagcagtgcttttctttgtctttttgatgccctcgcaaaatctggttcgcttctga

SEQ ID NO: 68665 - DNA, 998 bp, Heterodera glycines
  Genomic contig location: Contig_ID=SeqID_40267; Location=1..998; Strand=-
  SCN-specific regions: Sequence locations=1-377,401-415,437-699,724 -774,801-998
  Gene Ontology: Biological process=embryogenesis and morphogenesis
tcagtacatcgacatgatgagtcatgctgagtacccttcgttcgactactcatccatccgttcagggattgtagcaggtgagggaggacataggacgacacgtgctaacgccaccaacaatctgctggttttaattggctaattaattggcttttccttaggcgcgccgtgccccgtcactctctgctccaggcaataaaatgacctcctccgaattgttttctttgacttttatttgtaaattcaagattggtcaatgagttgggcatgaaggatcttcaagtgtgctatgggaccaccgaaacttcgcccgtttcgtttatgtcaattagggaggatccgccggagcagagaattcgcaatgttggccatattatggaccatttagaggtgattaggctcaaactctcgctttgacccctcccccttttgcccattcccttttcaggcggtaattgtagacaaagaaggacgagtgaccccccgcgggcaaagaggcgactgtacgtgccaatcccaccccccccccattttgcccattttggcattacttttccctttgtttgagtgtttgtcagaggctattcggtaatgtacggctattgggactcggtcacgcacggctcgtccgaagtaacaaaggaccgttggtataggacggggtgagcagaaatttttatggtttttcccgaaaaaccctttatatatttttaatttaattttgtgtcttttgtccgtgggtcttttgatgagagcacactttctttggcattgccttccctctccagtgacattgggctgatgcattcctccggcaccgtctcaattgttggccgttccaaagatatgatcgtccgagggggagagaacgtttatcccactgaggtgatttgattggtctctctgattggtccttcaacattatctcttctgtccttcttcaaggtggagcagttcatcgacagacaccctggtcagtcattccttttgccctaatt

SEQ ID NO: 68666 - DNA, 342 bp, Heterodera glycines
  Genomic contig location: Contig_ID=SeqID_40271; Location=433..774; Strand=-
  SCN-specific regions: Sequence locations=1-155,177-200,235-260,283-342
atgcttttacaaaagaatgggcacgattacgtgctttgttcgtcgggcttcaaccgtcaaacacaatttttgcaacaactgtacaacctttgcagccgatgataatgaaaatgaacaatcaaaatcaatcgccaactcggattgacaattttttaccaaataattaaaaatcatttagcataaatagggctaaatgtatgataatatatataattatattttgtaattattaatgaatgaaacatataaatatacaatttcttctttaaatacttcaaacttcatgagattttcttaatgtcttgatgagttatttagcatttttggtgtaaaaagaataaa

SEQ ID NO: 68667 - DNA, 506 bp, Heterodera glycines
  Genomic contig location: Contig_ID=SeqID_40273; Location=361..866; Strand=-
  SCN-specific regions: Sequence locations=1-13,35-58,80-99,121-272,302- 506
atgggacaaaatgaaagagaagaaatagtcgtaaaaacggaacaaattgaccaaaaagagcaaaatgaaaactcagcaacagttgatcaaatgggtgaagaaatgggaaactatccaaatgatcaacaaaaaagagaaataataaaaaatttgaagcaattaaagaaaatttgagagcaaaaggaaaataccaaaacaaacacagaaccaaaattgaattcaaaattggaagtgttttaggtgcaagtcgtaaaaaagaattaaatttgaataaagtcaaaatagaaaatattcattttgttgatcaaatggatggagaaaatttaaaaagtccaaatgaaaaaattgaaacaattcaaaaatttgaacgaattaaagaaaagctgaaggaaaacggaaaataacaatggaaaaacagagttaaaattgagacaaaaattggacaattattaggcacaaatcgcgacaaaatacaaaaatggaaaaaagaattaaatttaaataaa

SEQ ID NO: 68668 - DNA, 544 bp, Heterodera glycines
  Genomic contig location: Contig_ID=SeqID_40274; Location=555..1098; Strand=-
  SCN-specific regions: Sequence locations=1-251,288-544
atgacaacacggtgcgcacctccaccaacgaggtggtccagttcacgtttggcgacgacggcctcgacccggcgtacatggaggcgaaggacggccgcccggtggacttccaacacatgttggcccaagtgcggaacaccaactgcatcagtaccaggtgggcggcgaaagggtgatgtactgcctcgcaaaaaaattctttttttcatgaaaaattcggtaaattttgacactgtcaattttcatatgtcataaaaaatttttttttaatgaatcaattaaaaaaagagcctacgtaaacaatttaaatgtgcagtcattaaaacagtttatacatcaaacataaaaaaagagttctctgtaaaataattgaattttgggtcattggttcttgaaaaactcaattcatcccatttttatgcttgaacattttcttctctaaaatgtttcttcccattcgaaaatgttctttcgattaattttcaatatttttgcaatttttccatcactcattttggattttcatttttcatttgccaataaa

SEQ ID NO: 68669 - DNA, 369 bp, Heterodera glycines
  Genomic contig location: Contig_ID=SeqID_40285; Location=27..395; Strand=-
  SCN-specific regions: Sequence locations=1-19,45-182,213-323,345-369
atggccaactccgtccatgctgaacatcaccagccgggggctctcagcacaattggcgatgtcaacggcgatttcgggctggtcaaagacttcacatcactgctcggattcgattgcattttgccggtgatgagagactgtgaacagaatgaaaacggcagagaagcagaggaagagggagcaaaggaggaaaatgaggaaaacgggggaacgaataagcagattctgctgctgaggaagaatgattacggaaggacgaaagtgtcgcaggacggggagggaaaacggcacgggggaagagacgagggccatggggcgccaagggggacgggagaagcaccaccagtggcgacgacaggggcaagtccg

SEQ ID NO: 68670 - DNA, 630 bp, Heterodera glycines
  misc_feature (3)..(3): n is a, c, g, or t
  Genomic contig location: Contig_ID=SeqID_40287; Location=56..685; Strand=-
  SCN-specific regions: Sequence locations=1-630
atncgctatttccatcttgccgttattcttctcatcatctgtcggggctgtcacgccgagggagacccgccgccgacggagccaccggctgctggtgatgacgggccgctgaacatggaaaacttcgtctgtgcaaagaaggacacgaaacacggcttcatcactcagaaggacgggatgatgtgagttacaatatccaatgaagccacggattaattgctttccaacttttcagtgtcatggactcagaaggagttcccccggatgcatcgttgtattatttccagcagaaaaacgaaggaaaactcagcattcggatggctgtggaagaggagtgcaaagatgccttcgacaagaatgtccaattcaccgttgataacagttgtgagaagaaaccggtgagactcgcattttgcatcgactaataaagagatgttttaacttgtttcatttcagaatgacggaggaggaccgtgccctgaatctattcccaattgcaaattcttcgacatcgtgtgccctatcacaatgagagcggttatcgacccttccgacgctggcgtcttcaaagccaaacttaaagatcttgcgaacctttcaaaaacgtgcaaaaaatggcagggattcgtt

SEQ ID NO: 68671 - DNA, 776 bp, Heterodera glycines
  misc_feature (13)..(13): n is a, c, g, or t
  Genomic contig location: Contig_ID=SeqID_40288; Location=269..1044; Strand=-
  SCN-specific regions: Sequence locations=1-463,485-616,642-776
ggggagcaaaaantccaacagcagtaattaatagtacagagctatagaggaagctattcccgaaggattcggtctccccataaatctgggcgcatcggttcggggggaccgccccgaaaacaaaaaaatcgattttttcaagtgtccgtttggggtactcaaacaattataggggagcaaaaatccaacgcagaattaaagtacaggctgtagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttgtgaaaaaaatatttatgaattaattatgcaaaaaacaaataaaaacgaaagact

SEQ ID NO: 68672 - DNA, 909 bp, Heterodera glycines
  Genomic contig location: Contig_ID=SeqID_8609; Location=95..1003; Strand=-
  SCN-specific regions: Sequence locations=1-85,107-119,141-156,178-909
  Gene Ontology: Mol. function=transposase activity; Cellular component= nuclear chromosome
atggcacttatttgtttggcatcattgcctctctcttttgttgaagaccaagccttgaaaaatttattgtcaattttagctccaatgtacaaaataaggtctaaaacaaaaatggtctttaaatctttaaaattttagaagtcgtcggcattttacaagtgatgtcctgaggaatttgtatgcgaatgtgaaagctcgcgtaaaagaggacattcggaaaacagacttcatttctcttacaatcgatggctggagttctcacgaaggaaaacattcgttattaagtgtcacagttcattacattgacagtaatatggaaccgacttttcgcgtgatggaagcagttccaattaaggttcggttaaggggtttttacttaaaaattttgcagacatttagggcagtcatactggcgaaaaaatgtgtggtttgctgagccaagttcttaatgattatggtgtgaacgctgaaaaagtgcaccttattgttcgtgacaacgaaagtgcaatgcaaaaagcgactcgtattgctggttttgaatcactgcattgcactgcccataattttaacttggttattttgattaatcaaaaatttcatgattatcttttctttatttagtgtgtgtgggatgggattaaaaagctgtcaatcgatgcgttattagaaaaaattaaaaaatcaatcagaaagatccggaagtcacgggttttgggcgatgaattttcggcacttcaagacgaaactggcataccacagcgtaatttagtcaaagtaggcgccaaatctttttttatatttcaatgtattttttagggaataacggttcgatggaacagcgtttttttaatgctcgaaagattttacgaaaatgaggaagccctggtcttaatgccggcaaaagactaa

SEQ ID NO: 68673 - DNA, 387 bp, Heterodera glycines
  Genomic contig location: Contig_ID=SeqID_8609; Location=2501..2887; Strand=+
  SCN-specific regions: Sequence locations=1-12,38-221,314-330,355-387
atgtcgacaatgttttgtgtttcatttcaatttacagttattagcggtctaaagacatgcgcaccaattaatatgctttttaattcatttgtatttgaaggaggtaaatacttctggtattcattcaatccactttctaacctgaattactaatttaaatcattatttagtttgataattatacacttaatttttgtaatctttaattcatcgcaaatttgaaatattttatttaaatatatttatgattattttagactatttctttattttttcgtaaaataatcaaatattttttaatttttgaatttttccaattcatattttcaccaaactcatttttcaaattaaaattatcgaagcttttctagatattttaatacatca

SEQ ID NO: 68674 - DNA, 925 bp, Heterodera glycines
  Genomic contig location: Contig_ID=SeqID_8610; Location=464..1388; Strand=+
  SCN-specific regions: Sequence locations=1-236,260-289,333-350,386 -469,532-676,723-925
atggatgatgaaacgtgcttttgcagtggcgctctgtaccccaagcctggtgaggcccccgacgggtcgagaatggtggttcagctaaactgccgctgcacgggggcctaccacttggggtgcatcgccaagcacctcatcaagcgtggtggcaaatgccccacctgccgcaccgagacaattacggagaattgtcgtccaacagagcgctgggtgcagttgatgcgcgatgcaggagatgtcagcgagcaggaggaggacatcgtctttttagacggtgagtttgatgaattaaaaaatatttttaaaaattcaaaaataataatttttatcaaattgtagaggtgctacagccccaaacaccaccaccaccagcagcagcaaatgatgtggcggaaggcacggcgcaggcgagggggcgcgggcggcggacattgcgcgacaattttcggtaagccaagaaaatttttttaattttcgaaatttgactttttttaatttaaattgatttaattaatttttttttaaattccccaacagctatcggatctcggccatcgtcaccagcagaaaaagcctgagtgcgtttctcgcgaactgagggtccactgggagggattttccttcgagcaggattcgtgggaggacgaggcggccatccgcgcggtaagaaatcattaataatttaattattatataaataaataaaaacaaaataaattccagcaagcgccattgatatatgtggcgtgggaggccgcccacgacgcggggcacacaccggaacacaggagggtgttcccggtgcgccccgcgtcgtggatgaccaacgttcgagtgcagagggatttgggagaggccgaaagggcctatcccgggcggcgcacggcggtgcgacaaatttttggtaaaatgaatttaaaaa

SEQ ID NO: 68675 - DNA, 953 bp, Heterodera glycines; identical to SEQ ID NO: 40292
  misc_feature (38)..(38): n is a, c, g, or t
  Genomic contig location: Contig_ID=SeqID_40292; Location=1..953; Strand=+
  SCN-specific regions: Sequence locations=1-64,86-92,114-147,182 -288,310-447,469-682,705-953
  Gene Ontology: Mol. function=transporter activity; Cellular component= cytosol; Biological process=exocytosis

SEQ ID NO: 68676 - DNA, 689 bp, Heterodera glycines
  Genomic contig location: Contig_ID=SeqID_8611; Location=1460..2148; Strand=+
  SCN-specific regions: Sequence locations=1-92,331-689
  Gene Ontology: Biological process=protein biosynthesis
atgccaaaaagtgaaatagacggaaagggcggacaagtgccaacggaaaacgaaagcgcaagcgaagggacaacgacacaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaaggaagggccaagcagcgaagaatcggctgaagaaagtgtgatgaaagaaagtacaacaataaggacgacaatggaggaagaaaaactattgggggaggaggaacagagcaattcaaagcggacaacgaccaaaagagcgacagcgaaaggggcaaatttgaaacggaaagtgcccccggggctaaagcataacagacgaagggtcacaatgagaacgccaatcgccgagggaaagcgccaaaaacaattcgatgaaagtgggggagaaaccggtttacctcagttcggccccaacgtgtttttcaactataacttttttctatgtcattcaaatccaacaaagttgatatcattcgaaagcttaat

SEQ ID NO: 68677 - DNA, 946 bp, Heterodera glycines
  Genomic contig location: Contig_ID=SeqID_8612; Location=323..1268; Strand=+
  SCN-specific regions: Sequence locations=1-548,570-946
atgagaacgccaatcgccgagggaaagcgccaaaaacaattcgatgaaagtgggggagaaaccggtttacctcagttcggccctcacggttcggccccaacgtgtttttcaactataacttttttctatgtcattcaaatccaacattgttgatatcattcgaaagcttaatgtatttagaaactttttctaagatattgcttcgcgattagacaaataccaaaaaaagttatacatgaaaattgcgaaaaactcgaaattttttttccaggcttgaaaatcttttcgctttttgtaagactaatagagcatgttaagattattggattacaaataaaaaagctatagtggaaaaacacgttggtgccgaaccgtgggccgaattgagcgagtccgggagaaacacagaaagggtggataaaaaaaccattgttcagtgaaaggcgaggcacaagcactttacgactacgaagaggcaaaaagcggggaggacggactcacggggaaaaaaagcgccgcttcaaaacttttcgaagtggaatttttggcatggaaagacaaatttttgcgtgggctgaaagtatttgcaggcacttttcaattatgccgaaatattgcagattatttaaaggaaaggaaacgaaacgcacgacaaaagcgaattccgaaaggcgagacgaaagaatgcaataacggactaatggcacaaataatggccagtgccattattgaggacagttcaatatcgaaaaggctgatcaaaagagcactcaaattttctttcccagaatcgcagtttgacatcatttgcgccgcaggaggtgccctttccctttttaatggagcagaaaaagacggaacttcaggagtgctcagttatgccatttatggaagaagacattgccaagtgaaacggagaagtgtgacttgtttggcatttgaataa

SEQ ID NO: 68678 - DNA, 119 bp, Heterodera glycines
  Genomic contig location: Contig_ID=SeqID_8614; Location=856..974; Strand=+
  SCN-specific regions: Sequence locations=1-119
ataaatcgccttttgctttgtttttaattgcccattttattgttgcgcttttgtcgttcgaattggttgttcaaaccatcacaaatgttttttgcaaagggctttgttctgttcggctt

SEQ ID NO: 68679 - DNA, 674 bp, Heterodera glycines
  Genomic contig location: Contig_ID=SeqID_40303; Location=302..975; Strand=+
  SCN-specific regions: Sequence locations=1-317,352-377,399-674
atggactgcatcgtctgctccataacccgggtcgactttatcctgagaccgccgtacacaatgtgcggtctgttgggcatcctaacgtcgttcgaaaagggagctaatatggactcggtgcatgtattagtcgtagtttgtgacccagcactcgaataaaagtaggaattttgaatttttcaaattatgattttttgttcaaatttagattaggaaatcggaattgatcaaaataattgaaggattcgtgatcggggaccccaaaaaccccagagaataaatttttatgactatcacaaaaaaaattttgcaaaacaaaagggtccccccttttgaaaaaattttcaaaacggccacttttagactagcgccgcaattttcatgtttttcatgtataacttttttggtaattgtctaatcgcgaagtgatacatagaattagattcgaaacatgttaagctttcgaatgataccaacaatcttggatttggatgtcaaagaaaaaagttatagcgaaaaacataaaattttttgaaaatctgcccacagatcccacacaagtacccatttatttatattttcaggaaaagtcattaatgctaaagaggtcgaaggaacaacaagtcttgctaactgtacgaccattaaaaacagcacaaatttttaaacaataa

SEQ ID NO: 68680 - DNA, 216 bp, Heterodera glycines
  Genomic contig location: Contig_ID=SeqID_40306; Location=634..849; Strand=+
  SCN-specific regions: Sequence locations=1-83,139-216
atgttcaacatcgaaggcccaccgcgagaccgagaagcggccgagtgagtaccttcggtgcaggaaaattattaaggaagagagttcattatttatttattttttgcataattaattcataaatatctttttcagaaagggttctgaaacgcacctaattttatttacatgttagtttaggcactcttatgctttttctatcaaaaagggagatga

SEQ ID NO: 68681 - DNA, 81 bp, Heterodera glycines; identical to SEQ ID NO: 58971
  Genomic contig location: Contig_ID=SeqID_40309; Location=494..574; Strand=-
  SCN-specific regions: Sequence locations=1-13,47-81

SEQ ID NO: 68682 - DNA, 52 bp, Heterodera glycines
  Genomic contig location: Contig_ID=SeqID_40310; Location=193..244; Strand=-
  SCN-specific regions: Sequence locations=1-52
tggtaacgacgaaatgcgtactggtacaaatatttgtttccaacaattcagg

SEQ ID NO: 68683 - DNA, 813 bp, Heterodera glycines
  Genomic contig location: Contig_ID=SeqID_8615; Location=152..964; Strand=-
  SCN-specific regions: Sequence locations=1-162,184-688,712-786
  Gene Ontology: Cellular component=cytoplasm; Biological process =regulation of translational termination
atggagccgggcaagacggagctggtgccgggaggagcgcgagccgaggcgaagcaggcgatgaccaacatcggagaacttctgcaggctggcggatcatccttcaaacacggtgtgtgagcaattctccaggattcatcgtcttcatgaattttacctcccttttttcagttgtgttcgccaagattttgcttgctgacatgagcgacttccaggcggtcaacgagacgttcaaaagctacttcaccccggacacgtaccccgcccgcagcctctgccaggtggtcaaaatgccgaagaatggacgcgtcaaaatcgatgtggtggcgatcgctgagaagccctagagctgagctgaagtgcgcaacagatgaacaacaaatgtacatatgtgtattgtatattgacgtgatcatgtattcgatcgtattgtattattgtatgtaataactgtccttgttctgatcatgactatgtgtatatattgtattgttcggttcgcgatcggataaatattcaaatggaaaattatttttgttaacccaaaaacagcttagttaatgagatggataccattcgctagattagtgctaatttagtgtgcccaagttttgcagatcccatacggagcctcgcactcttcttttggcattccttggcattttcttatgacataagttgttagcatttttctcatcttctttgtttcttgcaataattccgaggccccaaaaattttcggaagtcggaattccgaccccaaaaatgtcggaactcggaagtcggaattttaaaaaatatatatataataaa

SEQ ID NO: 68684 - DNA, 1064 bp, Heterodera glycines
  Genomic contig location: Contig_ID=SeqID_8616; Location=546..1609; Strand=+
  SCN-specific regions: Sequence locations=1-1064
  Gene Ontology: Cellular component=cytoplasm; Biological process =regulation of translational termination
atggctgctgctccgtccattcgtatcatcgcgacgtccaaggcgcctgctgcgacgggctacaggtggagcaaacaatggatgacaattgagaaagcacaactttatttgcttttctgcagtcaggcagtgctcgtcaacaaccagacgctgtacgtgagcggccagaccgggatgatgccaggaaagacggatgtggtgtcgggaggagcgcgagccgaggcgaagcaggcgatgaccaacatcggagagcttctgacatacgccggctcatccttcaaacacggtgtgtgagcaaaattcagcataaccatcatcgttgatttccgcccctttccagttatcaactgcaacatcatggtggccaacatgagcgacttccaggacgtcaacgaaacgttcaagaacttcttcaccgcggacacgtaccctgcacgcagcttcttccaggtggtcaagttgccgaagaatgcactcgtcatgatcgatgcggtggcggttgtttcgggccagtgaggagaagtgcagaagtgcgcaacagatgaacaacagatgtacattcgtgtattgtatattgacgtgatcatgtattcgatcgtattgtattattgtatgtaataactgtccttgttctgatcacgattgtatgcatatattgtgttgcaccgatcggataaatgcccattgcattctgtatttttgattctcgttagagttcgatcagaggttagcgaagagccattccagcaagttaaaattttccgaaatcgaaaatccggcaaattttcctgaaccattccccgctatgtcaaagggttactctttttttgaagttaatttgggtctccagcaattcaaaaaaccagattccctaagtagcaacttaatatgactaaaatgttgaatattattatccttttatccacctaaaaagcccaaaagacatgagacgcactttcctggacaacggcatttttgaaactgcccttgggcacacaaatacagccatcggcattttccattttacaaaaacaccctcaatttgatggaactcctcagcaaca

SEQ ID NO: 68685 - DNA, 1272 bp, Heterodera glycines
  Genomic contig location: Contig_ID=SeqID_40314; Location=331..1602; Strand=+
  SCN-specific regions: Sequence locations=1-413,436-669,709-753,841 -906,930-1272
atggcatgggcggccactgctgaggaaatccgggagtcccaaatgagggctaaggcccaatatgataaacaaaaccgagttctggatatccaagtgggtgacagagttcttttgaagaattatatctctaaagtaggcacatcaaagaaattccacctaccatggagaggaatttttagagtagtgaacattgatggtgtaaaggtaacaataacaagctgtaatgccccgcaagcaaaccctagggttgtgcatatcaaccaattaaagaaatccttcgatggattaggtcctgcctgtactgttcccgaactcactgagaatgaaaaagatgcccttctcggtgcacaagctgaagaactccaaaatcagcctggctattctcacactcccaattctaatcctgattttgcctcatctgaaaacccacaaatgccaagtgatttcaatattgcccctgaaacctcagaaaatgcgacaaatccccaaccctcttacggactgcgaaatcgcatgtcccttcgtcgtcctcataaatttgattaaattttattctattgctaggctcaatacttttgaaggttctaaatcatttcttattttaagctaaatcgcattaaagctattattctgtgccttcaaatggagagcgtctctctcgaccctggtgaggagttccaggaggaattgacggaagaattagaagaggagttgttaggaaaagaagagaagtgggtcacggcccaaaattctgagaatgaggtggaaggagaggaaaagcagaaggatgagggtgaagaagttgagttaaatgaggacgctgagaagaagaaaaaggagtgggctacggcccagaactctacgaacaatgaaaaggaggttgagaagtgtggagagaaagaggttgaaaagagtaaaaagaaaatgaagtgggttacggcccaaaatcattctgaaggcttcggaaacggtggttttggagaacaaaccaaaaaagttgttgaagtgcttcttttggatctagagacatcggcgcagataagagaatatgtggtctgccaactccaaagcaaaggagttgtgttggtatacccaaatccttcggaaaaaaacaactttccgtacttcatctttcttccggatgtgtttgatggcaaatttgaacgtccattgttgcctggtgaccgtgtctttgttgaagattacgcttgggtggaaggaaaagagcatttggacaagtcaagatggatttatgccgaacaaattcgctga

SEQ ID NO: 68686 - DNA, 153 bp, Heterodera glycines
  Genomic contig location: Contig_ID=SeqID_40315; Location=375..527; Strand=+
  SCN-specific regions: Sequence locations=1-81,103-153
ggagccgaagcttggccatggattgacgacgttgtggaagaagtggaatgtgaatgctttgaagaatgaatgagcttatgtgggttctctgtggataatggaagtaatccttgtacctaataatgcaacaatccgagtaaaatcttttttgga

SEQ ID NO: 68687 - DNA, 1471 bp, Heterodera glycines
  Genomic contig location: Contig_ID=SeqID_1147; Location=200..1670; Strand=+
  SCN-specific regions: Sequence locations=22-340,363-1330,1352-1471
atgtctttagaaatcattccatttcaccgcaggcgagaagccttatcaattgagaatggatgtattatttatgctgaccgggtggtgatccccgcatcacttcagaaggaagtcttgcagcaattgcaccagggacacccgggaatgaaacgcatgaaaaatctggccaggcaatatgtttattggcctggaatggaccagcaaatcgaagactccgttcgatcttgccaagcttgcgctgaagaagcaaaagcacctgttaaaactcttcttcactcttggccaaaagaagacggcccatggaaacgagtgcatattgactatgcagggcctttctttggaaaaatgtatttaatttgtgtggacgcattttccaaatggccagaagtctttgagatgagttccaccggatcagcagcgacgattgacaaaattcgttatctgtgctctcggcatggacttcccgaaacacttgttaccgacaatgggacacaattcacttcaaatgaatttaaggaattcacgaggaagaatggaatttcccatctgttttcggcaccgtactgcccgatgtcgaatggacaggcagagcggtttgtcgacactttcaaacggacgtttcgaaagttgaaaaaggagggggtagcgaataggttggatacgtttttgacaacctatcgtaccactcctaatgagtcgctggctggaaacaagagccctgcagaaatgtttatgcagcgcaaaatccgaacgactttggatcttctgcggccgaaacggcgcccaatcatcgaacgtgacgaaacgatggaaaggagtttcaatcgccgtcacggggcacaaccaagagaattcatggtcaatggcaaagtttttgcccgacatcgaatttctcaaccatggaaagccggacgtgtcactcaaaagaaaggagtaatttatgacgtgtcattttccgacggatcgtctagtaggttccatgcgaaccaaatgttggttcgtcacacgccggactatgaggaagaccccttggatatgcttaatgatgcatttgggcttcctctggccccatcggtggtagaaaaccctgatggacaggctgaagttcaacttcccatgcgtgccgacacaccggagccactgaacgatggaccactcgacgaagatgtaccaagtatccccgaaggacggccgaaaagaaacagacgccctcctcagcgcttttcgccgggatgatggacaaaccgattctttttgatggaggaggtgttaggacgggtcatatttaaattgtatttggcattctgtcccctttgccacgtcatcattttgaccccattccaattgtccttaaatatcctcccatttctctcccctcgttgttcatcaccactcattcattttttttgtcatttcccttcacttgaccccaatcaatattatttgtgtgccttgtcctatttaatttgga

SEQ ID NO: 68688 - DNA, 3435 bp, Heterodera glycines
  Genomic contig location: Contig_ID=SeqID_1147; Location=1925..5359; Strand=+
  SCN-specific regions: Sequence locations=1-633,656-1824,1846 -1956,1987-2301,2323-3406,3428-3435
atggcactgaccgtagaacagcttttgcaggcaatcgcacagcaaaatcaaaacccgtcactttcaggcattgacttgtttgaattgggcgatgaaagcaccaacattgaggattggttgcagcaattctgcttcgcgttggactgctcagcgccaaatatcaaagatgagcagaaggtcaaacttctgatgacgaaattgagcaaggcggcattcagcgagtacaagaagtcgtgcctaccgaaggatgtgactgactacaatttcgccaaaacggaggagcaactcaaggcattgtttgccaaaccacagtcggtgtggatcgacaggtatgagtgcctccgggctttcaagagcgaggatgagaacttccgctcattcatcaatcggcacaagcgccttctccgggattttgagttcaaaaaactcaatgaagagcaattttattgcttaatgctgttaacagctttgaaatccccgaaggatggcgaacttcgaaagagaattttgggcaaattggcggctgatggcgacagggcaaaatacgataaggtcgtggaggacctacaaatgtatttgtccacaattgctgaagctaaatgcatcgagcagcagccagccccgccaaagcagattttggctgtaaagcaaaattgtgcagtgagaaccaaaggctttgaagcacgtggtcaagtgcaacagcagctgaaggtgtgctggcgctgtgggcgaagctcacattttccaagtgtatgtccgcacattaaagttgcgtgccggaagtgcagcaaagtgggacatttggaagcgcagtgcaaccaacaccaagcatggctgataaggcaagggaaaatgcaaagccgtaagcaaggcaacctcaagcttggaggtgtgctgatcaattcgatgaaccaaccgaaacggctgattgaatgccctattaaaatgaatggaaattttgtggaattcgcgctggactcaggtgctgaggttgtagtggtcaatgaagagacacatgaagcgatcggaaaaccgaagctaagtccatgcaatgttgaagcgaaataccacgacggaacaaaatgcacccttattggaaaaggggaagctgagttcgaattcggagggataatccgaaaagggcaattttacgttgaggcaatccgaaggatgcccattccaaccaatgtgtccactctccgatcatttttgggaatggttaaccactaccaacaattcgtaaagaatttgcggtttattcgccaaccgttggacgaccttttgaagcaggacacggtctggaattggtccagcgaatgtcagaaagcctttgatcaggtcattggcacgcttcagtcggaccaactgctcacacattatgacccatcacaagaaataattgtgtccgctgatgcctctgagcatggtatcggagcagttatttcccatcgttatgcggatggaagcatcaaggccatcgcgcatgcatcgcattcgttggctccggcagaaaggaattatgcccaaattgagaaggaaggcttagccttaatttatgccgtgcaaaaattccacaaatacctttatggaaggcattttatcctgcaaacggatcataaacctttgctgtcaatttttggcaacaaaaaaggaattaaatcctgcaccgccaatcgattgcaacgttgggcattgattttgctcgcttatgattttgatattgagtatcaaaacacatcggagttcggacaagcagacgctttgtctcgattgatctcaaaaacgacgattgaagacgacgaagtgatcgtggccaatttgatgaatgtggaaacggaacttttgaatgctgttgtaaagcaatttccgttgaattccgatcaaataattgttgagattggaaaagatgaagtgctaaaaaaggtcatgaagtaccttcgcactcaatggcccacttcaaagaatatgtctttagaaatcattccatttcaccgcaggcgagaagccttatcaattgagaatggatgtattatttatgctgaccgggtggtgatccccgcatcacttcagaaggaagtcttgcagcaattgcaccagggacacccgggaatgaaacgcatgaaaaatctggccaggcaatatgtttattggcctggaatggaccagcaaatcgaagactccgttcgatcttgccaagcttgcgctgaagaagcaaaagcaccagttaaaactcttcttcactcttggccaaaagaagacggcccatggaaacgagtgcatatggactatgcagggcctttctttggaaaaatgtatttgatttgtgtagacgcattttccaagtggccagaagtctttgagatgagttccaccggatcagcagcgacgattgacaaaattcgttatctgtgctctcggcatggacttcccgaaacacttgttaccgataatgggacacaattcacttcaaatgaatttaaggaattcacgaggaagaatggaatttcccatctgttttcggcaccgtactgcccgatgtcgaatggacaggcagagcggtttgtcgacactttcaaacggacgtttcgaaagttgaaaaaggagggggtagcgaataggttggatacgtttttgacaacctatcgtaccactcctaatgagtcgctggctggaaacaagagccctgcagaaatgtttatgcagcgcaaaatccgaacgactttggatcttctgcggccgaaacgacgcccaatcatcgaacgtgacgaagcgatggaaaggagtttcaatcgccgtcacggggcacaaccaagagaattcatggtcaatggtaaagtttttgcccgacatcgaatttctcaaccatggaaagccggacgtgtcactcaaaagaaaggagtaatttatgacgtgtcattttccgacggatcgtctggtaggttccatgcgaaccaaatgttggttcatcacacgccggactatgaggaagaccccttggatatgcttaatgatgcatttgggcttcctctggccccatcggtggtagaagaccctgacggacaggctgaagttcaacttcccatgcgcgccgacacaccggagccactgaacgatcgaccactcgacgaagatgtgccaagaatccccgaaggacggcccaaaagaaacagacgccctcctcagcgcttttcgccgggatgatggacaaaccgattctttttgatgggggaggtgttaggacgggtcatatttaaattgtagttggcattctgtcccctttgccacgtcatcattttgaccccactccatttgtccttaaatatcctcccatttctctcccctcgttgttcatcaccattcattcatttatttgtcatttcccttcgcttgaccccaatcaatattatttgtgtgccttgtcctttttaatttgga

SEQ ID NO: 68689 - DNA, 1698 bp, Heterodera glycines
  misc_feature (1697)..(1697): n is a, c, g, or t
  Genomic contig location: Contig_ID=SeqID_1148; Location=4..1701; Strand=-
  SCN-specific regions: Sequence locations=1-313,335-1698
atggttggtggtgaagcggagtttcccgagaccccacggcacaccccgacaattgccatgctgacgtctcaccccagtaacgtcgagtcattcccctcgttccgcacggtcaatgacttttggagtctcgaggcgattggaatcaccgacgaccccaatcagaacgacgaccaggttgccatgcagcaatttagcaataccgtccgccaattgccgtctggccgttactccgttcgcctcacttggcgggaacctcggcctcccctcccctcgaattgggccatcgcatatcgccggctcctctcaacgaccaagcgtctgcaatgctctcctgagcttctcgaccgttactccgccgaactgacacggcaaatggacgccgacattattgagctgaccgggcgaaacaacgacgagcattttttgcctcaccacgccgtcatcaacccaaagaaactgaggatcgtcattgacgccagtgctcatgccaagggcaccccaagcctcaacgactgtcttcaccgcgggccagtgttgctccccgacctttgcgggattctcctccgcttccgttcagcgacaattcctgtgttggccgacgttcagggcgcctttcatgccatcgaagtcgaacccgaggacaggcgcttttgcaaaatgcattggctgaaaaaccctgcccgtcctgtctcaggcgacaatctcttgatctaccgctacaaacggctagttttcggcgcgacatgttctccctttatcctcgccgctgttctcctccaacacttcgacaagcacgagcacccattcgcccaagcgttggccgcgaatatgtacgtcgacaatctcctcatcgagtgcgagacggaggaggaagcaatcgacaagtcatcaatcgccaaacaaatcctcaaagacgccgacatgaacctcagggagttcctcagccactccccaaacgtcatgaagcaaattcccgaggacgaccgactcgacaaaacgccggccaaagttttgggcctgacctgggacaccccaagcgactgcgtcactttcagtctgccgaaagacacagacgccactgctacacggcgttcagtcctgagcatcatcgccagcacgttcgaccctcttggtctagtcgggccatgtcttctgcccgccaaacggctcttccaacggctatggggagaaggaaccgcctgggatgcccccctccccgacaccgaggcggcgacgtggagccaaaccctttctctttggcaaaaccaaacaatagtcatcccttggcactccattctcggcaagcaaagtcgcctacaactccacgtgttttgtgacgcctctgaacacacatttgccgctgccgtctacatccgaagcgagactgccgatagctccgaagcgaacctaatcttcgccaaaaaccgcctccggccacgaaccgcgaaccagcgcttcaccatccctcgactcgaactcctcgccatcctcgtcggaattcgcgccatgcgtttcgccgagaaagagctccggcgcccgatcaacgggcgacacttatggtctgactcccaaattgcgctctcatgggtgaagtccgacgaacccaaggcccaatttgaacagagaagactcgtcgagatccgacaagggcagcacaccactttccatttcgtcagaaccgaccaaaatcccgccgnc

SEQ ID NO: 68690 - DNA, 230 bp, Heterodera glycines
  Genomic contig location: Contig_ID=SeqID_1148; Location=4302..4531; Strand=+
  SCN-specific regions: Sequence locations=1-230
cctgaaagggcggctggcggctgggagaagagtgatgaatggtcgaaagcctgaaatgggcggctgacgactcggtgagggtttgtcgggagcctaaaagggcggctggcgacttgatttgagtgatgagtgccggaggcctaagatggtcggcggacagcgaagggttgagttgccgggagcctaaagggtcggctggcggcagagagaagagtgatggatggtcgaaa

SEQ ID NO: 68691 - DNA, 1827 bp, Heterodera glycines
  Genomic contig location: Contig_ID=SeqID_1148; Location=2216..4042; Strand=-
  SCN-specific regions: Sequence locations=1-1827
atgtcggaactcattcgtcaacgtctcaccgccgaagtccgaaccctttcggacctcgtcaagcgcctccgacaaagggtcgggaggctcactgaattcaccaggatggcgccagaggaaatcccgctcgccgaggagaccaaactcgccaagggcgtacgaactgaccgacaattgctacagagaagcatcgaccgcgtcaatggcatgctacgagaatgttttgaccatattcagctgctaggcgacccgtttctgaagcaggcggaggaggaccttctggccgtactcccgaccttcgacgacgagcaagccgacccaaatgtcgaagaatggccagtcatcactcttctctctaaagcccagctcatcctcgacggcctccaagtctacatcgaggctcgattcgacacgacggacgccatctcttctcgcagcagcagtcgtgtttctgatcacggggccgacgacgaaaaccggatccaccgccaacggcaatccaccgacccaccgactcaggcacagccagcgaatgcacatcagccgtccaattcggctagagccgatcaaaccctattcaaccagcgaaccccggcattcccgcttaacctcacatttccccgagcatcgaatcgccccacccatcgatcggaacctcaccatggccacttccgacagtcgaccaatgacgacgacgcactccgggtcagccgaatcgaaatcccgaggttcagcggatcggcagaagaatgggtcacattttgggccgccttcgactttgccgtccactcgcgccaataccccgccttccaaaagcacctcctcctcctacagtaccttgagaagggatcgccaccccgacggatgattgaaggttacccaccgtcagacgccaattacagcacagtcgtgagcattctacgagaccgctacggcgatgtcggcaaccgacgggaccaactcaatgcccagcttctccacctcaaacccgcccggaacaacctcaaggagttgcgccaactccagcaagagatcgagcggatctgcacccaactttgcagtctcgagcccgagggggagctctcgccaatcgccaacagctcgctggtcaccaatctcatcaaaagcaaacttccaccaccggtactgcttgacctgatccgaatggagcgcgagagctacacttcctggacggctcgaaattggcgtgagggatttgcgacaatcgtcaccgacaaagagcaggtggacttgtgcgtccgcacattccaggacatggacatccagccccgcgaacgtcctcccgaacgggctccctctcgtccgggtggtcgttcttttcgaccaccaccaccagcgccggagcgacgttatttggagaacactcgggcctttcctgctctcgcccaacccgtctctgccaatggcatcagttgctccctttgtgagcaggagggacaccgtccgagtgcgtgccagcgatacaccaccgtcattcaacgccggcgacgacttgaggaacaggggcgctgcctgcgttctccgtcaagaccacatcactcgcgattgctctcgtcaagatcgatgttcgaaatgtcaggcgaacgaccatcacttcctcctctgcccgtcaatcgaccccccggggcgaacaaaccatcgacaagagaatcaagagcggaatggaaatgcgtcccgcaacgtcagtcgtgccacgggagccaacgccgaaccggtccgaccgagagcgactcccaccacaaccgcactgctcgtgtgcgacgagggcgaaagcattcccgaggcggtatgcgccgccgcctttga

SEQ ID NO: 68692 - DNA, 690 bp, Heterodera glycines
  Genomic contig location: Contig_ID=SeqID_8617; Location=256..945; Strand=+
  SCN-specific regions: Sequence locations=1-132,156-265,288-289,312 -601,625-690
atggtcgcacattgcgataaaaggcttggccatctcagcactcatttggccatacgcaggggtgacgtgagtcatcaacaattattacacagcacaaaaaaaagaattcaatcgattgcgtgcgctaattgattttaaaaaatcaccaaaagcgtattcgatttgtcaacatttgcttattatttttatttacaccaacaccaatcatggacggtaaaaaagaaaaaaaagcgacaataaatctttttatggataattatgggaaaaaattggcgttctgtcacatttactttttatctttatttctctcacttttacgtactatctcttcattcttaataatgtaaagaacaacatttacttcatcctgtttaacttttttcctacttgttaaatccacaccaaattttgcatatcgctagagaaaaaaattctgcatcgaacgtatcaaatatttttttaggttatacatcccgtttttgtagtagagttcaaaaagtaaaaagttgaaatcagcagtttaggacttgagttataacgtgatgaacatttgaaactcgcacaacttttttctgagatgtcaaattgcttagcattcacttagaaaaagattctccttttcaaaatctttttttagataccaaatttgttcatttttgttgggaatgaagcgtattatggctgatcaaa

SEQ ID NO: 68693 - DNA, 572 bp, Heterodera glycines
  Genomic contig location: Contig_ID=SeqID_8618; Location=594..1165; Strand=+
  SCN-specific regions: Sequence locations=1-87,111-180,205-205,234 -274,309-385,407-419,449-521,543-572
atggcggaatgccgagaatgtaaagaaaatggaaggcccaagtatgaatttagcctctctgactccagcaccaaatcactcaaaatccatcttttttcaacaatccatgctgattcggaatatgtcaaaaatttccaacaactggagaagatgaaaaaggagtcaaaagaaaaagctgataagaaacagccgacgatcgaaaatctaatcggcacgaatttgaccagcagcggtagttttgtgttagtaaattttacggattttggtttttttaggcattttgtctgtggctgacaaacgaattatcagcatgataacctgtaacaatctgtcatttggtttgctatctgatccgacttttaaagctcagtgtaaatatgagctgaaggatgaaagcgattatcggtaaaagtcaaagcaattaaaaaattaaaaaaataattttttaggaaaagagttctcccggaagcatacaaactagtcaaggcaaaaatactcaaggatttagatgattgcgccaatctcagcttcacaattgattgttgggcaggtccatcagacaattttttaag

SEQ ID NO: 68694 - DNA, 229 bp, Heterodera glycines
  Genomic contig location: Contig_ID=SeqID_8618; Location=1140..1368; Strand=-
  SCN-specific regions: Sequence locations=1-229
acaaaagcaaacactcgatcgtcatttattttccagctatccaataatttacggacattgcacgcaatggcattgccagaatgttggccgggaaaatggtgaacagcgagtacaaaattcttttgcacccaattttttgtgacgccgtgaccagtcaagcttaattattttttgaaataccgcttcttgaagcctaaaattaccttaaaaaattgtctgatggacctgc

SEQ ID NO: 68695 - DNA, 270 bp, Heterodera glycines
  Genomic contig location: Contig_ID=SeqID_8619; Location=803..1072; Strand=+
  SCN-specific regions: Sequence locations=1-154,178-188,210-220,252-270
atgatggccaatggacaaccaaccatattttcatctaggcatgtaagtatatacaatagcattatcgtgttattgcacaatttttgttgtgcaataaccatttatatttgtattatgtttgataatcaaaaaaaaaataaacctatgtaattagtaatttaaaaaaattaattaaaagatttggtgacttttttgggttatttttgagatatttcatcaattttttagaaagtttaaaattttataaaattctcgttttaaaatttttca

SEQ ID NO: 68696 - DNA, 489 bp, Heterodera glycines
  Genomic contig location: Contig_ID=SeqID_40325; Location=376..864; Strand=+
  SCN-specific regions: Sequence locations=1-113,177-329,392-489
atgatacaacaaaattcagtggtaattttcagtggttttatcgacaaaaataagcccattaaagtgcagttttcgtatcttggtactcatttggctgcatatctgtagtacggaaaaaatattaatatttcttttttaatatcaaaaaaataatttttattgtatttttaataattcccccagaaaaaatttaatcaaatttcgcagaattttattatgatacaacaaaattcagtggtaattttcagtggttttatcgacaaaaataagcacattaaagtgcagttttcgtatcttggtactcatttggctgcatatctgtagtacggaaaaatattaatattccttttttaatatcaaaaaaataatttttattgtatttttaataattcccccagaaaaaatttaatcaaatttcgcagaattttattatgatacaacaaaattcagtggtaattttcagtggttttatcgacaaaaataactcca

SEQ ID NO: 68697 - DNA, 1297 bp, Heterodera glycines
  Genomic contig location: Contig_ID=SeqID_40330; Location=157..1453; Strand=+
  SCN-specific regions: Sequence locations=1-437,464-649,694-716,740 -974,1014-1020,1042-1297
  Gene Ontology: Mol. function=ATPase activity; Cellular component =nucleus; Biological process=protein-nucleus import
atggacaatggtgatgatggtgcatgtgcggacaacgacttgcgcaacgatgttaatcatcaacaacagcggttggacaaatcacaagtcgatggggcggatgaagcggactggacagctggccaagatgagggggacaaggcaaaaccaacggcggtagatgaacgtgctgaagaacatggtgatgcggagggtgatgaccaacaacagagcatggaagacgaaggcgctgctgctggtggtcatcaacggcaattgcagcagcaagaaatgggcgaggtgagtggcagtggcttttctaggcgctatcccgtcatggattatgaatcaataggcttaccaatgtgtaccgttcagttgtcagcacatggctctgcatcgcttgaacaggcgcgtcagacgcgtgcactattccattcccatttgcgtcgacttcgtcagcaacaacaacagcagcagcagttggatcaatcacaacttgaagaggctgaccaagctgcggatgaccaaatggctgaccaagatgaagcggctgccgccgtagaggaggaaggcatggatgaaagcgcgggtttcaattttggcgacctgctcaatggaacggaagtgatgcgttttgacccaaaattgtggcaaaatgatgagcagaacggcggacagcagcagcagcaaaaggaggaggcaatggaagaagaagaaagggaaggcaccagccgtgatgatggtgatgatcaacaacaacaactgcagcaccgtctacaactgaaatgggcactgatcacggacagtgtggcgccactcgctgctgagctggccgagtcactgcgtgccatcattgagccaaccatcgcgtcacgactcgagtaagcgcgcgaggggaattaatttgttgcgcagatccctccctggcggccaggcccatagccaaaaaaaaaaaaaaattcggaggggagcccgaaaaaattttcgttgggctaaaaatttcaagaaattttctctgttattttaaaattttggtcccattgaaaaaaggagatatttgtagcttattcgccaaaaaatgacttgttttgccatctcctctttttagggttttctaaaaatttgtgtgtcaattttcagaggcgattatcggacaggcaagcggctgaacatgcgccgtctgattccctacattgccagtgactatcggaaggatcggatttggatgcgccggacgcgtaaagcacgtcgaaactatcagatttgcattgcggttgacaactcgcagagcatgcagcacaaccacatgactgag

SEQ ID NO: 68698 - DNA, 99 bp, Heterodera glycines
  Genomic contig location: Contig_ID=SeqID_40331; Location=97..195; Strand=+
  SCN-specific regions: Sequence locations=1-29,74-99
ggaggaggtgactcatcgtccaattcatcggaaggagaggaggaggaggcgaacgaagaagaagaagagaagggacaaagtcgggagggagacgaatga

SEQ ID NO: 68699 - DNA, 305 bp, Heterodera glycines
  Genomic contig location: Contig_ID=SeqID_40331; Location=376..680; Strand=+
  SCN-specific regions: Sequence locations=1-305
atgccaaatttgctccaagttctgttcggaccggttgtttaccgcccatatcaacccaacctattggaatcgggcggtaacaagctgttcagcatcggtgctggtgcctacaacacttgtgttgtgctgtcgcccattctcgtgccgtacattgccttttcttggacccactcccatcacttttcttttgtcggtttgcatgtttccaattcagtcctctcacttttgtccctttttcagttgcgcttcgttttggtgttttatgccattgccttttccttccgtacgattggtcggctgacaaa

SEQ ID NO: 68700 - DNA, 675 bp, Heterodera glycines
  Genomic contig location: Contig_ID=SeqID_8620; Location=875..1549; Strand=+
  SCN-specific regions: Sequence locations=1-6,28-196,218-417,451 -618,640-675
atgatggtaaacaaatttattaaactatttgttttgcttcttctgatctctcccaccaatgaaaagccgcatcagaaaagagccttagtgacaattgcattgattggcgccttagcacaattgaaggcgtatttattagcgcacaccggagttatattaacagcatcaatgataacagcacttacaacattgtctctcgctgtatatgttaagctcaaacgtgagatattgtttttaaatatttagaacttatttattttctaaattatagattgccgatgtggcgatctgttaaaagatttctttcccataaccttcgtcctgaactcgtacgagttctctgtgtcagtggaggaatttacacccgacaacatttttgaaaaaatttcaaaagagctaggccggaatgttcagcaattttgctttggtttgttttaaattggtttaaattattatagaaagatataataaattcagcttctccttcggaaacgactcgaaagattaaaaaaagtgatgaagacatggggcttcttttatgcaacccgaagccaaggacggctggaaatcttcgactgcccctgattcaggaggctggaaatcttcgactgcctctgtttcattttttatgatatttcccgttggcccttgggaaaggcattttctttttttcaa

SEQ ID NO: 68701 - DNA, 684 bp, Heterodera glycines
  Genomic contig location: Contig_ID=SeqID_8622; Location=829..1512; Strand=-
  SCN-specific regions: Sequence locations=1-103,154-257,295-684
atgctgtgggagcaaaacaacaggggcctcgaagaggaggccaagcaaaggcaaatccgaaacaaaattgaggaattgacggcaaaactggcagggaaacccagagaagaaatgggagaagaagaggcaaaggagttgggaaaggagaaggagcgctttgagaaccccccggagccgccaagagagcgcaggcctttctattccagcgccgtggcgcgctttgagtgccaaagcgaattggactcagcgtcgaaactaagaggaagagaagaaagaggggacagagaaaggaacttgggaatgagcgggaagcgcttgttcacaaacatgctcaaatcggccgtcgggacagtaaatgaccgtccctgtattccacccgagggattaaatcgcgaaatgcttaaaagaagaccgactccagcgccagtgccgcagtttacgacacgcagcgcggagaggagccccgtgaggaagacatacgcgccgtttcggaaagggatgccactggaacgcgcggaggaagctatctacaaaatccgcaagtcactgctccaggccgcggacgcgctttcagagctcgccgacgaactgttcccgcacggagaagcgcgagagaaagatgaaggaaaggaggacgaagaggcgcagtggggaggaccgggcccctctcattcttttatgtag

SEQ ID NO: 68702 - DNA, 522 bp, Heterodera glycines
  Genomic contig location: Contig_ID=SeqID_8622; Location=1908..2429; Strand=-
  SCN-specific regions: Sequence locations=1-522
  Gene Ontology: Cellular component=cell wall (sensu Fungi)
atgactaatattccttcgacgattcgcccaatcgctactactaatattcctctgacgattcgcccaattactacgactaatattcctccgacgattcgcccaatcgctatcactaatattcctccgacgattcgcccaatcgctacgactaatattccgccgtctattcgccctatagctactacacacactccacccacaacccgcccgattgctactactcatattccaccgacaattcgaccaattactactactaatattcctacaacaatccgcccgacttcaaccattcatagccctattataatcaaaccaacaacgacaatcccgacaaccactattcaaacgccaactaaattaatctttaccacggctacaccaaacaccgtctctcctcacaccacaaagagtgcggatgacaccgctccgaccactgcgtcgtatcattccattcttgatgagcttagaggattggccgaagaagctgatgaggaaggcattttatttctccgacgataa

SEQ ID NO: 68703 - DNA, 704 bp, Heterodera glycines
  Genomic contig location: Contig_ID=SeqID_40336; Location=237..940; Strand=+
  SCN-specific regions: Sequence locations=1-267,289-305,327-618,640-704
atggaattgcccgctccaattttccaccgtttgcgacatttcgtgccgtcaattctcaaagattgtatatcgcttcgcgttatcaacacctattcctatggtttcttcatcgaatttccatgcgatgacagtgccgcggcatcggatggacaagcggtggccaaatggcttttcactccacgtccggacaatgtgccaaaggtgttcaaatgctacttggacaaggatgatgcgaatttgacgtccaaagttgaagcattcaaaacggtgctttcttttattatttcatatttctttaatcaatttttcccgtattttaggcttttgccaatgcttcatctcccgccaatttcattgtctccatttggtttcgttattttgctgacttcgttgtgccatttgaccaaatcaacgaattgactcgggaacaattgacactgaaaagaactgactttcactactgttttctgttggtccgttgtccaattgcgcgagacgaaagcaaatggacaaaatgggaagaggaagcgattgactggcaaagttatggtcaatggaatcgaattagcatttgtcctatttttgtggatgacatcggcgatgggtcagcgaatattttttcaataaatccaaatttatttatgtttcacttttttaggcttctcgacgaaattcccggcccaagtgatcaacagcagaagtga

SEQ ID NO: 68704 - DNA, 381 bp, Heterodera glycines
  Genomic contig location: Contig_ID=SeqID_40337; Location=667..1047; Strand=-
  SCN-specific regions: Sequence locations=1-381
atggggactcaaatctcttggcattctaaacactggggactcaacccaccaactttcactgacattccaatcactgaaaatcaagccaccagcattccaatctctgagactcaattctcaggctttccaatcgtgggactcaacccatcagtatttcaatctctgagactcaaatctccggcattccaaacactgggactcaacccaccaactttcaatgacattccaatctctgggactcaacccaccagcatttcaatctctgagactcaattctcaggctttccaatcgctgggactcaacccaccagcatttcaatctctgggactcaaatctccggcattccaaacactgggactcaacccaccaactttcaatga

SEQ ID NO: 68705 - DNA, 669 bp, Heterodera glycines
  Genomic contig location: Contig_ID=SeqID_40339; Location=396..1064; Strand=+
  SCN-specific regions: Sequence locations=1-103,125-169,195-210,310-669
  Gene Ontology: Cellular component=integral to endoplasmic reticulum membrane; Biological process=ER-associated protein catabolism
atgcgtcgtggaagaccaaaatgcagatttggtcagttttaaagcgcctattttggggaaattttgtcatgaaaagtggatgtaatacccctatttgtaaacaatatgcaattttctgtcgcttaataattataaatttttagtccacatctattttttagctgtacaacgcttacacacaccctcctccccccgtagcgttttcctccgaaaaaaatttattaaaaaaataaattcttaaaaaaattttgaaaatatttttttaatacaaaaattttgaaaaattcttatcatttttaaaaaaattatgatgattgcttttttttcttcaatttttttttataaagaaatttttgatcatcacattaatttttgaaaatttttttaggcgacggtgaaccgccaaactatttgaatgtggacattaaggacggctttgtgctgaacacatggcttgacgcacttcaggtggctattgtgatccttccgatcgtcaaaaatcaaaatttaaacgattttttaaattttttttaggccagctttgctggtgtccaagtgttggccggcgatttggacgacgccatctgttcccatgccttttattacgcaatttggcgcaaatatgaattgttgccggaacgtttcaattggcattcaaaggcaccggat

SEQ ID NO: 68706 - DNA, 1170 bp, Heterodera glycines
  Genomic contig location: Contig_ID=SeqID_40340; Location=411..1580; Strand=+
  SCN-specific regions: Sequence locations=1-192,215-986,1008-1139,1166- 1170
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgataagtttctgaaaaaaaagttaagcctaaactttttggccaatgtaaaaaggaattaaaaatttttaaaaattttattcatct

SEQ ID NO: 68707 - DNA, 1816 bp, Heterodera glycines
  Genomic contig location: Contig_ID=SeqID_8623; Location=196..2011; Strand=-
  SCN-specific regions: Sequence locations=1-314,339-693,719-749,774 -1156,1178-1774,1796-1816
atgccgatccgtgccctgccgtgcccaactaccgccttaacacaccgcccgctcaattccgcccgtcccgtgccgttgacgtgtgccgagccgaccactcccgttccgtccccaaattgtgccgtccccattttgtgccgtcctcattttgtgccgtccccatttttgtgacgtccccatttttgtgccgtccccatttttgtgccgtccccatttttgtgccgtcccccattttccccccattgtgccgtccccatttctgtgccgtcccccattttccccccattttgtgccgttcccccatttcccccttcggtttaattacccaagtttgaggattccaataaagtgcattttgaatcgctttcccgcctcacttgacccccagcaattccaccatccccgattgaccgtcaagcgtccacccccaatcgccccagctctcgccaaatccgggccgttgccagccaacaaacacccattcagtaccggccgctcaatctccgaccgactccccgactcgcgctcttcatcccgtcccccccatttgtccatcaccgattgcggaaaggacaaagtggtgcacgacgacccggaacgccctgcgcacaacaacgatccggcattcgacaacaaatcgtcaaactactgaaacagcgaaaactcttcgtgccgcagcccaacttcaaaagtgagaaaactttaaaaatttttgctataaagggtaaccaatccccacactcaaaaaattcaaaatttttaaagggataaaaccctaacctaccaaaacacacacaaaacagtcatttttctcgaacaaaaaccgacaaacacacccaaaatcctattacaaatcaatcaatacccatcccattcagtgaaaagaacaacccgatcggcatctcgtgcaccgacaaacccaaacgaagttgaagaagaagaaaagaaggaaaagacaccaccgaagaaaagtgatcaaagatttctgatcgtaccgatatccattttttagtcattcgcactcattcgccttcggagcaaaccgaagtccaattccttgggtccacccccacctctgaaaaatccgacccggtcaccctctcgcctgagacccaaaaattactggcaaaactgaaagcatccgaaatcaaagtccaaaccaaacaactgaaaaaagcaattgactgtgttgaacaaaccgtaaaaaccaaccaaaacgccgacctcatccaaacaacaaacgcagtcaaaaaattcaactcaatccgtgagaacaccccggaccaaccgaattttcacagcaatttctcccccgaaattgacaacggttttttgaagaaactgactacgctcgaggacgagcggtcagaaatttggtcgaacgcggtcaaagagtgcaaaaagcaagaagaaagaagggttagatcggtcgaactccaaaccaataatatcttagaatcggtcgcaaaagcgattcgtgccgaggattttaacaggaaaatcctcgaggaattactcaaaacagtccaatcgactacctacgccactcgggccgcccgcgacaagaccgtcatctgcgcacagaaacttcagaataaccttctgcatcaaagacggttcctaactgcgcaagagcgaacggccacattcatccgcaaaacatttggtttgccgacaggcacaaaagaagtggacaattcgggagcaaccacttccgcagacggacaacagtgataattttttgtgatctgtgatccattgttgacaaattgtgatttattttgtgataaatatttaaaacaaaccggtgattaaa

SEQ ID NO: 68708 - DNA, 618 bp, Heterodera glycines
  Genomic contig location: Contig_ID=SeqID_40344; Location=152..769; Strand=+
  SCN-specific regions: Sequence locations=1-72,109-136,162-247,284 -410,447-579,616-618
  Gene Ontology: Cellular component=Cajal body; Biological process =nucleolus organization and biogenesis
accattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttttttaattttttaatttgtgtttttatttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttaatttgtgtttttctttagaccattcctgtgaccaaggccaaaccaccggcggagtccgagtcgagcagttcgggagacgacgacgaagtgccggccaaaaaaccggcccagaaggcacagccggccaaagtgcctccgaaggcaccgaattttcttttaaatttttttaatttgtgtttttctttagaccattcctgtgaccaaggccaaaccaccggtggagtccgagtcgagcagttcgggagacgacgacgaagtgccggccaaaaaaccggcccagaaggcacagccggccaaa

SEQ ID NO: 68709 - DNA, 147 bp, Heterodera glycines
  Genomic contig location: Contig_ID=SeqID_40344; Location=114..260; Strand=-
  SCN-specific regions: Sequence locations=1-1,38-123
tggccggctgtgccttctgggccggttttttggccggcacttcgtcgtcgtctcccgaactgctcgactcggactccaccggtggtttggccttggtcacaggaatggtctaaataaaaacacaaattaaaaaattaaaaaaaaaaa

SEQ ID NO: 68710 - DNA, 141 bp, Heterodera glycines; identical to SEQ ID NO: 58837
  Genomic contig location: Contig_ID=SeqID_40344; Location=633..773; Strand=-
  SCN-specific regions: Sequence locations=1-7,44-141

SEQ ID NO: 68711 - DNA, 876 bp, Heterodera glycines
  Genomic contig location: Contig_ID=SeqID_40346; Location=20..895; Strand=-
  SCN-specific regions: Sequence locations=1-6,28-72,98-290,312-365,387- 556,578-876
gctgtctctcgtcctccaccgccaccggccaagaaaacagataaaggcaaagtgcgtttacctaattggctatttattttatttgttgtttttgtttccattcaaaattcgtttttaaaaaggtcgttcctccgccgcgtcgtcctccgccttcgggtaagaaaccattcgtcaaagccaaagtgagttcgttcaggacgacaccgaactcgtactgtttttcgacaaaaaaaggcgtcataacttttgtcaaagtcgaccaaattaaacattcttggtatcttagctaaattttaatcaaattttttgaagcttggtatattgatagagaatttaagggctattgaatgatgccaagaatgtttatttggtcgactttaacaaaaagttaggacgacttttttgtcaaaaaacagtacgggttgggtttttaccgttcgttaatcatcatttgttcttgttatgatgaattcgtctcttttaagactctttcgcctcgttttccgtcaccgttcacgaaaaaggagccactcaaagtgagacactttgcccaatttctgtctctttctttttctcttccgtttaggctgtccctcctctttctcgcttcccctccatggaaaagaaaaacactgtgaccaaagtgagttttttcggatttgcattttttcctttattttctcaatttttccttaattgtttcagattgtgcctccttcaatgctttcgaaaccgcagaaaattgaaccattcaaagtgagagcgaatcgtttgccacttctctccccacaatttgcctgtcatttcctctgtttaagccacagtcatcgccgatggggccttccgaatccgaaaaaggacgcccgcattggaatt

SEQ ID NO: 68712 - DNA, 651 bp, Heterodera glycines
  Genomic contig location: Contig_ID=SeqID_40349; Location=149..799; Strand=+
  SCN-specific regions: Sequence locations=1-8,30-651
atgcgagcgaaggtatttttgggccattttcccctgctgctgttgggttgtaggggcgagcccagcgggactggccgagttgggacgcaatgcgataaaatccatccgtatttggaaataaattccggattaatcccacgcaaaatccctgcaatttcagtggcgtaagaagcgaatgcgtcggctaaagcgcaagcggagacaggcgaagaaatgagcggacggacggagagaaaactcagccgaacgcggaaacggaggcacaaaatgttgttgctgtttttttgttattgttgtcaaccgcccctttactcagataaaatttgttgcaaaatattgggatattcaatcaaattaatttttagcaaaaatccatttgttaagcattgctttggcaaaagatttggatggcacagtttgccgaaagacctagttcgagcatgattcgtttaaccgactcaaattctcattcccaaaaaatactatgtgatttttctggtggtctatttcataaaatgttatgcattgattatgatttttgtgttttgtgatcagttaaaagtcacatatggtagaatttttcccattgtcgggttcgatttacacgaaatcctgggactgtccctgttctttgacttcgtttgctccaaa

SEQ ID NO: 68713 - DNA, 760 bp, Heterodera glycines
  Genomic contig location: Contig_ID=SeqID_40351; Location=266..1025; Strand=-
  SCN-specific regions: Sequence locations=1-76,98-418,441-460,482-760
gtggcacccctctgggcttgtactgtaagctgacagagatgcacaaggctggccaagtgtcgtttgccaatgttgtcaccttcaacatggacgagtagggaaaaacgggcgcatttattagtgccactttgcgtgatctaattcaaaccgaaccagcagcagcagttaaatctgctgatcggttttacgaggcgccatttgattttttgatcagagtccaaatccggcactttccaacagttgaaatatattaaccgattttaaatgaattctttagtcatgaattgatagaaaatgtcttttttgcttatcctaagatatgttggcattccgcgcaaccatccgcacagttaccacacattcatgttctccaatttcttccggtgagtacatattttgaaaggatagaaacattttgaagggaaaaatggatgaaaaatccttctaaaaagtgccaaagttgaagaattaccttatttgcctctgatcaattattcactgatcgcccccaattttccctttaggcacattgacatcgatccgtccaatgtttggtttttgtccctccgccactaattttgtgcccccccctcccctcaaaaggtgcatattccgaatggaaacgccgccgatctgaccgcggaatgcgcaaactacgagtaagaaaggcgacacgatttgctgttcaataaattgacgccttttcactattttaggcgttcaatcgccgccgccggaggcattgatttgtttgtgtccg

SEQ ID NO: 68714 - DNA, 974 bp, Heterodera glycines
  Genomic contig location: Contig_ID=SeqID_8626; Location=475..1448; Strand=-
  SCN-specific regions: Sequence locations=1-16,38-114,136-406,439 -515,540-600,669-672,696-745,767-974
atgtcgggggagaaggaatccacgccggggcaatacagattggtcgaagtgtctgtgggcggacagaaggtggaagcaactgctgcgcaagtgcctgggaaaatggcggaatttgtggaatggctcaatgctgaagacgcccaaacaaatgacgttgccacttttgcggccactgctcactataaaatggtataacaatgataaaaacagcccacatttgtaagttaaaattctaaaattttctgatagtaacgaaaatgatttcctggttatattaatttgacaaattcgctaaaagttttaatttttcggttttaactaaacaatttaatataccttaattaattttgtttcataaaaggacccactttctaatattcgtgtttttagtcaatgctttgtaatttttcgtttattttactttaataaaaataactctctcaaataacaatgcaagaaatgaatttaggccaaaattcaccctttttggatggaaacggatgcacttgccatgaacttcattttaaaaagaaaaggctggaacaccgtcatcctccctgacaaatatcgtcgtgcttattatgaatgttttgacactggttttaattgttaatttatattaataatttatttaactgatttgtattttaaaattaatatttaaataacgaatccaaatgaatttattttcaaaatgttcattcaaaaattagtgatggtggtcaatgaagtgaggatattttgagtaaaaaagtgaaaataatacatataacctcaaataattcgtaaatcgcgaaaattttcgagaaaaaatctttgggatagataattttttctagagaaaatgagtaatcccattgcaaaaacacaaattttctacgtaattgccttttgaatggtgggtcaacgatttatccgacttatcgccgctgagttagagagtgtcaaaattggacaactaaaaaatgaataaa

SEQ ID NO: 68715 - DNA, 330 bp, Heterodera glycines
  Genomic contig location: Contig_ID=SeqID_8627; Location=15..344; Strand=-
  SCN-specific regions: Sequence locations=1-231,253-330
atgagcagcgacgattcacaaatgccacaagaggagagcagcgaagatgcaccaacgcccccagaggactattttgacacccccgaggaccatcaaaaagcagtggacatacaaagaggcagagaagcgggacggaacaccgccggcggcatgcggcgcgatcgcgatgtgtccgcgtcgtttgatgatgacaaggacttcttgtacatcttggacaccgaagggatggacccaaaaataatttctgaacaagtagaatatttctgctgcaaaagaaaaggggataaaactttccaagaattaaattgttttgatggttgtatgcgatga

SEQ ID NO: 68716 - DNA, 445 bp, Heterodera glycines
  Genomic contig location: Contig_ID=SeqID_40352; Location=265..709; Strand=-
  SCN-specific regions: Sequence locations=1-183,312-445
atgaacgacacgaacagtgacgactcggccaaactgccgtcatttgtcctaaagaaagtgcccataaatggacatttttgtttcaaaaatgccggaacgaacgtcgcctgcgtctgctccccggcggaacaatcggccgccgattggccttccgtcggctcatttttttgtgttttgtgccaaagaaagcgaagaaaaagcgcaaaagaaattgcgaaagacagcgaaacgagcagagaaaggagggcaatgagaagaagaagcataagggaagaagaagaaacagcggattctgagaaggaagggaaaagtgcacagattttgaaaggattaattaactgcaaataacaaatcaaattcaaatggatgagacggatggactccaaattgactactaattttactgactaaaaattaacatattatattctgatttgaaaataaa

SEQ ID NO: 68717 - DNA, 144 bp, Heterodera glycines; identical to SEQ ID NO: 57282
  Genomic contig location: Contig_ID=SeqID_40356; Location=253..396; Strand=-
  SCN-specific regions: Sequence locations=1-46,89-144

SEQ ID NO: 68718 - DNA, 252 bp, Heterodera glycines
  Genomic contig location: Contig_ID=SeqID_40357; Location=418..669; Strand=-
  SCN-specific regions: Sequence locations=1-217,239-252
atggagaaggcctgcaaaatttggagagattatatcgattttagtgcgctaggttcgatgaaactttttaaaatataagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaa

SEQ ID NO: 68719 - DNA, 155 bp, Heterodera glycines; identical to SEQ ID NO: 60582
  Genomic contig location: Contig_ID=SeqID_40357; Location=105..259; Strand=-
  SCN-specific regions: Sequence locations=1-32,59-155

SEQ ID NO: 68720 - DNA, 851 bp, Heterodera glycines
  Genomic contig location: Contig_ID=SeqID_40358; Location=70..920; Strand=-
  SCN-specific regions: Sequence locations=1-525,555-600,637-807,837-851
atggccgacttcgaagggcgtgtcaaagcttaccgtttggtggattacacgacggtttctttctccatcatcacacttttgtatgtgtgcttgtcactgtcaatgatgaagagtattgtgttcattgtgggcatgaaaacggtattcgagctcagttcattccaagcatggcataaagataggatttgttagtacatgaacaaagttattgtataaaatcctgggatcgtcaattgagaggactcataaaggtagattggactcataaagtgcattagagccgttaagttttttcgaaaattttttcaaaaaattgctaaaaatttcaaaattttttaaagaaatttcaccgacgaaattttgggatacacccatttatccatatttatgcattttattcaatttttattatgctctttcaatttttcttcctccttttcagccgtgcccatggctatttgccgcgtccccggcgttcatcggcacaaaaaagtgctgaaaagaaaaaacaaaaggtaatttgtctctttaaaaattatttattttgtatatttctcaattttagccatacgccgaaccgatttatgcgggagaggttggaatattttgttaaaaaatataatttcttttttatttctcatgattaattcaggaaaaaatcatcattttctgtccaaacaaagcagcagacgatggtgagaaaggcaccgctgagaatgccattggcgatgacgcagaagaaaatgcggatgaacaacagtttggtgagccgccgatgttggcacgcgccacactgaacagggccgggcttgaggaggaggacgaggaggaaacggcggatgaggcttctg

SEQ ID NO: 68721 - DNA, 190 bp, Heterodera glycines
  Genomic contig location: Contig_ID=SeqID_40361; Location=443..632; Strand=+
  SCN-specific regions: Sequence locations=1-190
atggcaaagccaatcgttttgaatttcgcttcccagtcaatggatctggctgcattaggcccaattctgatcaaaaaggtttggcccaatttttgatttttaaaatgttttttaggtccgacgcggtgccaataagtgccaccgttggggaaaatcactttccctggcatggactgaaattttcatataa

SEQ ID NO: 68722 - DNA, 1795 bp, Heterodera glycines
  Genomic contig location: Contig_ID=SeqID_8629; Location=110..1904; Strand=-
  SCN-specific regions: Sequence locations=1-203,225-498,520-558,580 -610,632-638,660-1275,1322-1336,1358-1687,1709-1795
atgccaactgttcgcgaaatactcgagagtctgcaaaagccaaccaaaaggcctcggatgccagcaaacgaagacagcgtaattaatgttgagaggacaaacgcagaacaacaggctgcgcgcacaaattaggacgggtgtcgacgatgaaacctttgaattactcggcacaaacgaagcgctcgatcgaatgacgaataggttgaaaaattcaaataaataaagatacatagtacacatcaattatagaacaaagaatccatcattgagtgacttcattgctgcgttcatcaaagacatcgacaattaactggacatcggacgcgcagaacagctccagaaaagtagaaaacgaccgcaacggtacattatcaaagaacaaaatgtggtgcggatccttgacgaggccgactttgaatctgaaggattggccaacattttgcatctgctcggactcataatgcagggatttgttgagggacttcacatccgtggaaatgaagagagtgatgaagaagaaatggatgatgccgatgcaaattgaattatgaatttaatatttttaactttctatatttcgtttgaattttataaaatttctttgcttcggtgtacttttataaatataagctaaatataaatctattttagaaagaaattcttcatggaaatgtctcttttaaggcattaggcgaaacatccgattttgggttggtaggcgaaatgtcagtaggcgaaatgtcatattttggattagtaggcgaaacgtccgattttgggttagtaggcaaaatgtcgagtaggcgaaatgtcagtaggcgagatgtccagtaggcgaaatgtccgtacaccagcaatgcaacgacctttttggggccggtggcgaagttttgtagattttacattcattttaagagattttcaagaaaaaaatgcaattttggatattttatgtggcattttggttatctttttaatagttaaaattgtacaaatttccaaaaatcgcttaagtggtatcttcactatgggtcaactccactgtgcagagaaaagcctagtactatctcgacgttactctttttctttgtaatttctctcactttggcgtactatctcttcaatttaattatgtgaaaaaaaaaatttatttcgctctaagaaacttttttttacattaacagaatttctttaaattttgcacattgatagagaaaaaaaaattctgcatctgtctatagtgaattcgtttttgtctatagtccaaatcaaaagttataaatttataataaataattatttcatttttattagattttatggcaaaaaaaatgtaataaacaagctacaaagcaaaaaaggggcggggcccaaaagcgttggacgaaatgggaggagagacgagagaaggcggaaaggcgagataaggccgatgggccaagaaaagtgagtttttccattcatttttcataaaatcctaattttccaaatttttagccgctccccagccgaacacatgcaaaaacgccacaaccatccgaagaagagccgtcgacatcagaggcaccggcgcgggacaacgacggacgaccaccatcaaatccaacaccgatgacaccgcaggaaatggacgtgccgtcggtggagatgttggaaattgatgtgtcatacccttcaactcctgccgacgacgaccaacaagccgaaccaatgccgtcaacatccacggcacgttgtgagctgatgacgacaccatcgacatcaaaaggcgccggtggcttcggtctcgacgatg

SEQ ID NO: 68723 - DNA, 1757 bp, Heterodera glycines
  Genomic contig location: Contig_ID=SeqID_8630; Location=74..1830; Strand=+
  SCN-specific regions: Sequence locations=1-289,311-1057,1083 -1257,1279-1381,1403-1437,1485-1757
atggcacatgacaatgttacaataattaaaatatcagccaacaccaaccaaaatcgtccagccaatgcccttggaaatggcccagtcgatgctgtcgaaaatgagcctgccgatgccgttgattatggcccagtcgatgccgttggaaatggcccagtcgatgcagttgaaaatgagcctgccgatgccgttggacatggcccagtcgatgccgctgtgctgaaaatacgacgaaaacgtgtcccggcattactattggccgccgtaccgctggcaaaaaaatttgctgttgctcttttggttgctgctggaaaagaaattgggaaaaatcttttttcgggaagtaaaatcaaagacaatccagctgctgatggatatagtgattcgaaacaattttatgtttcggaagaatgcaagagggattttaattgcacctttttcgcttgccacccacatcctgatgcggaaggcgacagtttctgtcgcaagggcttcacgcgcaaatgttgccaagtatttaatttaaatttttaccaaatggaattagtaggtgaaccaatgaaattttgtatctttttgacaaaacgaatggatctattaaaagtccatgaattttatctgcctaaacaccaatcactggacactgtttgtcggcactatttttaggttgtgtagtataagcaaaagtaccatttttacaccagacgatctaattatttaatacataaatttgaattaattaacttcattttaggaatacaatgatggagaaaaggtaattgttcgaggaagattataatgcgagattttaatggctaaaaaaccatcaaaaagggcgttataaaaaagtaaaagtgaaaattctcaaaaaacaacccataattttgctcaaacccaactaaaatttaattcttgatatcatttatagccaaaaaaagttcactattagcctgcgaaatttcaaaattggaaaagagcttctggactagtcagctgacggcaactcagccgaagacaactcagaatgatgacaattcggcttatggacaactcagccgtacaataaaaaattacaaaataaagcctaagcctaggccttgccaagccattgtacgagttgcgtttcaaaattctcgtaaagctgagctgtccatgagtcgaattgtcgcatcagctgagttatctgtcagctgaattgtcctaggctgagtttttatttacaagctagtagaaaactcttagggctattgaatgatatcaagaattaaaatgtttgtattgagctaatttattgtagtttttgttgaaaattttcatttgatggcttttataacggcccagtgccctaatgattgattatctattaactttgataatgataaaactcactcatttttagaaattggacgaaaaactagtttgttttaattaattatgaactaaatgaacatttgaaatatcttttaaggaaaaatgtttttataattttccgatatgcggagaaagtggatgcgttagtgacagaaaatactataccattaaaagcaaaggcggaaaagttgagattatatctcatgcaaaaccaccgcctgaatgcgcttttgatgcggtattacttttttatgcaataaaaatgatgctaaatcatttgaagcaagcgtcgatggttggggtgaaatactattatccatatgactacggagagggtgttcagggggtaatctaccagcatatagtagtattctagtattcaaata

SEQ ID NO: 68724 - DNA, 1067 bp, Heterodera glycines
  misc_feature (955)..(955): n is a, c, g, or t
  Genomic contig location: Contig_ID=SeqID_40363; Location=1..1067; Strand=-
  SCN-specific regions: Sequence locations=1-13,43-43,82-82,169-254,349- 349,445-445,489-528,656-789,824-971,993-1067
  Gene Ontology: Mol. function=ribonuclease activity; Cellular component=cell; Biological process=DNA replication
ccatccgattcagcaaattctcacatattctcttcgcattgttcatccccgcacaatcagtgcgcaaatgcaacggcgcgttaaacagtcactcaacgaaataagccatctttgtgcaatttcactcatcgagaaagcaattcagaatgggatttgcattagcgaggtcagaggaagcaaactgtcaatgaatgaatcatttggttatttgatatcttattgcattacttttaattgcgtttttatttttttgcaggttttcgtggatttagtaggcaacaaagaagaagtgtatcaaacctttctcaatgagcgttttcctacactcaaaatcaccgtttccaaaaaagctgatgcaatttttcgcattgttggcgctgcttccattgttgccaaagtgacgagggatgacaaattggccgaatgggtctttgacgaaattggctttattgcgcctgaacgaggattggggtcaggatatccgtcaggtgaatatttacttaataacgtgaaaatgactgccactttagacccaataactaaacacttcattcgcactatggtggatcccatctttggctatccgtcgttggtcaggttcagttggaaaactgtcgaaagggttctcgagaggaaagcaatcaaatacacatggcaagttgggtggagctaaatggccacaattatctgggagacggtcccctgatttgtcgcactgggcgacgacctttttgcatttcaacgcttttttaataccagatatcctttctttttccaaatggaaaattcgctaatttaatgcttattatttgtaataacacttattacttcgttattgttcttcgtctaaaattctttactcacccaaagcacccaaaattatgttgggttctctataccgaacaaatatttgttaaaagaggaaaatatagatattttgaatgtccaatgctanttaaattttactagtattaaaaataaaaggctttaatattgtctcgtccaagagtttatttccccgaatacacccgaaaatttttaaaggaaaaaaaaaattttgatggaaa

SEQ ID NO: 68725 - DNA, 491 bp, Heterodera glycines
  Genomic contig location: Contig_ID=SeqID_40364; Location=201..691; Strand=-
  SCN-specific regions: Sequence locations=1-209,246-297,319-491
atgccacctaaactgtgagtggttttatcatggctttggccaattcacggatcaaatagaaaaacactgatcaattggtcaaaagttagggctaataaaaaagtttcattaattctttttatccactcgttaaatcattcagacttagatttatttttcggcatcattaaagacaattttttttaatttaggcaaaaaatcgtttttaattaatgtatttttacaaaaaatgaagtcttttagaatatattttgaagtttttttagtgaaaatgaaaaatatggatgtaaaacatggtttaatgttggcaaatattttgcggcaatattgggatgatgaagtaatattttggaaaaattaataaattagtttccgatttctgtggaaattaatgatgttttacaaaaaagcaaccgaatctgtcttaaaaaacctttatacataaaaaggtgatagaatccaaattaataagcatttaattgtaaaataaa

SEQ ID NO: 68726 - DNA, 48 bp, Heterodera glycines
  Genomic contig location: Contig_ID=SeqID_40365; Location=337..384; Strand=+
  SCN-specific regions: Sequence locations=1-48
atgcatatattgggatattttattgccggaattcaatatattaaatat

SEQ ID NO: 68727 - DNA, 702 bp, Heterodera glycines
  Genomic contig location: Contig_ID=SeqID_40367; Location=651..1352; Strand=+
  SCN-specific regions: Sequence locations=1-181,258-330,467-477,582-702
atggggaacggaaacagtcaccaccaaaccgcaacacattatttggatccggcaataatccatgaacctccaccagctccgtacccggacatgaacatgatcttcaaatccattccaaaaatgatgcaggtacagaagggatccaaaaaacaacaattaatttaaatggattaaaaaataattaatttttaattattttttgaggcaattttcttttaaattttatttattttttttgcttttaatttaatttttatgaattaaaaaataagttaatagtaagtgttatttttggctatttgctttttacataaattttaatttttgctttttaatgaattttattgaattaaaaataattttaaatttactgattattttatacaatttgttttaaatttaaattattttccttttttatttctattttttttctgtgatatttatttaatctgaattaattcaaaggttctcatcattattatatttgttaaaattaattttagattgatttttttatattccattggttttgttatttttaaattaataatttttaaaattatttcaattaatttaaactcttcattaaatgtttcatttaaggtggccgatgacatgcacaggatgagcaattatgtaagcccttttccaaacatttatcaaaattaagccgaaaaattggaaaatgcaaaaattaaa

SEQ ID NO: 68728 - DNA, 924 bp, Heterodera glycines
  Genomic contig location: Contig_ID=SeqID_8631; Location=1462..2385; Strand=+
  SCN-specific regions: Sequence locations=1-599,622-897,919-924
atgtgctcacttttcttcgccgttttcaccgttttttctccgtttgtgcaacaaaattgtacattctcactgagaatgttcgtattttggagttccttctgctcagaatttggccaatgttcaaggacaccattcattggatgtgtttgaaccccatcgcttttcgtctaatccgtcaattggccccctcattgctcaacgattatccatcccttcgttttgtcaatttctttgacggcatttccctcgaatttccgcccgatgatagtgccaatgcgtcggatggccaagcggtggccaaatggctgttcacgcctcgtcccgacaatttgatgatgatctcattgtcagcattcaggattcagcgatggaacagcaatggttggcaaccatggaacatatcaaagcggtgattaattgatttttccaatttaattccttttttccttctttttcttgtctttttttaggctttttccgctgcttcttctcctggtgcatttcgcatttctgtttacttttcgctgccctcttcactttcttccgttgtgccatttgaattgaccaacgaattcaccggggaaaatttgaaattgtccaaagaagaggaagaagaagatataagtggcttttccctcattcgttgtccaattgggcccgatgataagagacagcagcaaatgaataaggaatttagtaaacgaaaccgaattgacatttttattggagacgacggagtcgacgatgggtaattaatacgattaacaattttaaaaatccaaatgcttatttttgtttttcttttcagtcttctcgacggttcgcccgggccgagtgatgatcactgatcagaacagcggaaatgaattgattgattggttattgatgcgattatgtgacccaatgttggcctttgctatttaa

SEQ ID NO: 68729 - DNA, 1174 bp, Heterodera glycines
  Genomic contig location: Contig_ID=SeqID_8632; Location=148..1321; Strand=+
  SCN-specific regions: Sequence locations=1-275,297-488,510-770,827 -934,956-1174
cttcatctctgctgattgttggcttgaggtgttcgttttgcttccacgctctcagcttggctttggaattgcgatgatttcccaccgatttgactattttgttgacgaacactttaaaacgcgcaaatggaaattgagaccaattgtaattcaacacaaaattggacagaatggcgcaaaggaaatggaaattgtcaattacgatggaaacgaattgccaatcccacaaattccattgccgaaaaaagtcatcggattcggaagcatttcgatcgggtaaaaatgaatttgtaaatgttttgtaccaatcactctttcttatgttttcagctccatcgaccaaaatgtgatcacttttcttggccattttgaccgctttttcgccacttgtgcaacaacattgtctatcgatactgaaaatattcgtattttggagttccttctgctcagcatttggccaatgttcaaggataccatttatcagctgagtttggacatcatcgcttttcgtcgaatgcgccaattggccccgtcaatgctcaacgactgtccatcacttcgctttttcaatttaagcaacggcatttccctcgaatttccgcccgacgacagtgccaatgcgacggatggccaaacggttgccaaatggctgttcacgcctcgtcacgacaatttgatgaacaatctcacaatctacattgagaactcagcgatggagcagcaatggtcggcaaccgtggaacaaatcaaagcggtgattatttgattattcactttttaaaatatttcttggtatttttagtcattttcctctgcttcttctcctgtttctttcggcatttctgttttaattccgccgtcctcttcaattgattccattgtgccatttgaattgaccaacgaattcaccggagaaaaattggcactgtccaaagaagatgaagaagcagatttaagtggtttttccctcattcgttgtccaattgtgtccgatgataagagacagcagcagatgattattgaattgggcgaccgatggaaccaaattaacatttttatcggagacgacggagtcggcgatgggtgattaacaattttaaaaatccaaatgcttatttttgtttttcttttcagtcttctcgacggttcgcccgggccgagtgatgatcactga

SEQ ID NO: 68730 - DNA, 389 bp, Heterodera glycines
  Genomic contig location: Contig_ID=SeqID_8632; Location=2373..2761; Strand=+
  SCN-specific regions: Sequence locations=1-83,105-304,327-389
atgtcgcataatccgaaagaagcggagagagaaatggaaaaagcgatgtaataatctaaatttgatttttattttcatggtaatcattttgcttttccgttttcagcttcatctctgctgattgttggcttgaggtgtttgttttgcttccacgctctcagcttggctttggaattgcgatgatcagtcaccgatttgactatttcgttgatgaacatttcaaagcgcgcaaatggacaatgggaccaattgtaattcaacgcaaaattggacagaatggagcaaaggaaatggaaattgtcaacaatttcaatggaaaagaattgccaatcccacaaattccattgccgaaaaaagtcatcggattcggaagcattacgatcgagtaa

SEQ ID NO: 68731 - DNA, 881 bp, Heterodera glycines
  Genomic contig location: Contig_ID=SeqID_40376; Location=50..930; Strand=+
  SCN-specific regions: Sequence locations=1-73,104-305,353-360,535 -570,745-748,786-881
  Gene Ontology: Mol. function=cytoskeletal protein binding; Cellular component=cell-cell adherens junction; Biological process =intercellular junction assembly and/or maintenance
atgaaggccttttttcataccatttttgaaggtgttctcgaaattgttgttttggtattttttaaattaaccctattttattttaagttttaaaaaataaaatccaaaatccagaccgtattttttcaaaaattttcattaaattatgtcttggggctgaatatctttgttactgtgaccatccctgaacaaagtgaaaaaaccaacaaatcatgttttcctcattgcacagtccaaatccgccatctatagctatgatcgagcttggtgcgaaagtctaggcaagaaaaaagaaaaagatcgacaagaagaagaagcagaagaacaaggggaagaagaagaagaagaagaacaccgaccagaacaagagcgacaagaacaagagcggccagaagaagagcgaccagaacaagagcgacaagaacaagagcggccagaagaagaacgaccagaacaagagcgacaagaacaagagcggccagaagaagagcgaccagaacaagagcgacaagaacaagagcggccagaagaagagcgaccagaacaagagcgaccagaaggagagcgaccagaacaagagcgacaagaacaagagcggccagaagaagagcgaccagaacaagagcgaccagaaggagagcgaccagaaggagaagatcgaccagaaggagagctaccagaaggagagcgacccgaaggagagcgacaagaaaaacagagacaagaggatggggaagaagaagacggggacgatgatgatgatgatgatgatgataatgaggatggcgccgtccagtgcaaagtgattttgcgaagaggaggcgaaggagacgatgatgacagtgctggagggaattcgggagggaatggtgcaaaggatg

SEQ ID NO: 68732 - DNA, 386 bp, Heterodera glycines
  Genomic contig location: Contig_ID=SeqID_40377; Location=107..492; Strand=-
  SCN-specific regions: Sequence locations=1-301,323-386
atgaagcgaaccaacgcatcaaacatcactccgcctcgcgcaaaacgttcaatggcacctgcactggacctggacccaaacactgttgcactcgcagagcaagaacgacaacgcactttggtgttcattggcctcccggaaagcaatgccattcgcccatcggaacgtgttcaggaagacagggaagccgccacaaaaatcctggaccatcttgaagttgaggcccaaccaaccgccgtctttcgactcggacggtacgacccgcaacgaacaacaccacgcccgctcaaggtggtcatgccaacaaccacacaccaacacatggcactcggaggatggaagcgcgagcgtgctcgactccgttctctacaaaacctgaaccgcct

SEQ ID NO: 68733 - DNA, 1781 bp, Heterodera glycines
  Genomic contig location: Contig_ID=SeqID_8634; Location=7..1787; Strand=-
  SCN-specific regions: Sequence locations=1-750,773-1367,1389-1781
atggacttatttgatgggcgcgacggtccaggacattttggccgaactgacaggtcagtctcgagagtagcactggttctaagttcaattcactttcaggacgcattgctgggaatgtttacggaaaaggtttttagccattttataggcggtaaaaattgacaaaaattcatttaggcggatccatgcatatgtacgccaagaacttcttcggtggaaacggaatcgtcggcgcacaagttccgattggggcgggcattgcttttgccatgaaatatcgcagccagaaaaacgtctgtttgacactttacggagatggggcggctaaccagggacagctgttcgaagcgacgaacatggccaaactgtggggattgccgtgcattttcgtttgcgagaataacggagtgagttgtcgtcgtcattttgggaatgtcttgcaaattcagttcggaatgggcactcccgtggaccgtgcctccgcctcgaccgattattacacgcgggggtaaagcggggaaatgggggaacggccaaatggattaatttccgtttttgtaaacgatgtttgcgtttctccaattcccagtgactatgtgcctggcatttgggtcgatgggatggatgttctgaccgtccgcgaggccactcgctgggccaaggagtactgtgacgcgggcaatggcccactgatgatggaattggccacttaccggtactacggccactccatgtcggaccccgggacgaggtgaatgaatgaaaagggaaatggcgtactgtgaatgtgtgtaactgtgtgttctgcagctaccgtactcgggatgagatacaggaagtgcggaagagcagggaccccatcaccagtttcaaagatcgcattgtcacggcgggacttgtcactgaggaggaattaaaggtggacgagctgtggccggggggggggggaggaaagcatttgcaagccaatgaatacacaaatcaatggtcattccatccccgcaggacattgacaagaaagtgcgtcaggaggtggacgaggcggtcaaagtcgcactttcagacgaaggcatggcgcttcattgtttccaccttattttgttgttttttcagttttacctccggaagcgctcttctccgatttgtatgccaacactccgccgcttgcggtgcgcgggacgactgccgacgcaaccgtcacacagccatttgtgagcacggcggaagtgttgagaaaaatggggagggagccgaagaattattgagagaacgaatagccaaagacgcattgatagttaggagaagcacagaataattaattgtttcattatatttattcgaagcaaactctcagaggaagaaagagattccttttcaaatggacagagtgttctttggttcaaggccaatgtttcttgtgtggtaaatggatttatgagccgaagattggagggggtggggggggggggggaattgcgcgaccgaatgagaatggcttcgcaattagctgggattgagtgcgttcaaaaaccattcgttcatcctccgcagattgtctgttttttattttgatcagccataactcgcttacccaaccaaaacgaacaaatttagtatctaaaaaaggattttgaaatggaaaatctttttctaagcgaatgctaatttgttagcaaacacatctcagaaaaaagttatgagtttcaaaattttatcaggttataactaaagtcataaactactgaggaaacgtccgaaaaaacgagatgtgtaccaataaa

SEQ ID NO: 68734 - DNA, 2634 bp, Heterodera glycines
  Genomic contig location: Contig_ID=SeqID_8635; Location=171..2804; Strand=-
  SCN-specific regions: Sequence locations=1-148,170-335,366-481,503 -876,898-1021,1044-1358,1387-1699,1723-1893,1916-2027,2056-2137,2160 -2247,2269-2634
  Gene Ontology: Mol. function=ubiquitin-like conjugating enzyme activity; Cellular component=cytoplasm; Biological process=protein ubiquitination
cgcttcagctcaacctccactccgttgtgcatgcgttggtcgtcaacagttccacgcgtcaccaaactttggattacttctttcacattttgacaaccaatcgcaaattgtcccaactccacgcggacttttctcaacttgcaaattgtacttccgtgctgaacgttttctccgtcatccttttgctatccgacaaaattgtcattgagaaagtgcaaagcgattaccttttccatccgaagtgtcgcattgacacaaccgacgaatcacgtattaatatggattcggaaaaattggaaagttatcgcaaagaattaggtaaatttattacagccaattttttacaaaaatttttttttttttttggtttagcggaattgacatatgtgccaaatttcaacaccgaatgtttctatttgggcattgaattcatgcggataaggtgagaaagcgatggattggctcttggtccttttcggcattttctcttgcttttctgtttagtgtaaatgccatgtcaaatgcattttcacgcctcaaacgcttttacctttcggaccttcggcggagagtgcaggaaatggaggaacgaatgaacgcattgggaaacagtgccaacccggcgcaagtcacacgcattaaaagcgcaatgagaagggccaaggaaatgctgaaggcaacgaacattgatgctgatttactgacatttgttgacaattgccccttttagcaattcaatctcagtgcctattgctacgaatgtttgttgcacgaccccaatttggtggaaatgtgtgtgcttttcaccaacaaactgctcagaatgcttctccacccgattatgcctgttttgtaaggatccttccttttttctgctttaatttggtatttttgtttcagtggtcaaaatgaattccaaccggactttgaccgcttcttcgctttccccgagacctatttggaagttgccgtcgagtttctcactttgctcgtcaggtatttgcttggattttgttttcgactttttacttttccatttagcaagtccaaaatgagtcggattttcttaaagaatttgtccgactttccgaagcaagttcttcatttgcttctcaacttggagagcataaagaaccctttcattggttcaaaggtaaaacccccgcttcccttttctgaacattttgctctgttcctctgattttttcaggtcgtcgatttgcttttcatgctgtgccctttggttaaccatgatgcatccgtcttttaccgtcaaattgtcagtgattctcttgctgttgaaggactgttcccatccctcgtcaaattttattcggccgttgaaacaactggtccgattttcttttttcttctcctttatgctcccaaaaccttaggttcacacactgaatttttcgacaagtttaatatcagaaggaacattcaagtcattttcaaatgcatgtggagtgatttgtcgcatcgcgacagaatggtccaatacgccgggtgttttttctgtttttttgtttatattttttatttttccattcagtgaattttctccgagttttgttcgtttcatcaacatggtgctcaacgacacaacttttcttctcgacgaatcgcttgacaaattgaaagtgatccacgacattgaatccgttatgagcaatgagaccgaatgggacaaactcagtcaggaggagcagcagctgaagacggaccaactcagagactcgaagggacaagtcaaaatgtggatccaactcggcactgacaccatggaactattcgttacgctgaccagcgacgcgccgcaaatatttcgcaacgaagcgcttggggaaagagttgcggcgatgctcaaccacaacctcgtccaggtgggctggagggggagggaagggaaaagccaaaaaaagaaagcccaaacaatgcacggcttttttagttgtgtggaccgaaatgtgcgcaactgaaagtgcacgacgcaataaatcgcttcgaatgggacccgcgcacattgacacagcaaattgtgaaggtctacatcaatttgggctcggaaatgttcgccaagcaaattgcgcaggatgaggtgacctatttcagacttttttatttgccgggacgcaatcccccaaaaaaggaaaagatgaatttttaaattgcaattagacattctctgatctccccaatttagcgttcgtacaccccggaagcattcagcacgataattgaaagatttaaaatgaggaacattcttacgatcaaccacttggaattgtttgcaaatttggcggaacaggcagaagcagcgtacaaagagaaaatgatgttcgaggaggaattcgaagacgaagtgcccgaagagttcaaaggtgtggcgcgagtgatattccccggaataattcgcctttttgagatgcgcttgtctacacgatgatgagcgacccggtcgaactgccctcgggacagatttgcgatcgcaaaaacattctgcgccatttgctcagcgacccgacaaatccattcacccgacaaccactcaccaccgacgaactgagaccgggtgggattcgtggggatgttaaaccaagggaacattccgagctgtaactaggaaaatgc

SEQ ID NO: 68735 - DNA, 53 bp, Heterodera glycines
  Genomic contig location: Contig_ID=SeqID_40382; Location=160..212; Strand=+
  SCN-specific regions: Sequence locations=1-53
gttccctgtctcttgtgaagatatcagattattatccaccatttttgttttga

SEQ ID NO: 68736 - DNA, 82 bp, Heterodera glycines
  misc_feature (57)..(57): n is a, c, g, or t
  Genomic contig location: Contig_ID=SeqID_40383; Location=68..149; Strand=-
  SCN-specific regions: Sequence locations=1-82
atgattgttgtggtcgaagtacaaattgaagaaactttttcattgcttcgaacccanttcgaaagccacgggaagtgtcgga

SEQ ID NO: 68737 - DNA, 387 bp, Heterodera glycines
  Genomic contig location: Contig_ID=SeqID_40385; Location=287..673; Strand=+
  SCN-specific regions: Sequence locations=1-187,220-387
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacg

SEQ ID NO: 68738 - DNA, 795 bp, Heterodera glycines
  Genomic contig location: Contig_ID=SeqID_40386; Location=224..1018; Strand=-
  SCN-specific regions: Sequence locations=1-249,271-461,484-518,540 -628,663-795
atgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccattttatagagcacaaaatttgctaccgaattgcctttggaatagtgggtctacgatttaggcccgctgagatacgtcgacttttatttcggtgcctataaaaagtactgtatttcttaagaaaatagtgcattttacactacgtcaaaattgaagtgcccatacctcagccgctataagtcatagagacatgcggttttttgaataatcagcggccaattttccaattttgcgaaggggtctccggccatgtaaattaatgtaaatcaatgacctttttttgctttcaacaccgctttttacgcggcacgttttttccaagacttttgggggacaaggagggccggcggtgccgataggcgccgccgggaaaaattttgtattttttaatgcgatttgttaacagaatttgtaaaaaaatgaccaattgattaagttttgggtttttaggatgcttaacatgaaagaaaaaagttgaaatattttttaaaattaaaattttaattaaaatgatggtaaagaaaatgtgaggaatattctatccaagtggggaattgaacccaggcaaaaaattatgaaaggtagaaagtttaaccactacaccacatgtgcatgtgtgtactcccatgactaaatgaaataaa

SEQ ID NO: 68739 - DNA, 66 bp, Heterodera glycines; identical to SEQ ID NO: 53774
  Genomic contig location: Contig_ID=SeqID_40386; Location=1103..1168; Strand=-
  SCN-specific regions: Sequence locations=1-66

SEQ ID NO: 68740 - DNA, 249 bp, Heterodera glycines
  Genomic contig location: Contig_ID=SeqID_40387; Location=244..492; Strand=-
  SCN-specific regions: Sequence locations=1-61,247-249
atggaagagacagaaagtggaagagaaagtggaaaaggaatagaaagtttaagagaaagtggaaaaggaatagaaagtttaagagaaagtgaaaaaggaatagaaagtttaagagaaagtggaaaaggaatagaaagtttaagagaaagtggaaaaggaacaggaagtggaagagaaaatggaagagacagaaagtggaagagaaaatggaagagacagaaagtggaagagaaagtggaaaaggaatag

SEQ ID NO: 68741 - DNA, 2268 bp, Heterodera glycines
  Genomic contig location: Contig_ID=SeqID_8637; Location=915..3182; Strand=-
  SCN-specific regions: Sequence locations=1-133,155-548,570-862,884 -1039,1063-1508,1530-1939,1961-1972,1994-2268
atgcaaagtttgggaaatcgccaattggtgagaattcggcggaaaaaacagccacagaccaacaatcaaaagacgaaacaacacaggcgaattccatgcccacgaagaatatcgaaacgatgcaaagagaggaggaacacattgtttggctttctccgttcattcaatcaaaagacaaatgcttttagaggggcgtaaatcgaattgaggaaaaaacactcggaaaggaagaaaatggggaaaaagagaaaatgaaactgaaaagcgaaagggacaaaatcgccgcgttggaaagagcgttggagaaaagcgtaaccgaatacacggccaagcggaacgagcagacggagcgaattgcgcagttgggccaattgcgacgcgaagcggagaaaagtgcgagtccattggacacgggtcagtcagtggccaagaaaacaccgagaaaagaaacgaccgttaaagggtttctcgttgaactgcacaacatcaagacggagttgctgcactccttcagacagagcctttcctctctggacagactttgtgtggaaacaaatgacaaaatggaatttctgaatggactcaaattggcggccctgagggaaggagagacatcggccgaactgaacaaaccgtcatttgacatggtaagagccaccattgtcaggcatagtgtggacgtgtaactgtttaaggaaagacggctccatctgattgagagggaatacgaaaatattatggaaaaaatgaaaaaagcgcgaaaaatgatggacagattcgaagggtgtcgcaaaaagcaaatcccgaggtgaatttattaatataaaccgcgccagcaaccaagggagaagggatgaattcccatcacatcccaaatgaaaaatagctaactttttataaatttaaagtttctccggcggcgcctaaaggcatcggacgactaaatccctcaaatttttcaaaaattttgacctgaaaatgcacaattggcaattttggcgaaaaatactaaacatgctattttgacacatagtgcttataagttcaaaaattatttaacaaaaagttaaaacttttttgggttcagaaaagcaaaaaaaaaaattatgcttaaggaggcttatataaactgaaaatatgaaaattcatagaacatcggaagacacaacaattgggccaattgaacaacgaaaaatcatccaaattaatgaaaacatcgcgaaaatgagtgccaaactgaattcacggcttcaccaaatacgtcgctcggtcgggcggaaattcgcctcgtcggcgactgatcccaaaaaattgactcaaatttccatccctttggccgatttttgtgcgttagaattggaacaattaaaactgccgatcgtgggaaatggtcgtccccatttggtcattcgcgagacgaaaagcaatttgcaacaattgcaaaacaacttgcgagactatctaatggtgagcatttgcaattaattagctatgctaatgacatttttaaagaaaagaccaaacgaggtggaagtgaagcggattttttctctcaaaatgccggacgaatcggaggctgtccaaacagtgccaatgcaatcggtcgctgatcaaagattggcccaacggatttccgaggcggcttctccgccgaagccccaattggtctccgttggcgtccaatcccccgattttgcagcccaaagtcgagaaaagacaccgaaaagtactcggggctggctttgtgttagtgtgactttgattgggttaaatcacttttcaaaaggagccccgttgaaaaagacatcgacgccgaaagctgcgaagaatggggggcaatcgctgcgaaatgccgtgccaatctcatcgacgcctttgtctttttcaactctgtctccaaagccaacagaagcggtttcaaaagagacaccaattgtggaaaaaccaatggaaaaagtgcccggcaaagtggcaatgcctttggccactccgcccaccgaaaaagcgataccatcgccaccagaaacagttgcgatactttcacaaagccaagccaccgaaaagggattgacggggggagaagagggcacggaaaagcaaagggaaagccaaccgacgggagaaagcgctgaaaaagcgaatgtggcggaggagggaatggacgacgaagcggctgatgcggcacgcgaggcggtgaccttcgattttatgaagtacgttctgccccaagaacggtccgtttcgaacatttccacaggtctggtttgg

SEQ ID NO: 68742 - DNA, 306 bp, Heterodera glycines
  Genomic contig location: Contig_ID=SeqID_8638; Location=1641..1946; Strand=-
  SCN-specific regions: Sequence locations=1-306
atgactcggcagcggtgccgcactgcgcttcctcctcttcagtctctgctcacaaccaacttccctccgcttctcaacatacctcggcttctctcagcttcgacccctcttcttctgctgatcaccaactttcatcagattcgtattcccaacggagtcccgcccaattgtggactcacagccaacagattagctcaaacacgccttacggcaacacgccttctacgccagcacaggccatttacagcggcaccagcccttccccaccgcaacgttttgaattcaacagccgcggaggggcgataa

SEQ ID NO: 68743 - DNA, 512 bp, Heterodera glycines
  Genomic contig location: Contig_ID=SeqID_40392; Location=111..622; Strand=-
  SCN-specific regions: Sequence locations=1-121,163-512
atggcgcacgatttagcggagatgacctttgaggtaagggaaatcattcgaagaatcagtaaatgtgcatttaataagaccattaattaatcaaatttttattagtgagttttccataaaatttgctgaagcttttcttttatattcaaatattatatttttatgcaaatttgtcactttttagtcagaagacattgagctgaagcgacagttggcactcgccactcgcgcctaccattgccacatgcaatcgctgaacacaaaccaagcactgcacacgctgcgcacgttcattggcgaccgcgtaaacaacgaatatttggttggtcgttggggcagcacacagaaatggcgttaattggcaatctctgtgcggagcaagcagctcgtttcctccgagaaaatgaaaaaaaacaaattttttttatactaatttagaaatttttcgtgaagaaatctgctagaaagttatttttataggaaaaattcgaacaatttttcagcttcgataa

SEQ ID NO: 68744 - DNA, 215 bp, Heterodera glycines
  Genomic contig location: Contig_ID=SeqID_40392; Location=227..441; Strand=+
  SCN-specific regions: Sequence locations=1-215
gaggaaacgagctgcttgctccgcacagagattgccaattaacgccatttctgtgtgctgccccaacgaccaaccaaatattcgttgtttacgcggtcgccaatgaacgtgcgcagcgtgtgcagtgcttggtttgtgttcagcgattgcatgtggcaatggtaggcgcgagtggcgagtgccaactgtcgcttcagctcaatgtcttctgacta

SEQ ID NO: 68745 - DNA, 823 bp, Heterodera glycines
  Genomic contig location: Contig_ID=SeqID_40393; Location=92..914; Strand=+
  SCN-specific regions: Sequence locations=1-367,389-780,802-823
atgttcatctctcccacgccggatttgggggcagagtccgcccccccccccgttctcctccgtcgcattcttccattcccaacaacgacaccattcacttcttctcatcgggccaaagggccgtcccactggatcaatggaaacgccactcaaagggggcggttgcgttcggtgattgtggtaccgaacgccgccggcaacgggcaaaagctcggggaaacgtcagccagaacggccgggccgccggccaactcaggggaacgttcccctcgtccatcaaccagcagttcttcggcccaaccgccgaagagcccggcaacaacagcaccagagctgcgagcgagaccgacggagcaattggcaaaagtggcggagctgcttgggcaggtcggcgaggaaatggccaaaatcctggaggccgaggagaagagcacggacgggaaggaagaccttctttccctcccttcggacggggaggaggtggtgccggaaacgccgccgccgcccgccgcaatgtcgcgaaaccgcgacgagagttggggtgaaggatcgggtcaattgtcctttacccggggctcgggcgggcactacaatgcccgtaaaatcgatgaggaggaggagaaccgatgggccaccccaggcgcatggtttactgcacccccacgagtctcgggcccgaagaagaagaagccgtggtaccattgatgatcgggaacattcccgttggtcggtcggtcggagcagaagatcggagagatcacgaaacccccgccaatctggcttttcccttccttttcgtccccttctttttttctccctatta

SEQ ID NO: 68746 - DNA, 1247 bp, Heterodera glycines
  Genomic contig location: Contig_ID=SeqID_40397; Location=305..1551; Strand=+
  SCN-specific regions: Sequence locations=1-486,508-1247
  Gene Ontology: Mol. function=ATP binding; Cellular component=snRNP U6; Biological process=signal transduction
atgattgccgaacccctcgagaagggattggcggaggatatcgaaggcgaaattgtgaagatcagttggaataggtcggtttacagaaatgtttgctttcatataagattgaatataataaacacattaaatgattagctagagttttaaaaagttagtcaccgcttgggaaaagttaaattcttgcgcaaattaacgtttattatttgctatgctaacactaaaaatgtttaatgagttatggccttattttatgcctccgctggggaaaaaatctttcatttcgttggatttcccttcagaaaacaacttggtgactttttccaaaccaaatacgaatgggatttgctcgctgcgcgttccatttgggcatttggtcccgagacaaatggtccgaacatttttctggacgacactcttccgtcagaggtggacaaagagttgctgaagacagttcgcgagtccgtcatccaaggctttcaatgggccaccagagaagggcccctctgtgaagaacgttcgtccttcgctaattttaaggctatcaaaacaaatttcgcttgcttcagcgattcgcaatgtcaagttcaaaatgttggatgctcagatagccaaggagccgctctacagaggcgggggacaaattatcccaacttcccgccgttgcgcatattccgcctttttggtgagttctttccccatgcaattttcgtttctgatttttctttcgatcagatggcaacgcctcgtctgatggagccgtattatttcgtggaagtgatcgcccccgccgattgtgtgacagccatttacactgtgctgtcaaaacgacgtggtcacgtcacgaccgatgcgccgatccccggctcaccgctgtacacaatcaaagcgttcattccggtgatcgattcgttcggtttcgagacggacttgcggacgcacacccaaggacaggcattttgcatgtgtgtgttcagccattggcaggtaattaattgccctggaattctctgatgacttgccatcattgcctttttcagattgtgcccggtgatccgctcgacaaaagcattgccattcgtccactcgaattgcaaccggccccccatttggcacgcgagtttatgatcaaaacaaggcgaagaaagggcctctccgaggacgtctctgtgaacaaattcttcgatgacccaatgttggtcgaactcgcgaagcagcaagacttattcagtgggttcggcgtatga

SEQ ID NO: 68747 - DNA, 143 bp, Heterodera glycines
  Genomic contig location: Contig_ID=SeqID_40399; Location=201..343; Strand=+
  SCN-specific regions: Sequence locations=1-143
gtacaggcctggatccaggcctcgaggctttttacaaaataccgacctctactaaactccccacctgaattaatggttggattgacacgcggacaggggcctttggtgtcacaatgtgaatccttacatggaaaataaatgaa

SEQ ID NO: 68748 - DNA, 198 bp, Heterodera glycines
  Genomic contig location: Contig_ID=SeqID_40399; Location=373..570; Strand=-
  SCN-specific regions: Sequence locations=1-198
cttttcattggttttgattacgaatgcccacggggacatcgttttatggttgtggagccgggaaaagtgctccgacatcggcgaatgtccgggacactaaaaaccgatgcggcaccgttgatggacaatgacttggcaatttggatgccatgtccgtgcaaaaaggaaccgagaatgaccgcacaattaatgcggtag

SEQ ID NO: 68749 - DNA, 415 bp, Heterodera glycines
  Genomic contig location: Contig_ID=SeqID_40402; Location=193..607; Strand=+
  SCN-specific regions: Sequence locations=1-215,237-415
atgtccatgtgcgcggacaacaaagatgtcgaaaaagaggaagaagagaaggccaagaaaaaggtggagaaagaggatggagaactgaaggaagagtcggaggatgacgatggagatgaaattcagctggttggggagacgaaatcgaccagcaccgaggccgtgaaaaaggcaaaaaagaattgacaagagtgctgagtaatgatgaacctatcttaaatgatattgatgttgcatttagcatagaaaaaaacaattgttaaagaaatgtttgcacttgtaacagcctacaaaaaaaaaggcatagagaaattgccaaattatttgaaacactctgaaaaaaatttttgtttttcaccttaaataacagcacaatgaaaaggcgctgggactttcgttcaatgagcttttttga

SEQ ID NO: 68750 - DNA, 243 bp, Heterodera glycines
  misc_feature (225)..(225): n is a, c, g, or t
  misc_feature (232)..(232): n is a, c, g, or t
  Genomic contig location: Contig_ID=SeqID_40411; Location=58..300; Strand=-
  SCN-specific regions: Sequence locations=1-57,79-243
atgtccgctgtcgggagagtcgctgactgtcccgtcctgctgcgaatgctccgcttgctggttaatctgatggtgaagcatggacgaaggctgaagacgaatgggcatgagaggctgctgctgagacatggacgggaacatgtgttgttggacgaattggaaagtggggacggaagagacggggaggaccaaaggctgattctaaaaggcgtcgaaagtcaatgnccgttcnctttcaaataa

SEQ ID NO: 68751 - DNA, 141 bp, Heterodera glycines
  Genomic contig location: Contig_ID=SeqID_40411; Location=160..300; Strand=+
  SCN-specific regions: Sequence locations=1-63,85-141
atgttcccgtccatgtctcagcagcagcctctcatgcccattcgtcttcagccttcgtccatgcttcaccatcagattaaccagcaagcggagcattcgcagcaggacgggacagtcagcgactctcccgacagcggacat

SEQ ID NO: 68752 - DNA, 989 bp, Heterodera glycines
  Genomic contig location: Contig_ID=SeqID_8642; Location=1467..2455; Strand=+
  SCN-specific regions: Sequence locations=1-65,88-207,233-747,769-989
atggagtccccgaaggggtcgttgcccgaaattgtgcaagcgtcctcctgctgccacttccagtcggcccccggcgggcggcccaatgttttcgctgcacaacaaacgatcggtgccggaggggacatttccgcagatcagcaccagcaactgatcactgctggaggcggtgcagctggggctgatcactcgctgttgtcctctttccaacaccagcagcaacagcagaccgcctcctcggcgggagtcggcccaccggacggagtcggctgttccggctttcacatgttgcctccgccctacggcaacagtccgtccgtgttgcgacccgtcaaatcgctttcaggttcgaattgcgccacccccccccccacccgacgattcacaagaatattttattgatccttttttttgaattgttagactaagtagcgctttgaaatgataaagttttggcaaggaatgaaaaagtcgaccaaaacggcacaattcgtcgaaacatgaaaaacaaaatttaattggttaatttatgccccacgagcaaatgttgaattgcgggccattatattgcaaacttctaaattccttattcttttacatcaaattgttcgtgtttttgtccagatttgagttcgttggctgctgccggtggtggccaaatgtgctcttcgcaaccgtttggccaaatttgtccctattcgccgccatgcgctggccataataatgcaactgctaacagtcaatatggcacgatgaacagcagcaacagacggctaaccgaaacgggcattttgtacgggggcggactcagcaaacagcagagggactcacaggtgatggacaagacaaatggaatgggacaaaagacacaaagggacaatcgaacggagggacaaatggtcgaaaaaattggaaaaacaaacgctgataatgagacaaaagaaatggaaaggaatcggaaattgaaattctcagggaattgcttttaa

SEQ ID NO: 68753 - DNA, 151 bp, Heterodera glycines; identical to SEQ ID NO: 40413
  Genomic contig location: Contig_ID=SeqID_40413; Location=1..151; Strand=+
  SCN-specific regions: Sequence locations=1-151

SEQ ID NO: 68754 - DNA, 480 bp, Heterodera glycines
  Genomic contig location: Contig_ID=SeqID_40416; Location=94..573; Strand=-
  SCN-specific regions: Sequence locations=1-165,193-197,219-334,358-480
atgggattgtgttttgaaaaaccgagattggaatggagccaaaaagccgagattccggaaacaattcgggattactctcttatggaaccccaaattttagagctgttaaacgctaatcatccgacatatcgtgtgaaaatttgtgaagtaaaagaattctcattgaaaattaataatatatattattaatttcagaagttttcaatccctcaacaattctgttgggatgccaattcgtgtcacagtgacctcaaaatcgttgacgacaaatgcttgacgatccattacattggaaatggaaaaggtaaactattcaagacatttttaattgcattaattatcaattaattaattaatgatgagttttattgtttgtttagcatattgctctgtgttcgctaactattcgatcccgaactgtgcttcgggcatcttttatttcgaaatagaaatcaccaacttgaaaaagtgaataataaa

SEQ ID NO: 68755 - DNA, 896 bp, Heterodera glycines
  misc_feature (33)..(33): n is a, c, g, or t
  Genomic contig location: Contig_ID=SeqID_40417; Location=290..1185; Strand=-
  SCN-specific regions: Sequence locations=1-294,316-401,432-896
atgcgtaagttgatcgccaagagggacgccgcncgggatgaggacgatgttggtcactcgcataaacaaagtctgcactctgagaaccaaacctcttggaacatatcgaatgactgtccagttgagaagcgatgcaaaagatttttggttaagcagaagaatttgattgaccattttagaccttatcatgaacaaagaataatgaaggtaactatgtgtctatgtaagcaagactatgtgaacttaagcctaagatttcacaaccaactaacgaaacagtgtaaatcaatcgaatgaagaaaatatttttatttggcattttgtacgtgttaaattactaaaagccatttcaaattgtttttttctttttaacctggcttttgaactaaaaaaattggattatattctaaacatttttaaaattttgtatttacaggtgaagatgaaaaaagcaccttctgtaaagaagcgcaaaagacagagaaatattagaaagtctgacaatcaaattataataaagaaaacttgcaaaagagaacgcttaaatttgagactaattgacacgcaccaaaactcaggatcttcaaggttgcctgaatgcaaacatggtagttttgctggttggtacatttgaagatgactataaattaagggccctgtcttttattttcaaatgaagacggtacaaaaaagtggtttgcttgttccgtttttcggtccaggaaacggtgtgcgttttccgtaactatccatcagaatggtgtccttcagccatataaagctgaggaagcaattgaatcattacccattgaagagtatggaaaagcgagaaaagggtacgccgccggattttgatttttgatttaccctcagcaaatatatccaaatttaataaa

SEQ ID NO: 68756 - DNA, 49 bp, Heterodera glycines; identical to SEQ ID NO: 60106
  Genomic contig location: Contig_ID=SeqID_40419; Location=528..576; Strand=+
  SCN-specific regions: Sequence locations=1-49

SEQ ID NO: 68757 - DNA, 312 bp, Heterodera glycines
  Genomic contig location: Contig_ID=SeqID_40420; Location=872..1183; Strand=+
  SCN-specific regions: Sequence locations=1-53,211-265,287-312
atgggaacagtgaagaaaaagctggaagaaaagttatttgatgaaatatttggagaaaaatgggaagaaaaagaagaagaaaagcgaaatgaactcaaaaaaagagaaataattgcaaaatattatagaataaaagaaaaaatcaagcaaaaaggaagaaaattctcaaaaaaagaatggaataaaattgaagaaaaaataacgaaaaaattggggacaaatcgaatgaaaatttataaatggatcaaggaattggggcttaatcaaaaatttaatctgtcaaaattaaaaacggatgaacaaaaattttga

SEQ ID NO: 68758 - DNA, 1401 bp, Heterodera glycines
  misc_feature (1376)..(1376): n is a, c, g, or t
  Genomic contig location: Contig_ID=SeqID_40421; Location=1..1401; Strand=-
  SCN-specific regions: Sequence locations=1-596,618-1401
  Gene Ontology: Mol. function=ubiquitin activating enzyme activity; Cellular component=cytoplasm; Biological process=reproduction
tttttttttctttgattagcgcatgaaaaagaatgggaaataaattcagaaattcttgccaaaatgagggcccgtgatgcgacaaaagcgaagaaaggcgacgaaaatgaactggacgaccaaaacgacgaaggtgctgaagaagtggaggcaaaaacattgccaatggctgaagaagcgggcgaaacgatagaagagaatgagtcggaagagagttcggaggaatgatgcgacttttcgtttttccttaccattttatattgcataaagcgtttaacaattaatttgaagctactgttttgcagccttttactgttcgagttaaatacagattgcttacatatttgggatacaagttttaaatatagattctttggcgttatgattggtttttctgagaatgtgaatgaaattacctagccaaaatttttcgttgactgattttgtaataaaaagaacacaatcaagtggtttttgctcacattccaattctttcttttagtttgccccgttgaatttttattcgcatttattggcagtggtcaattgccttacaattagagtcgaatattagccgtttgattgaataacattcggagttattttgatgatttttgacccaataattgctcggatgcaattggccactgaaaattagattcgttttttccatttccagtggtttatgcagtcatctgaccttattattgaggaaccagcaacgaaaaaggcaaaaatcatctgtgaactgccgaactccgaggcatcagaaaacgtcactttttgttctattggttgctcattttcttgctgactcttttccgtttaggcaccaaagagtaacggagaacaaatggcggccatcgacaccaatttgtactctcggcagatgtaagccgcgacaaatgcctttgatataattgcttattgtggtttttcctgtttagttatgcgcttggacattccgccatggaacacttgcgcaaggcgtcggttctcgtcagtggcctcggctccgtgggcgtggaggtggcgaagaatctgatccttggtgccgccattctttgattttactttgcatgactaaacaatcgccgcttttcaggcggtgttcgctcggtgactcttcacgacacaaaagcgttggcgttcagagatttgtcggcgcatttctacgccaaggaaagcgacgtgggaacgaaccgtgccaaagtttgcttcgacaaattggcggagctcaacgacactgtgaactgtgcattgtctgtggaaaatctgtcggaggatttcgtcaaacaattcgacgtcagcaaacgcttacttccttttcccgtctcgcctaattccgtcgttctttcagtagggcgttctcaccngatgcgtccttttccactcagacgg

SEQ ID NO: 68759 - DNA, 382 bp, Heterodera glycines
  Genomic contig location: Contig_ID=SeqID_1149; Location=147..528; Strand=+
  SCN-specific regions: Sequence locations=1-38,60-302,355-382
atggccgctttgaacgaaatgctagctaggaatgtgccggcgaagaatggtgatccggcattcttcgagatttgccagcaaatctgggcaattctcggccaattcttgggtaagtttgtcttatttggtatggggaaggcggaagatggggaaagaaaaacggccaaatgcaaaaatgaatgattgtaaggatggaaaagggaaaaaatgggaaagaaaaattgcgagatgactatcagtggatcggtgtaatggccgagaaagccattaggggaggggcataaatgtatgcaattaatgtgtttttatttaaaatgattaaaaatgattttaaatatatatatttatttatttgaggaaaagtttcgaaattataatcaaa

SEQ ID NO: 68760 - DNA, 4548 bp, Heterodera glycines
  Genomic contig location: Contig_ID=SeqID_1149; Location=4112..8659; Strand=-
  SCN-specific regions: Sequence locations=1-434,456-591,613-1488,1510 -1675,1705-1770,1792-3832,3854-3965,3987-4278,4300-4548
atggaaaaggccaacaatgacctcgtctctttccaagacggagtgaaccgctcacttaggcacattaatagacttgtcaaagcaaattatgatgccatcaatcgcgccgctgctgaagtgaacacaaatctacagacatgtgaggcccaaattatatcactctcagatagaatggaccttttcaaattggaacacaaagatggaacagactctcaaggggggaattctgtgaattttacaggaggaaatggccaacaaaatacctcattaattcgagtagatccattcgtggaacagaatcctgacaataacaatgaagtgaatacattaaccggagtaacgggtctagaaattttctctcaagaatcagtaacggcatttgacaaatggtcgagacgatttagggattacattcaagtagtaggcaaaaatttggatgaagctgaaaaattggaccgccttcgcctcgccttagacgacgtaccacgcgacttgtacgacacactcaccccggcagaaacaacgacagtattgcgagctctcaaatttttaagagaaaaactcgactcaccacaacgcaaagaattggccaaaagaaatttggcactgtgcaaacaacgggatgatgaaccggtgggaatatttttaaggcgtttggccccattagtggaagttgcttattcaaacctggacccggatcagcttaaagagcgcttgagtgaggaattaattgaccgtttgagacctgacttagcatttttaattagactcacagggctctcaaaaggaaaagagttagacatagtcaaagcccaagctgaagagcttgaactgcttcttaaaactcataaaggacaaattcccgacccaattctccaaacagttcatgccgtccaacaaaatccatggacgccaagccgtgaacgggaccgacgacagaactacaattcaaatgaagcgggaccatcaaattcataccgcaatttttcaaacagcccaaatcgtggaagatatggacaaggacgtggtggcggcactttcaaccaaagacaaagaggccgaggaaattggcgaggaccaaacaacatggccgaccgcagctggaatcaacgaccgtactgtactttttgtaagaggacaggtcatatggcatacaattgctttcagaggaaaaaccaattttctcaaagacaattcaccccaaattcaggaccaaacctaaatgccattcacgactctcccgaatttcaccaggatgcaaatcgtcaatcatcaaatgtcacattggacatcaatgaattgcttagagcattcagtgttatgaacactcaaggcccgtcttcaagaggtggaaatgaatctgcatcaatgaatgccattagcacaatgcctgcagatcacccaagagttgctgaagttgcttaccaaggaacaggtaaaactcaggttaatccatgtgaaccaagtgaccagcagaaaatctcacagtgggaagggattggaccaaaattgtccaagtatttcatggttcttacagcattcatgttactcattaccggtctcattaacaccactaccgctaatactattcccaaacaccccatggtatgccaaatgataaaagatggagtactttggcaaattcctaatttgtcaagctgcccaaagttctcattggattatttggaaaatcccaaaattaagtcacttcgattgtacactccaaatgttttcgaacatcaaaccccggcttggtcatgcagaaaaataagaaaatcaatcaagaaatatacaagtcttacaaatgttcccatttcagagatgcttgaaccaattccgctcgaaattagttcagatgaatgctggcaaatgattcgccaccgtaagtgtaaattgggggtactgattgaagactcgggcttatggcatactgatttgaaaattgacaactcacctcgccattggttaattggctcatggaaatgggaaacagtttttattgataattgttatttaatcccaacaaatatcacatcccattttggaggaaatacagtatccattcaaaattttgaagagctaaattgtccatacgaaaaaggcacttgtttaactcaggacaattcattaattgtttggaccccagaaaacgaaacaaactgtgaattccaaagcattggaaattggaaaggcgaaatgatgggtcagcattggatttcgtccaatgagcccctaatgttggaattttctcataatgccaaaacaattttagactgcgacaggaatctcacaatttcacaacaaggttttgcagcagacacagtaagtcttaggggaaggaagagaacccgagttacacgcaccacggatgggttaataacctcctcccaattagcctcagaattatccttccttaactggaacatttcaaataccatgtcattttcatttcaacataccactcactcaatttgtgaatacatggaacaaacaaggcgatgggttatttccgcctcgatttctgaaccaattacttttgcccgtataactttcaagaacccaaatttggttgctaaaaatttggccccgggaattattaaaatttggccatgtgtgccattggagccgaatcagtactcattttatcctctcgaggaatcaaatcctgtgacaaatgaatgttttgaatttcttccaatcaaaatcgagatgagaggaatccaccaaatggcgtttgtcgatccaacaacaatgatcataaatccatcatcgaaaaaggcaccgtgctcaagcaatcagaaacaaatgattgtaattgataatgaaattttggaagttgatcaaaaatcagcttcagtttccagaattaaaattaaagaaattggaaatttgagtttcaatcaattgaccaccccaattctccagccattttcatttcaccaattggtcctaacaaatgtaactgatattcttacccattcttatacaagtaacatgatcaaagagtcacaaattgcttttcgaattcattttcagaataaaggaacttcaattgtgcccgacgaacaatggactaaaacaggcaaggaattcaaacattttcttattggtgactgggatgggattttctggaaaattttaacaattttagtttttatcaacacagctgatttaatccttcgtttttattttattttgagaaaccagtacataaatttgggacgtagtaacacagagaagcggaacaataacacacacattgatgataggcctgggtcatcccaatcattcgaacgatccggttttgtaaatgagagaccagaatacaccccgatcaggccgttatcagaaattgagaaagcacccctaaggaacaaaacccgaagagtttcatttaaattaagaagaaaaaccgaaacggcaacaaatcgaacaatcattggtaatgtaaatgctttaactcagataggagctaattctgaattgctgtcaatgatgtcattatctaacactgctgtaatttcaaccataattaattcacaaattgtcagatgtcttgtggacaccggttcaagtgtcacggtggcgtcaagggcactgattgacatcttgggctgcaaaacggtaccatcacatgaggacgcaatcagcgcaagtggtcacataatttcatttcgtgaaaaagcaaaggtaatgctaaaagtggcagacatttgtgtcccaattactatttattttgtaaatgaacaaaaatccgtctgcaaccgagattatcaattaattctcggatgtgactcactccgacattttggcccttttaccgtaaatatagacaaaaacaaaattcaaattggaacacaatggataagcttaggctccaaaaattatgaattaatgaacaatattcgagcctttgctgccgaaaattacacaattccaccttcaagccaagtaatgatcagagcaaacattaaaactgccttacagccaaaacacagcttagttgtggataagcccgatttaaatttgctaaacaatgaccttgggattgtaccaagtgtgtcggctccatttgtggaggatatcccgttgacaataattaatccatcaaatgatcctaagattttattcaaaggcatgcatttagcctatttaaacgaaatagtcgaaaatgatggaattttctacgaatcagaccaggagaaaattaaaagcgggaatcctgacccaaatggattaactgatccatcattcaaaattgacctctcaaaatctgacattaatgaaagagaaagagaagcacttaaaaatcttttagaagaatttaaggacatattttcaaaaagtcaatatgatttaggctcattttcaggtggcgaacatcattttgacacgacaaccgaagctccaatttcttcgccgccaagacgaatgccatataaatacagagatgaattaaagaagcatattgaacaattgcttaataaaggagtaatggttgaatctgagacatacagaaaaaggatggtggaattagaccatgtttag

SEQ ID NO: 68761 - DNA, 623 bp, Heterodera glycines
  Genomic contig location: Contig_ID=SeqID_8643; Location=223..845; Strand=+
  SCN-specific regions: Sequence locations=1-623
  Gene Ontology: Mol. function=long-chain-fatty-acid-CoA-ligase activity; Cellular component=lipid particle; Biological process =gametogenesis
ctggttatttgccttcaaactcgcctcctcagggcgaagttctgattcacggggccaatgtcgcgttgggttacttcaaaaatgaggaaaagaccaaagaggacttcgtcgagttggacggaaagcgttggttcgccaccggggatattggagaattccgtaagcgatcgactccaccaaaagcattgacataatgatattattcatttttaggcgaggatggcagtctctgcattattggttttagtgaataatattgtcgatttaccttccattttaagaccggaagaaagatctgatcaaattggcccacggcgagtacatcgctttggggaaggtggagacggcgctgctgaccaatccgaacgtggacaacatttgcgtttatggcgaatcgcacaaggactatctgattgcacttgtggttccaaatctcaaaaacctgcaagtccttgctgaaaaggtaccgtttgaaatcagaagcagtttccgcttctttacaatgataccccagcgcttctcccctcttcagaatgacgtcaatgagccgagtattgagagaatttgtgccaacaaagaaatgcccaagattctgcagaaggaactccacagctttgtttcgg

SEQ ID NO: 68762 - DNA, 397 bp, Heterodera glycines
  misc_feature (384)..(385): n is a, c, g, or t
  Genomic contig location: Contig_ID=SeqID_8644; Location=1..397; Strand=-
  SCN-specific regions: Sequence locations=1-109,131-397
tgagtaaacaatgtttttatccaattaacataggttcatataagcacattaagtaaattggtatcacacatttcaattagagaattaacaatttgaataattggtggcgtaaagaaacttaattatgggatacaatccttttcaaaatctaaggcaacaaaaattgtcggaggtgataaaatttatcgactggtcatcaataccattttaataattgatatcatatgtcttgaggagcaattaagtcaattcagttctcttcataaagctgcctgatttcctcctcgaacttcttctcgatgttcttgcgcttcagtttcaatgcttcggtcagcattcccgaatcggcagtccacggctccgcacaaatgatgacttttctgnngatttcctccct

SEQ ID NO: 68763 - DNA, 2366 bp, Heterodera glycines
  Genomic contig location: Contig_ID=SeqID_8645; Location=49..2414; Strand=-
  SCN-specific regions: Sequence locations=1-590,612-759,781-1188,1211 -1748,1771-2366
  Gene Ontology: Mol. function=myosin II binding; Cellular component =synaptic vesicle; Biological process=synaptic vesicle priming
atgccttttcctcccttagctgacgacccatggcttccctcagaaggcttcttcgatgtccgtggacgagcaattgggatatatcgcaattgggacgaaagacggcagacttttgatgtaagtttttccttaactgagaaggcattggggtgacttaaatgatgggttcggttttttgtatggaatttcacgggatgaaaaaatttcccaaacatataaattctggtccatcattttgtattttaaactcccgaaattttctaacttcctactactaaaaatgtttacttatatttaagctggactagtttttcttcgttttggtttcagattttgttcaaacggcgcccaacatttgtccgccaattttggcagcaaattgccgatctgtgcgctttactttgtcgcaggtgcgaacactttgctgattcagtgcaatgactcctccacaaatgctcagcattttgtacggtgtcaaatcacttctgatcagctcactgtcacccatttgaacaatgaaaggcatttgaagcggatcacttgctgtgagatggttggcctcgccgatgggcagtccgcccttctgattggtattccatggatatttaaatatttgaaaaggaaaagtgttttgaattaaggcacaataatcggcaacatttatgcacttttggtgcgcaacatggaacttactgaacacgttgtttttctcgacaccgctctcaaagagtaattaacacttaattagcatttactgcctattaattatataatttatttgcccttggatgttccaatttaagcatttccgagttcgattctcagcaaaagcaagtgaacggagtgaatgttcactcggaagaccaatcgaagctttacattctcttcaacaattcatttgttgttttttacgacattacttccgacgaggttttgcagacgttcaaatcggagacgccaattacggtaacaaacggcaatgagcagttaagcctttaactttgttaagtttatgtcgacgatttcctcactcacaaaattgctctgttctcatgccgatggcgcttattcatttctcggtgtttcagagaaagggtttgaaattgagcgcaaaaggccattcggaacgaaaaaatgcacaaaaattaccaaaataatttcttcgaaatcaccaaagtctgctctctcttttgcattttcaaaatgtcaattttcagttcctgcgatgaatttgtcattttcgccggcggtgttcccctcgatgagctcgacaatcgctttacgctgtccgttttctgtgccgacaaatctctcattttggattttgacagtgccattttggatttttgcgttttttgcgccaatgatagtaattttttccccatttttttcccctttccctcccaacatgttgcagattcttcccacattttgttcgtcctttgtgaggatgaaattgttgcgattgatttgcttgatcccatttggcgaatgcttccccttccttttctccatccaattcactcttcccctgtgacttgtgttaccacagtcaattctttgtccgaaaaggcccaaactttgcttggtcgattagcgaatttgcagcgaaatgcttcgaatattttctcgaggagtaatttgacactaaaaaacggacaaattgcacaacggagacgaatcaacaacaccaacgcggcaaatgacctgcaattggttgtcactgggtctgtttttgcaattgcttttctctttttaatacctcattttccattttattattaggcatgaaaatggtgtcatcaatgtttggttggcttctgaattttcattcaagccctggatttctctaaacactgcgcgcgattttgagggctttatcgatgacagtgccccaaatttactgcaaaattccaacgaagaattaacaagaaaggaaccggcagacgcaaattccgatgaaaataatgccaatttttgtttgccacccgtcagaaaggtcggccgagttatttctgctaatagaaatcacagattcatttgcatttaggctggcttattcgacccctattctgatgaccatcggttggccgtgcaaaaagtattcgtcgactcccaaagtggcgaaattgccgtcgggggaacagcaggacaattgttggtttacgaagggctgccgaattcaaaggtaattgttttgagagacaagcagaaaaccatgaatttcagaaggatatgccaaggaatgaagtgctgttgctggacatgacgtcatcggaggatgccgcccatctccgacttaccggccgtcttccctccgagtcgccaatccaagcgaggaatgtgccggccaattaccccccggg

SEQ ID NO: 68764 - DNA, 889 bp, Heterodera glycines
  misc_feature (84)..(84): n is a, c, g, or t
  misc_feature (89)..(89): n is a, c, g, or t
  misc_feature (102)..(102): n is a, c, g, or t
  Genomic contig location: Contig_ID=SeqID_40422; Location=124..1012; Strand=-
  SCN-specific regions: Sequence locations=1-889
  Gene Ontology: Mol. function=signal transducer activity; Cellular component=nucleus; Biological process=MAPKKK cascade
ttttgtgataaatatttttgcttgattttgctcatttcaacgccccttttcagattgtgcggttacccaccctttttctccacncatgnccttccaatttcncccgggcatgaaaaggtgggttttcacaagagaaagcaatctttagaatgaatgaatgatgctttcgttttgcttagccgaatccgagctggccaatacaatttttcgggccccgaatgggaccgcgtgtcagaagcaggttccttccgccaatcccttgcctttttgccattttttgttttattctcagcgaaggacttgatcagacgttgtttggtcaccgacccggacgaaagggcgacgatcactcaactaatgcagcacaaatggatcactcactaccaacaaaaatccggcgactgcgttggccacccaaaaagtgttaaatgaaagagaggtcgactggtccgacttttcggtgtttttttttctttttccgcaaacaattgctgacaaaagcacgtcgaatggatcaacttgagaatgtgaattgtgtgaattagcgcgcctgtttgttgatttttttaaattttggcgacccgaaagcaggaaaatgtcgattttgccgacttcccccggtgcaaattttggagaaatttaaaatctaatcttttgcctcatcgaagaaactaacaaaaattaccagcaatataaattcataaaaataggaagagatggaaaatgcattagcgacgatgcgagtgggcgacgtgcacatcaaacaaatgggagacgcgcgaaacgcacttttggagaagcggagaaaacggacaacggaggaggaagagcaaaaagagacactgccggaggggacaacgacggaagagggggactgaaaatgacgaaa

SEQ ID NO: 68765 - DNA, 299 bp, Heterodera glycines
  Genomic contig location: Contig_ID=SeqID_40424; Location=134..432; Strand=-
  SCN-specific regions: Sequence locations=1-144,184-299
atgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcagttcttatagcaaatattaatttatatttgcgtagcttcaaatgagcattctgccttcaatttcgaagggaagtgaatttttttataataaa

SEQ ID NO: 68766 - DNA, 274 bp, Heterodera glycines
  Genomic contig location: Contig_ID=SeqID_40424; Location=749..1022; Strand=-
  SCN-specific regions: Sequence locations=1-132,167-274
atgaccaatttgccttcaatttcgaagggaagttagtttttttataataaatagatagagagcaaaaaccccaattgtataatattcacaaaatttatctatgcatttgttgaatgttcctagacccgatcaaattttttaatcctttatatgaaaacatttattgcaggaaatgacaaattccaacctgggtgagcacacatttcagataagcttcctatcattatttcttagaaacaactaataatctgttgaacagttatttcaaaataaa

SEQ ID NO: 68767 - DNA, 926 bp, Heterodera glycines
  Genomic contig location: Contig_ID=SeqID_40425; Location=86..1011; Strand=-
  SCN-specific regions: Sequence locations=1-278,312-412,434-512,534 -629,667-683,720-926
atggaaaccctgttggataaaaatacctttgctgtaaccgcgggattcaaatttttcttaccttttccgaatgtaaattgtcatactttctcccaatcaattcactatattaatctctctgctgtccattcatttaatcccgtgccattcatcattgtgttcttttatctcaaatattaccatgccatttcaatctcattcgcctctttttctaaaagcactttcattcctccaacaaaatccccttttgcgtcattactctctccttggaggaaggcaaatcaacacttttttaaaattagttttttgaggagaattgccattactttcgtacccaaaatctcaatatatatcccactcaatttgggtcattctgctcatttgtaagtgccactgttttatgcccttgcaattcccttcccaataataatttcactgacccatccaaaatgctctgagattgtttgttataatattgatccaatcattcccacggtttatgctgcgttttattttttccattcgttttcttataataagtccttctcctagaaaggggtaattccaaataatctaaagccttaaatccggaggtttgatgggtcggcaacaataaaatctatttgcacaaataattttaataaacaattattatgtaatatttttgttttgctttattctataaaaagtcaatttttaaacaaaaatacatgtttatttttgcttaattatatttaattttctagtctttaaagaataaattctcctcctctattataagaattactattgctatggacacatttgaagaatttgttattgtcaacgaaaaatcattcaccgatattttactcacatttggttataatcgaggcggtaacagtgagatcaaattcagtgatgtcactcaattcgctgcactgtaa

SEQ ID NO: 68768 - DNA, 768 bp, Heterodera glycines
  Genomic contig location: Contig_ID=SeqID_40426; Location=65..832; Strand=-
  SCN-specific regions: Sequence locations=1-1,23-31,54-258,280-295,317- 653,682-690,712-768
caaaagttttttacaaccacttattgccaatctattttcttgcagatttaaagctatccattgcctgccggttctcggcacagcaaagcactaatacggtgtttgactcaattcaaaaaataattcattacccaaaagtttttttacaaccacttattgccaatataatttcttgcagatttaaagctatccattgcctgccggtctcggcacagcaaagcactaatacggtgtttgactcacttcaaaaaataattcattacccaaaagttttttacaaccacatattgccaatctaatttcttgcagattgaaagccatccattgcctgccggttctcggcacagcaaagcactaatagggtgtttgattcacttcaaaaaataatttcttacacaaagttttttacaaccacttattgccaatttaatttcttgcagatttaaagccatccattgcctgccggttctcggcacagcaaagcactaatacggtgtttgactcaattcaaaaaataattcattacccaaaagtttttttacaaccacttattgccaatataatttcttgcagatttaaagctatccattgcctgccggtctcggcacagcaaagcactaatagggtgtttgactcacttcaaaaaataattcattacccaaaagttttttacaaccacttattgccaatctaatttcttgcagattgaaagccatccattgcctgccggttctcggcacagcaaagcactaatagggtgtttgattc

SEQ ID NO: 68769 - DNA, 671 bp, Heterodera glycines
  Genomic contig location: Contig_ID=SeqID_40428; Location=75..745; Strand=+
  SCN-specific regions: Sequence locations=1-36,58-304,326-484,506-671
atgtcaaccgaccacaaagagagagcaacacaagccaaaaaagttggaattaaaaccaccaaaaatagagcaaaatttgaacccgattcacgaccatcgacatcaaaagtcgcgcctcggtcgaaaaaagagcctgagttccagcttgacccacggccatccacatccaggcaagccggatacattcctcctccggcacccaaaattgtaccaaaacatgagccgacaaagagacccgtgccataccgtatcccgaaaagagaacccaaaattgttgaagaaacgccacagaggcaacagcaacctcctgctgctgctgtcgtcgaagaaatgtttcttgttcctccgcctaggagggggaccaaacgccgctaccctgtaatcggtgagaatgatgctgaggtgcgcataagaaaacgcgtgaggcaagcgaggagggtgcgagtacagtactcacccgagccgggtccatcaacatctgcacaaagtgatgaacaacaacatcgagaactgtttgccatcccgtcaaatcagctgaccatgaatcagcgggttgaacgactgtacatcaaatgcaaccgttatgcggatcgtatgggtgtccgtggcaatacaattaacaccgcaaacggcaagccgttggcgcatagcaatttgcgaatggccatcag

SEQ ID NO: 68770 - DNA, 617 bp, Heterodera glycines
  Genomic contig location: Contig_ID=SeqID_40429; Location=459..1075; Strand=+
  SCN-specific regions: Sequence locations=1-77,99-195,220-296,324 -439,461-617
atgccaaatttgaactgcgtggagttcgacgacacttgcgcatggcacaattgccaaacgcccgctgaccagctgatgtggtttcgcacttcggcaaacataagcagtgatcagatgatgaccacgacgggcactggagtgatgccaagttgggatttcgctatctcaaaaatcagattttttttcatttttttattggtgtccaaagaaaacaaaaagtttcgacgaattttccatgaaaatatattaaaccttctttttaaacgaccatttgctatgaaaatcacggaaaaagcattaatttaaataaaaaatttttttttcatgttttggtaaaacccttaaaaatgtttgaaggtccaaggtttttcataaaaaggacggataatttacgatgatccaacaataagcggacggggaataatgccaaatgcaagtcaagaatcactttttaaaattcgaatctccaatatttttaatagacggaagttatgccatcgcgtcaagcaacagtgttaatcagtcacttcacgcttgtctaattagtgatgttgtgccttcactaccaagcaatggttccttaatgttcaggtaaaaattggaaataacggaatcaa

SEQ ID NO: 68771 - DNA, 1695 bp, Heterodera glycines
  Genomic contig location: Contig_ID=SeqID_8647; Location=283..1977; Strand=+
  SCN-specific regions: Sequence locations=1-5,27-38,61-442,484-646,674- 1079,1102-1174,1219-1574,1691-1695
atggacattttcctggccccaaaactgccggtcggcggcatggagaactggggcctggtggtgctccacgcggacgctgtccgcatttcaaccagcgacggaccgttgccgctcggcaccgacgactcgtcgtcctcgtcacgtgccgcgtcacgcgaggagcgggcacgcgagcaaaagcagcacagtttgatgctggtcgaccgccgctcggaacagtaccgggccgagaaggccatcacacacgaattggtccaccagtggtccgtttttacgttggaccttgttttttgatgcttggagttggaaatttctttaaaaacctaattgatttctggttcatacaataattgtagaaatagggattttgcttgttgactaaaatttcctgaaatccaattttgggctcaaaacccaccgtaaaacgaaaatcgccaacatcttttattctaaaaaaaattaaaaaaaaaaaaattaaaatatggaaaattttgtggttcaggttcggcaatttggtcggcatttgggaatgggaagagctgtggattgccgaaggctttgccacttattttgtgttcgactttctcaacgcggccaaccatcctcatctgacgggtgagggagcttgcaataaatgctatgaatctcatggaaaatggcattttttggaaaacttagcgtcgaggctaaagcgagagataccaaagagtgttaagatgccacaatttggcaaaatgacttcccagcattggatataccataaccgattagttgagtaaattttggatatattttcgaaatcgaaatttgaatttaatgaattttttaattaggcaaacaaaatcaattaggaattaatttgtttattccgcaatttattttcgtagagcacgagtattacctacgactaattgagctgatccaacgtcagtccactgacggacgttcggcattggtacgaccacttcggacagccggccaactctaccgactgtttgacggcattcatttgtacacaaaaggtattaaaactaattaccaaaacaactaatgactaattaaggcgataattgcctaaattaaaatagaattttaaatttggatcttgatcaaaatttttgagaaaagctgaatcattttgatttgtaatttttgttttttcaattcttttaggaaaaaaaaaatttaatttttcagtattttttaaattaattttttcatactattatcattaacctaaacccaggtgccgtgatggtcaaaatgctgaaggacttggttgggcctgccgagttccgtgccggcatcacgcgcttcttgcgcgagaactccttcaagtcggtggaccgtcgcgcaatttgggccgcgtttcccaccgtcgctgaccacggcgttgatccggtacggctgaaggacgccatggagccgtggcttgtcaaccgcggcgtgcccgaggtggaagtacagcgaaactatgaggaccaatctgtgcggttgaagcaacggccggccgatcagaacagacacattgtgtacctggacgacgaagcaatgcagcagatgaggatgaactggaaggatgaggaggatgaggaaggaggaagagagaaaaagggggtcggaagaggcgcaggggatgaggaacatgatgaggaagacgtaggagaagattggtggaagatgaaaaggatggat

SEQ ID NO: 68772 - DNA, 257 bp, Heterodera glycines
  Genomic contig location: Contig_ID=SeqID_40432; Location=165..421; Strand=+
  SCN-specific regions: Sequence locations=1-257
atgctgacatcgattgcttttgttccaattggcggtctcacagaagcagtcaatgcattggacgttgagtttcgaaatctgccagaaatgcaaccgatgctggaatggtttgtttttttgctatcataaacatgccaatatttacatttcctgcgtacaggttgatgaataattacacggtcgtccacgcgctgatggttcgcgaacggaaccgcgtttcaaagccgaagcttggaatgtctaggaaagaacgctaa

SEQ ID NO: 68773 - DNA, 320 bp, Heterodera glycines
  Genomic contig location: Contig_ID=SeqID_40437; Location=685..1004; Strand=+
  SCN-specific regions: Sequence locations=1-320
atggaaaatcgattaattcttggccattcattaattgccctaattattggcaattcattaattgccaattttgattatgttcttactaaaattgcacggataataatgaggatgaaaaatggtgaagaaaaatgtttgaagttggtgacaatggccagcaacagcgagcagtacagcacggcagacggaatgccaatggccaaagcgaaaaaaagggggcacaaactcgaattggccaaaatggtcatggcggagaagaacggagcagagacggaggagcccattgggggaggatgaaatggtgtaacggggaggaaata

SEQ ID NO: 68774 - DNA, 400 bp, Heterodera glycines
  Genomic contig location: Contig_ID=SeqID_40437; Location=1..400; Strand=-
  SCN-specific regions: Sequence locations=1-4,31-96,118-400
aaggaattaaaaatttttaaaaattttattcatctccctttttgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccg

SEQ ID NO: 68775 - DNA, 248 bp, Heterodera glycines
  Genomic contig location: Contig_ID=SeqID_40440; Location=748..995; Strand=+
  SCN-specific regions: Sequence locations=1-8,30-42,88-248
taggggtgtattttttgaaaaaatttttaggtcgattcttaggggtgtattttttggttttattgcatttttgttaaggaattttccaaaaaatgccgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttct

SEQ ID NO: 68776 - DNA, 797 bp, Heterodera glycines
  Genomic contig location: Contig_ID=SeqID_8651; Location=1121..1917; Strand=-
  SCN-specific regions: Sequence locations=1-292,350-587,609-752,774-797
atgccgggtaccagttcaacacacaaagagtcggtgttcatgaaactgaacaagcgactgacagtgttggagcagaacatgtcgctgagcagtgagcatttgcttgagctgagcaggcgctgtgtgaacggagcggcgcgggcggagaacgaattgaaacagcaaagggaaggcattgccaaggaagccgaacgcatggccaagcaggaggccaaccgagtggagacggagatgaaacagaaggtagctggttggccaaatacggagcataattataccattccatcctctcaaatatatatttctattaattattataccaaaaatatttttaatgatattatttattgggttttacagatcaccgaattgcaaaatgaagtacgccgtctctcccaacagcttcaatctgtccaaacaactgtccaagcgactggcaccggtggttttttctaccggcccatgctttcccccatgcacgggtacagtgcaagcgactcgcactgcagaggcgaacaaggtgtgtccatgttgagaaattgaccaaaacattaaccactttggggaagagttacataattatttaatttgaaaaaggggcaattttttaaaataatcgggctatgccattccgtttttaagcatgccttctcagtgatgcaatgatgggcacaaccctttcgccattgcacagcacttcagccgctccttacagcgcaaattcaatgccggtctccgcccattcagcatttgaggggaaaacgatggatggactttggacggtaatctatgaatag

SEQ ID NO: 68777 - DNA, 157 bp, Heterodera glycines
  Genomic contig location: Contig_ID=SeqID_40443; Location=136..292; Strand=-
  SCN-specific regions: Sequence locations=1-66,89-157
atgccatggttgcgcgtgccgcaattggacgagccggacatgtgagtgaagcgcgtgggggggggcaattaattaactaattgattaaaattgctcattttaaattttccaacaatttttcaggcacgcaatgcgatcgcacgaaagaagtgcatga

SEQ ID NO: 68778 - DNA, 210 bp, Heterodera glycines
  Genomic contig location: Contig_ID=SeqID_40447; Location=606..815; Strand=-
  SCN-specific regions: Sequence locations=1-210
atggccggggtggactacgtgctgaagtttatgcaaattgctgaacacagcgaacaacagcgaagcagcggcagaacgccaaaactgtcgcaacaaaagtgggcgatggcggaggaggacgaaatgccacaattcatcaaaagaccatttcgggtgccgagtgcgcattcggtggacaaatttgtggacgaatccctcaaatcggacggg

SEQ ID NO: 68779 - DNA, 645 bp, Heterodera glycines
  Genomic contig location: Contig_ID=SeqID_40448; Location=487..1131; Strand=-
  SCN-specific regions: Sequence locations=1-277,374-547,577-599,630-645
atgcagaaaaacacggtcctggtaagtaaggcctgagatcccacgaaaatttgaatttacacaatttgcttgagctggaaaaatttagcattaaaaaattgtttttattagaatcatttaaaaattctaatttcgaaaggagtcagaaaaaattttagttcttcaaccataagttctattaataaaaaagaattcgtattactacaataatctcagaccaaaagtaagaaaccaaccaaaagcaggctgaaacaaattcgaaaaaaaaataccgagctttttaaattataatgatgaattaatttaattttttatttaaatacattttaatcgaatttttcaattatttctttatcaaattttttaaatttttgtaaagccttcgccaccgacagaacgcgagtgttatgacaatgatgtgtgttgcattcagtgggccgcgaatggcacatgtaaaacggcaccacgttacatgaacacatggtgccagggttcgtgccgttttgacgggtgccgaccgtacgccgattatggcaaacctggtaagtaaaaaatgaaaaaatattttaaaaaattgcattttaacaaatcggactttgaaatttttaaaatttttaagaattttaatagatgtgatgaaataaa

SEQ ID NO: 68780 - DNA, 540 bp, Heterodera glycines
  Genomic contig location: Contig_ID=SeqID_8654; Location=285..824; Strand=-
  SCN-specific regions: Sequence locations=1-136,159-355,391-503,525-540
atgaacaagaagcacaatgtgaccatggcacgtcgtcggccgaccaaatcggccgcttttccccccgccaatgcgccaaatgcgccgccaaccaaaagagaagcggtggtaatgccctgactttgcttagattggaaaagcaagcaaatctaagcattattgcctgaaagtgttcagacgaaggtcggctgtcatgaagtgcaagctgtcactgattatgcttgttccatagccaagcaaaaggcccccgagggcgcaaaaccaactgatcagactcaaaaacagagtggcggaggacgactcggagtgatcagaagcagcagaggacagatggagctgaatgggcgagaccaaaccaatcagcagaagagagaaagggagagaaaggaacaaaaacgaatgcatacgcaatttgggacagccaaagaaatgcggccatttgttaatgatggaccaatttcggcatttttgtccatgagaaaataaatagttaaaggtggaggaagtgaagaaatgaaatagaaaatggaagggaataaa

SEQ ID NO: 68781 - DNA, 2667 bp, Heterodera glycines
  Genomic contig location: Contig_ID=SeqID_8654; Location=486..3152; Strand=+
  SCN-specific regions: Sequence locations=1-181,204-1378,1400 -1890,1913-1936,1958-2016,2044-2174,2209-2637,2662-2667
  Gene Ontology: Mol. function=myo-inositol transporter activity; Cellular component=membrane; Biological process=myo-inositol transport
cagctccatctgtcctctgctgcttctgatcactccgagtcgtcctccgccactctgtttttgagtctgatcagttggttttgcgccctcgggggccttttgcttggctatggaacaagcataatcagtgacagcttgcacttcatgacagccgaccttcgtctgaacactttcaggcaataatgcttagatttgcttgcttttccaatctaagcaaagtcagggcattaccaccgcttctcttttggttggcggcgcatttggcgcattggcggggggaaaagcggccgatttggtcggccgacgacgtgccatggtcacattgtgcttcttgttcatcgtcggcaatttatgctcttcgttggctccgacttttcccgtattttctttccttagtaattttgagcatccctccaaaattcaaaagttgcttctctccgcccgcatttttctcggcttttctctcggcggcttttcctctgtcgtcccaatttttctctctgagctttctccgtcttcaattcgtgctcaagttgtcacccgtagcactttgaacatagtcgctggtcaattgctcgcttttgtcgtcggtgcccttttgggctccgtttgggaggaacggtaaggcgacggattgcgcggaattgcctaaattgtcgtgatttttgccaattccccgccccccccccagattggatatttggcgatggatgaacgctgtttcgctgttccctgcccttctgctgctctccgctttgcttctgttcgtccccgaatccccgcgttggttggtctcttccggacagatgggcaatgcctttgtcgttctgtgccgaatccgtcacaacgcggaagaagcacgtgaagaattggcggagattgcacagagccaaacggagaaaagcggcaaagaaaagctcaccttttcggcatttttgtgggatagatggcttcgaaattgtgtgatgatcggtaagaaaagccaaacggatggacaaatgttaaccaaaaagcaaaattcgattaacaggccttggaattgcactcatccaacaaattgtcggagtttccgctccgatgtattacggcacaaacattttggaacggtgcggcatggacatcgaattggcaatgattgtcaatatcgccatcggggtgcttcgtccattccacccattatagctaattactgtgctaattatgccaagatcgtttccttggtgtcaatggcatttggcatttggctgatgggccgttgcggtcgtcgtccgatgcttttggtgggaatggtcggctcttcgctctcccatttactggtcgcacttattttttggcttatgcccagcggaaatgccaaaggcgtagtggtgctgcttttgctgctgctcttctgtgcttttatgcaatgcgccatcacttcggtataatccgccgatggtcggatcggaaaccatggccaattagtttcggacagtgcaatttaaaaatagcgaaattctaatttattatgtccaaatggcaaggattttatgtaaaaatactagagtgcagcgggaccgggaattttgggcttaaccgggaccgggaccttttctggttgaaaaaccgggactttttgctgggaaaaccgggaaaaaaccgggactagtcccggtcccggtcaaaacggggaccggtaaattggacaccggaaaattggacaccaagcggaaaattggacactgtcggaattttggacaccaaaggaaaattggacactaaattcctcttttaaaatataaacccaggaatttaaacactcaatatgcacaataattgatcaaatgtggcaaaaaagtgtacaaaattagacgatgattgatcaagatgccaaaaaatgtacaaaattgcgtgatgattgttcaatgtaccaaaaaatgcgcaaaatgggaactccataaaaataaaaacttttttcgttatgaagttgtccgtgtccaggtcccggtcccgctgcactctaaaaaataccaaatcaaaattattttaaaataattttattttgatttggcactttttcatgctgctcgagaatcttgaactaatttgccttcgtttctttgacatcactgaaatttttagccatacataattttttgcggatattttactgtcggaaacatttggcacttttaaattttaaaataactttttctttctgtttccactggttaaggtcacttggtgagtggattgatttgattcccttggcgttccgttcggccttttgtcaccgcccctccccaccaattgccattaattaataattaaggttcattctcgcggagatttttccgctgcgtgtccgtgggatcagtgagtgtttgatcaattgcgatcattaaaaaacattggcattccgtctttacctctcttagccatgggtttgtgcagtgccatcgtttggatgaccaaattcgcttacggccttttcttgcccttggcaatggatttcctcggcatttctgctacctttctgctgcttctccttttcacttcactttcaactatttttgtgtggctttttctgcctgaaactcgtgacaaaacattggaagagatggagaaacagttcagggaggaagattgggcagcactgaagaggaaagggaggaagagaagcaaaga

SEQ ID NO: 68782 - DNA, 103 bp, Heterodera glycines
  Genomic contig location: Contig_ID=SeqID_8654; Location=3613..3715; Strand=-
  SCN-specific regions: Sequence locations=1-103
gtgcccttttcgtattcccctgcaggcatttttaattgaaccacaaaaaagcgaatttaatggaaggaatgtaaaataatggaagatcggaagggcataaagc

SEQ ID NO: 68783 - DNA, 732 bp, Heterodera glycines; identical to SEQ ID NO: 8655
  misc_feature (67)..(67): n is a, c, g, or t
  Genomic contig location: Contig_ID=SeqID_8655; Location=1..732; Strand=+
  SCN-specific regions: Sequence locations=1-732
  Gene Ontology: Mol. function=actin binding; Cellular component =lamellipodium; Biological process=cell adhesion

SEQ ID NO: 68784 - DNA, 49 bp, Heterodera glycines
  Genomic contig location: Contig_ID=SeqID_40452; Location=313..361; Strand=-
  SCN-specific regions: Sequence locations=1-49
ggaagctattcccggaggattcggtctccccataaatctgagcgcatcg

SEQ ID NO: 68785 - DNA, 49 bp, Heterodera glycines; identical to SEQ ID NO: 51181
  Genomic contig location: Contig_ID=SeqID_40455; Location=279..327; Strand=-
  SCN-specific regions: Sequence locations=1-49

SEQ ID NO: 68786 - DNA, 53 bp, Heterodera glycines
  Genomic contig location: Contig_ID=SeqID_40457; Location=412..464; Strand=+
  SCN-specific regions: Sequence locations=1-53
agcacttcccggacccggtccaaaacaaccctggtatcattcgaaagccaaga

SEQ ID NO: 68787 - DNA, 779 bp, Heterodera glycines
  Genomic contig location: Contig_ID=SeqID_8656; Location=2185..2963; Strand=+
  SCN-specific regions: Sequence locations=1-421,464-602,641-660,697 -747,769-779
atgaaacaacaaaatgtgcagattgctgaagaagaaacattcggaaagacaaacgacgaaatgccaaacggagcacagaagcagcagaatggccaagcgaaggagaagcaaaaagtgggccaaacggcgccggtggcacgtccgctgacagtgaaagattgggactacgacgagaggggccaatgcggaccaaagcattggctgcgcattgccaaatgcgaacatttgggtgccaccttttatcattgataaaaaaatgccaaaatgatttttgaaccctttctcaggcgatcaccaatcgcccattgacttccaactgtccaaaatgcgcgtccatccgctgaacattcacccgctgtgtttggtcaattttaaaaagcctttggctggccagctgatcaacacgggctgtggaagtcggatttattatatgaaattttaaaataacttaattatattaaatcatcatttagtccaattccaacccgacccacagattgaaccgcccgaaatttacggtggcttattggaccaaaactatcgcttcgttcaataccatttccactgggcacagaatgacaatgaaggttaataaacctactattctttatttatgtaaatgattttcaagtttgaattttagaaaaaatggcaaaattcataaatttaaattaaaaaaaaattaaaaaaaaattagggtctgagcacacaatcggtgggctgcgttacccagccgaacttcacttggtccaccagggtgtcaagaatccggtcagtta

SEQ ID NO: 68788 - DNA, 489 bp, Heterodera glycines
  Genomic contig location: Contig_ID=SeqID_8658; Location=101..589; Strand=+
  SCN-specific regions: Sequence locations=1-66,88-202,252-489
atggcttcttccgcggaacattttgtgtcttcgtttgtccgttacgaggggtaaaagccatgccaaatttaatttataaattgaaaatgttctaagctccctgaccacaccgccatgctccgaaaatgtcacttggacagtgttcactgatccgcttctgatcaccagagagcaggtggaaagggaaagcagcaaaaaaacaaaacaataaattaatgggattaaattaattttaaatggttcaattaaaacgccttcttaaagaacctctaaattcctattcaaaattaattagatctaagcctaagctgtgtaaattttaattcttcttccagcaattatttcgtatatttttctttgcccttttttatttttttaacactttttattacaaaaaaacgttgcttgatttttgtaaatttcagatgtctctcctccgcgccctaaaagactgtaaaggcaatgtaatcgaaaagaattacaggccgg

SEQ ID NO: 68789 - DNA, 689 bp, Heterodera glycines
  Genomic contig location: Contig_ID=SeqID_8658; Location=1015..1703; Strand=-
  SCN-specific regions: Sequence locations=1-108,130-145,218-436,471 -644,666-689
atgggggaaaaggccaattgggcgaatttattcttttgtatggcgggaaaaacggacgccgtaaaatgggagaaaaaaaacatcgatcacaggacagaacagtcgcccattaccacagaattggaagcagcagaagcagcaaagcattattattggtattattataaaatattattattatattattattattattattagtattggtattatgattcgtattaatgaggaattaaaagcgggcggaaaaaaaggaatttgtttggtgatgatccgatgatgatattactaattggcgaaaagcacaagtcgaaacattggcccaccgatggaatgtgttcaaaattgtacagtgaaagtgacagtgatctttgaccacattttatcattttttaacctttatttttagataggccttttatgttgttttgctaccaaaaaatattagtaaaaatattatttatttttttgctttgacttttttaatgatttttattccacttttttgacatttagtaactaaatctgtcagtcgaattcattcataagacacaaaaaatgaaatgtttaaattgttaaacagaaaaagcaaacaaaaaagtaaatcttcaattttgtaatgtaaacagaaaatgcataggctctaataagcaatttaagattttgggttaattttggttgaaaataaa

SEQ ID NO: 68790 - DNA, 341 bp, Heterodera glycines
  Genomic contig location: Contig_ID=SeqID_40462; Location=401..741; Strand=+
  SCN-specific regions: Sequence locations=1-36,58-198,245-341
atggcacttttcaaatgttcagcttatttatatttgaaaggttaaaaaacccgatttctttaaagcgtttttataaaatatatgtccatattttcggcattttatgtccatattttttgcatccctatagattacatttgatttttttgttttaaaattcaaaaatattcaaacaattgtttttaggaaatctgtgagtttatttaaatttttataaggtaatttataatatgaattaaaatttgcttaactcagcttcataaccacttaattaattcccctttttcctaatttatccgttgttcgatttgccaactgagacaatgaaatgtttaaacaca

SEQ ID NO: 68791 - DNA, 545 bp, Heterodera glycines
  Genomic contig location: Contig_ID=SeqID_40462; Location=778..1322; Strand=-
  SCN-specific regions: Sequence locations=1-146,170-219,241-296,320 -361,400-448,472-545
atggcaatggcaccagtcattgtaaagcaattaagtgttatttaatgtttttgttaattattttagcttacgccttacgttctttcgcccaatattcttaacccttttgcgatgagtccgctgattctcagtccgacggtaaaccgaaaaatatttttgggggaaatttcaataaaatggcccaaaaaataaattggtggaaattgttttttcaagcttaaaagattattttaaaaaatagagtaaatccgtctgttgtgtaaggcgtcgcagggaaaacatttcttagcttttgtagtaaaagtcattattttcttaggaaatataaaatcaaaatcgacgacaaaaagcttcatttatcttttttataaaacttaattctttatttaatttattaatctgctgcttttcaggttctcagtcctgacattttatccccacaaatccttggcggtgccattctttccccaaccgtcggttctccggcaattttgactgaaacatttttggcggcctctgtactttcgccaagcgttttgtcatga

SEQ ID NO: 68792 - DNA, 198 bp, Heterodera glycines
  Genomic contig location: Contig_ID=SeqID_40466; Location=352..549; Strand=+
  SCN-specific regions: Sequence locations=1-62,84-91,118-198
atggcttcaataaacgatttagattatgttcgagattatgattatgtttatgattagattttgatgaaattgaagaatgtgttgagattttagatcaagaaaatgaaagaaatattaggaattatgatgtgtttgaagagcataactatgctaagagacaaagatttgtggatggtggtcccagtcagggataaatga

SEQ ID NO: 68793 - DNA, 408 bp, Heterodera glycines
  Genomic contig location: Contig_ID=SeqID_40469; Location=131..538; Strand=+
  SCN-specific regions: Sequence locations=1-48,70-143,165-375,397-408
atggacaatcggttcatcgacagagctctctttgagaactcggcgacgaaaaaatattttgttggcacattcccggccgatcgattgccaaagtgcaccaaatttccctgcagtctaattgtcaatttagttagtacccataaaatacattaaaatacatcttgccattttaggatccatcgggaatgccgggaaccaaaaagcgctcaaatccgcgtattccattgtatttttcgtagtgctcgagcatcacttgtgtatttcccgtcatcattttcaatgtgtcccttaacctgcggaaatttgtttatttgctgtataaatattcaatttttacaaaaatacctgaattttggctcatgatttttgcgtgcctaaattttataaaaattattactttaaagaaaa

SEQ ID NO: 68794 - DNA, 110 bp, Heterodera glycines
  Genomic contig location: Contig_ID=SeqID_40470; Location=428..537; Strand=-
  SCN-specific regions: Sequence locations=1-39,61-110
atgctggggaaatgctctccacctgtcactaaattggcttcaacagcagatgaaatagaagagagtgtgccggagacatcttctgggtgctggaaacgctttcgtcaatg

SEQ ID NO: 68795 - DNA, 286 bp, Heterodera glycines
  Genomic contig location: Contig_ID=SeqID_40471; Location=1046..1331; Strand=+
  SCN-specific regions: Sequence locations=1-56,95-286
atggctcaagcggagtcggcggaggagacttacgagcatgcaagtgagtttcaatcattttatttataaaaaaatatcaaatattcaatttttagtggacttctactttcagttggacaattatgtccaaatgtcgcagaatttgaccattgatgaccaacttccgccgggatgggacgcaacagcagaagtgcgagtttattgcgcgacgccgacagtggaagcctctaccccagccgggtggaccatccatgcggtagcttcaaatttcactttgctcggatga

SEQ ID NO: 68796 - DNA, 2075 bp, Heterodera glycines
  misc_feature (1139)..(1140): n is a, c, g, or t
  Genomic contig location: Contig_ID=SeqID_8661; Location=843..2917; Strand=-
  SCN-specific regions: Sequence locations=1-509,531-818,840-883,905 -1204,1231-1345,1367-1539,1566-1750,1772-2075
ggggatctctagagtcttcattttagcattatcttgaagcatcaaatgaaatattggtaagccatcaaatgagaccaaagttagctaatggtcaaatttagacgagggaccgagaaataaaagaactttttgcgctcagagatcgctttcacgacaccatttggaatctcacacactcagaagaggtccctaaaacaaataaatgcatacaatcgacaccttttcatcgacttcagaatgttatttcgcgtgaatcgttcaacggacttggccaagaatattttgacaaattaattgcccactcattttccgcatgccgaaatcaatttacgaatgaaaggcatttgctgaacagaacccacggggccgagatgttgtggacctatgcgaatagtttattcttcgcaacgaccgtaatcacgacaattggtccaaagcaatcaaattagtccaaaaaattcccatttatccttttcaggatatggaaatctcgtcccgatggtatcgttggaaaatttggggagggggctaaagcgatgtgatgcttttcaaatggaaatgccaactttgtcagcttcagactgagtttggccgaatcgcgtgcatttgctttgcacttttcggcatccctttacttctggtgacaattgcggacattggcaaattcttgtccgattttctgaattttctctaccgaacctaccgcacttttaagacgaaggtgccgtcgtcccctttcggcctcctttctcttcttttcaggtccgtaagcaatcgcgccgcttctctcgctaccgcaccgcttccgcctcttcccacgacggtgccctccccgccccccaattggcttcttctctcctttatgagtccaacaacaactgactgtcctcgctttctgattggactcgtaaaaggagcaacagaagaccaagtgtccgcgcaatttgtcttaatcgaaaagcattcagaggaaagagcgtccgtctcgacgatgaccaaagcgggaagcataaatctgaacgaaataaacgaggcggacgtggaggagagcgaaacgccgcacgaactgcgcattcccgtggtcatggttttgttcgtgctcctctgttactgcgccattggcggtttcctcttccacnnatgggagggatggacttatttcgaagcgttttatttctgtttcataacaatggccaccgtcggtattttattattttggtttttctgaccgaatttcgtcgttttctgctaaatgctttagggtttggtgacatcgtccccactcacagctcaacttatatcattttggcctatatcatttttggactttcactgtgctttaccttttttgatgaatttaattcattgtttagcgcaacgatgtgcatcgatttggccgggacggaatacattagaaaaattcattatttgggcaccaaaatggaagatgcaaaaggcacagtaatcacagggcttaaggcaggggagcaaatcctcaaacacagaggtacggcatgcacttgctgtacgatatgcagcatttattttataatttatttataattcgaatatttttgcttttttattcgagtgttaaccgaaatgaaaaggtaacccaaccaaaatttgagggatcgaagtcattcgaacagcgagtggaaagattgtgcaagttgggggagcaatgctcagtcttcgacaagctcaggaactcggagtggagtatattctctcggagttcaaattggacaacaaacacaaaaacattctttacgagcctttgagtccggctgtccaaaggctaatcaaaaacaaaaacatcaaagtgagacagaaaagaccattgacagtctaaaaaaggtactgacatttccaactacgacccaaatttcaagattcttcctggtgacatcagcgacaacgatgggctgatcctccaaaatcggagttatgggaagccctttctgttgctacaaaccagcccaaacgctatccaccgttacactatgccagcagaagatgcaagaaatgcctatgccattctcgtgccttttattttaaaagagacgaatatt

SEQ ID NO: 68797 - DNA, 1160 bp, Heterodera glycines
  Genomic contig location: Contig_ID=SeqID_40474; Location=1..1160; Strand=-
  SCN-specific regions: Sequence locations=1-378,400-458,482-1160
gtggattttcggggcaaaattttgacggcgccatggatttggttggacggacagtttcgccaaaatgtccatcttaaaattgatgacaagggaaaaattgtgcaaataatggaagggcatcacgaagctgaaaaacagtgcgacgacggaatggcggcgggatactgtcgcctggacaatacggtaggtgccttgtggtgcctccgagactctcgagtcgagaaattcccggtttttgaggtttcgaagactgctcaagagtattgtttcctgagtcgaaaagtcacaatgcctaaagacttcgggggttgctgatcagaatatgaattcatttcgaacaatttccgaacccagggaattttccgatttcattttggcttagaaatgatttaaatactcaagaatatttcaaaaggcattaagcataaattattatctttccatgcagccttggatgtaaatgaaaaattcaaaaaatttattattcggctttttgttcgaatttggccaggggttcggaaatttttcgaaatgaatatcactgatcaacgaactgcgatctaaaaaaaaacctttctcgagtctcggaaccgagcgaactacgaatttgttgttaggccctgttgcctggctttgtgaacgcacattcgcacgcgtttcaccgctgtttgcgaggccggtcccaaatcggtggccaagggaccaacaatttttggaaatggcgccaagacatgtacaacctggtgcggcacattgactatgcgcggatgaaaaaagtgaacattttacctcccagacttttgtatttctcgagaaattcaatgattttcttgaatttttgccgaattttttggcattcaataattttcacacttaaattgcatacaatttcaaatttgcgtcggcacttttcgcgaaatgctgtcagctggcatcaccacagttggcgagtgagtgagtcaatcgacgaataatgcaaacaaattttgcaaaaattcaaaaaattcaaattgatttttcaaaaattgaaatttggttttttcaaaaagatttcactacgttcaccatgcggatgatgaaaaatttgggctcgatttggccgtcgtagaggcggcccttgaagttggcattcgtttggtgctgatcggtcggttcgaaat

SEQ ID NO: 68798 - DNA, 902 bp, Heterodera glycines; identical to SEQ ID NO: 40475
  misc_feature (812)..(813): n is a, c, g, or t
  misc_feature (824)..(824): n is a, c, g, or t
  misc_feature (831)..(831): n is a, c, g, or t
  misc_feature (850)..(850): n is a, c, g, or t
  Genomic contig location: Contig_ID=SeqID_40475; Location=1..902; Strand=+
  SCN-specific regions: Sequence locations=1-115,183-313,378-620,642 -716,738-744,768-871,901-902
  Gene Ontology: Biological process=jump response

SEQ ID NO: 68799 - DNA, 407 bp, Heterodera glycines
  Genomic contig location: Contig_ID=SeqID_40476; Location=123..529; Strand=-
  SCN-specific regions: Sequence locations=1-79,101-183,215-407
atgtgcggagcaaaaaaggttagcgggagcgggagataacttagtatttttgaggccaacaatttaatcagattagattgtgaaaaccttgaaaaaggcttgttttcatgaaaacgtgtttctgttggttttcgtgggtaaaaaaccacatacctatcaggtacttatatggtttagccacccaaaaaaatttttttttaatcatataaaaattctaggtggttttcggggtagggtttttcgggatcgctgatcacgaatctgacatccatttcaaccaaattcctaaaactggacctgaactattacagaaaaatctaaagttcaaactttcgaattttgggtttttggtctaaaatcggtttaaacacacggaaacaactaaaatctatcacttctacaataaa

SEQ ID NO: 68800 - DNA, 427 bp, Heterodera glycines
  Genomic contig location: Contig_ID=SeqID_40481; Location=593..1019; Strand=-
  SCN-specific regions: Sequence locations=1-427
ctacattgaccattccgtgatcaaatttctccgctccaaaaagcgattctttgacaaaagtggcaccaaattggaagtgtttgtgcattcaattgatacggatgtccaaccaatttgggatgtttttacccgcgaaattttgcctatttttgcgacaaacgttcgccatttgtgctttcctaatgccaatcatttttacaatttgcgtcgtcacacttcgccgacacttctcactgatcttgatcaattgaattcaattgattctggtgctctgttacccgatggaatttctgacgatgggccaaaagcaactgccggccaagcgttgtccaaatggttgcacacgccgagcaaaaatggaaaagcgaatgaattgtattgctgtgcttatttttgtgaaataacatggatcaacactttcaaggag

SEQ ID NO: 68801 - DNA, 683 bp, Heterodera glycines
  Genomic contig location: Contig_ID=SeqID_8662; Location=40..722; Strand=-
  SCN-specific regions: Sequence locations=1-10,33-103,126-170,192 -385,430-590,661-683
atggcatttgttattttaatttttgtgttgatattcataataaattcaaccgataaatgtttgtgtgttcataaattatctgatttgaatggaaaaactcggccaacttttgttgaaatatttggccaaggatgggaaattgatcaaaactcaaattggcaaaatgatcaaaatgaattaaatttggaagattcaattggcaatgatcagaacaacgaacaattcaatgatcagcaaaaacgcgaaattgttcataaatttcatgtgataaaggaaaaaataaagaaaagaggaaaatattcggcaaaagttcggactaaaattgagcaaaagattgccgtaaaattgggaattagtcgaaagaaaatttacaaatggaaaaaagaatttaatttaaagaaaattaagaaaaatgataaaaattattatgaaaagaaaaagcaagaatttattgaacgaattgatgagatttacagaaggttaagaaaaggaaaacagaagcaatttgcgaaagagttggacattgaccaaaaaacattcattaaatggaaaaaaagaatttggaattgaaattgacaaaagtgtgattcaattaaaatttgaattaaaatatgattttttttaaattttaaatttaaattttatattttattatttttaggtggaattcggtattcgaatga

SEQ ID NO: 68802 - DNA, 818 bp, Heterodera glycines
  Genomic contig location: Contig_ID=SeqID_8662; Location=1664..2481; Strand=+
  SCN-specific regions: Sequence locations=1-40,70-272,301-346,368 -391,423-545,567-573,595-674,704-741,787-818
atgaaattattggttgaacaatcatggtggaaagttggaatgcaaaaaacagaatcagagaattgtttgttatcaaaaattagtttatttggtacaccagggttagaaacttgcgtttacaaaaaagatgctaaaataaatgggacatttgtaccaggaatttggatgtcagaagataacaatcgtgcactagtttttgacaaaaattcaaaaaaggccgaagcatgcggcgaaaaattgcgcgttagtgcgcaagggtttgcccttacggagaaaaccaaattttaattaaaaaagaaaacgataaatttagttggctttttggatccaattaccatgattatcaaagaaaatagtaaaattcaaacatgcactgaaggacaattcaaaactattttgttaaacaataaattgataaaaattaaccaaatgactggaaaatataatcatatcgaagaaccaactatttacaatatggaccaaaaagtctggaacgaagaaaaactacctattttcccattcaaatattcaaacaactaacacttacaaatttaacaaataaacaaattgacatgttggaaatgttaaaagaatttagaactagtcgtattatatagataacagacccattgagcaaagagaaatttggacgtcaactcaatttcgagattcggcattattccattttttaaaatataattcctaaagcaaattaaaattttcacaatgtaatttattcagtaaaatttttaatttcagaaataataagaaaaatttttaatttttcttcctttttttaaaaaaatcaaatacataaa

SEQ ID NO: 68803 - DNA, 562 bp, Heterodera glycines
  Genomic contig location: Contig_ID=SeqID_8663; Location=535..1096; Strand=+
  SCN-specific regions: Sequence locations=1-28,50-562
atggattttgattttcatgttttaattcttatgttattattaataattagttcaactgacaaaaaatttgtgtttaaaaagaatggaaaaactcggccaacttttgctgaaatatttggccaaggatgggaaattgatcaaaactcaaattggcaaaatgatcaaaatgaattaaattcggaagattcaattgacaatgatcagaacaatgaccaattcaatgatcaacaaaaatgtgaaatggttcataaatttgacgcaataaaagaaggaattaagaatagagggaaatattcgccaaaaatttggaatagaattgagcaaaaaattgcgaaaaaccgggctttcttccaaaaatcccctcttttcctattcattcgttgctttatagacgaatttctcgatttcggttcggtatggaaaatttacggctccaacaaataaatttccattttcggcggtccattattttaaggcaggaggaggccggatgtcgattgctgtcaccggtaaattttttgaaatttggctaggtttttaacagataattgtccaaaaaata

SEQ ID NO: 68804 - DNA, 296 bp, Heterodera glycines
  Genomic contig location: Contig_ID=SeqID_40486; Location=197..492; Strand=+
  SCN-specific regions: Sequence locations=1-296
ggaatctgaaaagccctcctctgacagagccaaagtcatcagttcgtcgtccgccgattcgcaacacaagcgacgttcgtctcacaccaaaaaacacctgccttccccgccgcctgtccatcgcgatgcttttcctcccgccaaaaatccttccccgtcgcgcgctcgctcaccgtcacgtaacggtaaaagcggagacgctaaacggacgccaccgcgacgaacgcatccgttgccaccaaagacacacggcgaacgcagcgtaaatattaaaaaaaacggaggggttgaggaaa

SEQ ID NO: 68805 - DNA, 195 bp, Heterodera glycines
  Genomic contig location: Contig_ID=SeqID_40487; Location=228..422; Strand=+
  SCN-specific regions: Sequence locations=1-195
ttaggccgcttcgcggcctcgaacgggcgcttcgcgcccgttttttaaattttgttgggcttatacgggcgcttcgctcccgtttctaaatttgttgggctattaaggcagcttcgaggcctcagacgggcgcttcgcgcccgtttctaaatttgttgggctattaaggctgcttcgcggcctcagacgggcgct

SEQ ID NO: 68806 - DNA, 1014 bp, Heterodera glycines
  misc_feature (932)..(932): n is a, c, g, or t
  Genomic contig location: Contig_ID=SeqID_40488; Location=1..1014; Strand=-
  SCN-specific regions: Sequence locations=1-467,490-535,564-772,795 -978,1001-1014
  Gene Ontology: Mol. function=carboxypeptidase A activity; Cellular component=extracellular space; Biological process=histone acetylation
agtgcctgactttttaataatgggtgattagaagactttcagattgatttttggcgtccgccgcccttcgtcaattcctctggggatgttatggtcgatgttttgcgcaacggaagacattttttggactttttacgcaaattccaagtcgaattcaaagtgttggtagacgatttatcaaagtgagaaatcatttggaggattttggcaagtttttcttacatttctttagacttattgaagaaaaggaaattgggccttctccgtacgccaaattgtccaaaaatgggccaattctccgcgacactttcgatcgttttgaggggttcggcctacgcatgggcgactatcacagcttcgctgatttgttggcatttatgcaaaatgtgcaaaacgcgatgccgagcagggcacagttgcgcaccatcggatggacggccgagggacggccgctgcagggcattcaggtggagaaagggggaagaacggagggaagggatgaaagagggagtcgttggaaggggggggggatgaaagttatttaatattcattcattcatttggcagtttggcaatccatcggacaaaagtcggcccgtcgtttggatcgacgcgggaatccacgccagagaatggacagccgtaagaacattgcacagcatcggctgtttgatgttttgttttcgcctccgcaggtgcacaccgccgcttacttcatcttttactttgccaaccaaattcgccttgggaatgaccaaaggttgctcaaatgtctggagagagtcgacattttggtgctgccctgtctgaaccccgacggatacgaattcacgcgctccgaaccgcgcaacccggcggtgcgaatgtggcgcaaaaaccgatccaaggaacgctgcgcgacgagtgcgagggacggccaaacgcattgctgncaagtgaaaattggggaggaaattaaaaggggaaaagccaagaaatggaggaaaatgaggggaaagcgtaacggacgattta

SEQ ID NO: 68807 - DNA, 1073 bp, Heterodera glycines
  Genomic contig location: Contig_ID=SeqID_8666; Location=212..1284; Strand=-
  SCN-specific regions: Sequence locations=1-251,273-661,683-815,851 -932,954-1051
atgatgggaattgagtgcgttcggagtacggcgccgaggccgtgggacagcgaaagtgaacggtgaaaatgggcgaagggccatcatttttcggggcaaaaaatgcttcattcatcacatgaaaatattgataaacgcctaaggcgaaatgcaaaaataaaatattgcaaatgaaaatatattacggaattttaagtgcggaatttggcagttttatatgcatggcaaaattttttgaaattacctcaagtaaaatcttataaaaaattattcgaattcaattttttaaattgcctacgacttttgaagtccaattgaaatgccctgacgatgtttctttggaaattgaaaaaatccttgagcttattcagtgtaaattgcctcgatcaaataaaaaaatttcagctttcatcaagttcaccattcttccgacggctatggacgtgatggcattggcacgcacccgccaatgtcaggtgtggcattacaattcgaccgatttgaagtccaggcattttatcaaaatattcctttcatcgtatgggtcgaagaaattacattccattaagtatttttgaattttttaaatattaatcgaaaatttttccctgtggtgcctgccggactgcctgacacctattttcattgatttttttaatcaaagttaaagtgaaaatcaaataatttttggattaaccttttctttaatttttggattaaccttttctttaatttttaatttttggattaacctttctttaattttttttaagatggggccttaaattctcgaaaaactcctgtcaacctgaaattcaaaaaattcttataattttgtttaaaaatcaatattcccaaggtgacgcaactgccattgtgattttgccccattccgcgccctcttcgtcgtgtgggttcggctcgcgccgggccgcctccttcccgctggccagcgccgtgctgatcagcgccaatctgccaagctcacacgcggcaaaaatttaccaacagcagcaaatggctgccggcaatttgaaggtggggaatgagcataatttaattttattaataaa

SEQ ID NO: 68808 - DNA, 304 bp, Heterodera glycines
  Genomic contig location: Contig_ID=SeqID_8667; Location=193..496; Strand=+
  SCN-specific regions: Sequence locations=1-80,104-304
atgaaattagaattagcaaaaaataatactgttttttcagtaagtctcccagatttaaagaaatttgccatcttgtcctagaaaatttttgaattttttgtcaatctgagtgttcttactttttagagtaaattgagtcccttcggtagaaaaatggttgaacactataatattgaatttaataatgtggaaaaagatgcaaattagacccaaaactttgcttttgccctcctgtccataaaatgcctcacataatcaatttaatagtggaaaaattatgacaaaaaaaattccctagcgaaca

SEQ ID NO: 68809 - DNA, 283 bp, Heterodera glycines
  Genomic contig location: Contig_ID=SeqID_40493; Location=656..938; Strand=+
  SCN-specific regions: Sequence locations=1-237,278-283
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactggtcccagcaccccccccaaagcaaaaacaatataaccaaaatataaggaaaaattttttcctcccacttccctttttgatactaa

SEQ ID NO: 68810 - DNA, 1460 bp, Heterodera glycines
  Genomic contig location: Contig_ID=SeqID_40494; Location=95..1554; Strand=-
  SCN-specific regions: Sequence locations=1-390,413-500,522-1171,1193 -1460
  Gene Ontology: Mol. function=structural constituent of cuticle; Cellular component=extracellular; Biological process=cuticle biosynthesis (sensu Nematoda)
atgcgccctatcgctttcgttgcggtcgttgtttcgacggtgcgaaaaagtgacgaaatcggacaatttttaccaaattctcttttaaggttgctgtgattgcttccgtcgttactttgccaatgctttacaattacgtccagtccttccaaagtcatctgatggttgagacggattactgcaaagtgcccttttcgaagtgttcaaagaccactcgcactttttaaaggcccgtgctcgtgacatgtggctggagatgaccgccctccaaattggcaagggacatgtgaaccgcatcaaaaggggctggttgttcggccaatgggtgcccgagagcggcgccgatgcttacgctgcgggtaaacactcgactgatgagccttcattgggcttttttgggtttcttttccatttgtcaccttcgctcccctaaggaggtgggccatccggcggtgctccgtcgggaggtgctccgtcttctgcttcggcacccgtcggggctgtgcccgctggcccttctgccgcggtttctgctggcccatctcagccggcaggtggacaatatgggcaaggagccgccggatatcagccggtacaagctcccgaagtgtcgcccgtctgttgtgagttaaaaaaatgtgtatctcttctttacgttggacttaggcacttgtcaccagggccctcccggaccaattgggccggagggagccgccggggcggatggagacgatggacacaacggaaaggacggagcccccgggagggacgcgcagtccatcccagcacctcttgaagagccatgcatcgtaagcattggcgggcagaaagtgcgtgctgtgataagtgtgactaattgacagatttgcccgcccgggcccgccggtccccaaggacccgccggaccgaaaggacccccgggaccgaagggaagcccaggagagccgcccaaagacggagtaccgggagagcagggaatgcagggtcagcccggtcctgtcggacgcccaggccgcgaggggccgcgtggagcccccggacagcccggacgactcattcccgtccctggaccgcaaggcaaggaattgtccattattatcattttaatgccatcttaaggaccgcctgggccttctggacctcccggagaacaagggtttgtgtcttacggttgaccatttatgttctttttcagaccgaagggtcagcccgggcccgacggacaatctttcgaaggtcctcccggaccccctggagatgctggtcgacctggtcgagaagggcgtcccggaggaactgtaagtgttttcacgcgtttctcaccgaaccaaacaccgaagggaccttccggaccccccggccaagacggcgagaagggcagctgcgaccactgtccggagccgcgcactccgccaggatatttcgtcgaggcgggcaaaagtggcggacattaccactga

SEQ ID NO: 68811 - DNA, 989 bp, Heterodera glycines
  Genomic contig location: Contig_ID=SeqID_40497; Location=1..989; Strand=+
  SCN-specific regions: Sequence locations=1-5,166-172,194-209,231 -266,288-326,350-411,433-473,495-641,664-963,985-989
aagcggaagaagaagacgaagaagaagcggatgaagaagacgaagaagaagcggatgaagaagacgaagaagaagcggatgaagaagaagaagcggatgaagaagacgtagaagaagcggatgaagaagacgaagaagaagcggatgaagaagacgaagaagaagcgtaatcagcggaagaagaagaagcggatcaaagcaactaaatgtacagaaatgattaattaattatatttgttgaaatgatcaatctcactaattggaatttgatttgatgctcattttatctcagaaatgctttgttgattctttcgttcgaattcatatatatgtatattattttaaattagggttgcgactccgaaatgtcgggattttatgaaagtcgtcatattggattttttgtaggtatttatgcattttttctgtatattttgtgtaaaaaaagaagacgaagaaaaattgtcggcatcagcggaagaagaagaagcggatcaaagcaacggaaattaatttatatttgatgaaatgcccatctcactaattggaatttgatttgatagaattatttttttatatttacttaaaggcaataggcaaaaaataattctcgaatatactcggaaaaaatgaatttcgtgttacataatttattttttaatgccagtacttgctcttttcttgcatttataaaatcccgagactttaagcttggtaatactggaaaacaaaaaagccattagtaatcattgcaatttactgaaagtttcgaggacacatcattttaaaaagttaaataattccttcacaaaattatatcttcgtcaatacataatgattagggttgtaaattatatggattaacatatattttctgcgcatatgctatgaagaaaggggctcaaaaatagcctttttacgttaaaattttttgatttagtgaaggtttttagtctatataaatcaatatttttggggggtttcgggaa

SEQ ID NO: 68812 - DNA, 477 bp, Heterodera glycines
  Genomic contig location: Contig_ID=SeqID_40500; Location=179..655; Strand=+
  SCN-specific regions: Sequence locations=1-118,147-372,395-477
  Gene Ontology: Mol. function=RNA binding; Cellular component=nucleus; Biological process=pole plasm RNA localization
atgaggagggatcttgccgacagaccagccaaagttgagctaaccaaaggcatgagtgtgttgttaaggagaggtggtgaagatgaagatggtgaggttgtggacactacaccccgaccccctgctccacccccaccacctccaccgccagggagacgtcctccgcgtggaccccctcctccaccgacggggagacgccctccctctggaccaactactcctcgtccctccccacccggaagtcctccgcctcgtcctgaacgtccccaaagaccaagtagagcttctcggagaggtggtcgtctggagaaatggaggaaaggtcgatacaatatacagcaacggcagccggtggtgcgggaccttctagcggaagcagcagctgccccattgcccgaaagtgacgatgaagatgactatatgctggagagtggattcgcgctgccagcgccgtcacaatattatggcgatttgcct

SEQ ID NO: 68813 - DNA, 717 bp, Heterodera glycines
  Genomic contig location: Contig_ID=SeqID_8668; Location=150..866; Strand=-
  SCN-specific regions: Sequence locations=1-136,158-312,359-381,413 -570,592-630,664-717
atgatgcacaaaacggatacggtaagactttggcaagttcctctgtggctcagtcgtttaaggcatttgactatttggaatttctgtgggttcgagtcccgccggcgggagcatataatattttaggttcaacacaatttatacatattttatttatgtttctcctctccgggcatcttggacttaattttttatatttgatacgctcatttgctgagctaaaattgggcgtccggtagtgggcgcgcttggcgccaggtgttaaggcgcacgccaaaaagttcaaaaatatggtggaatttttttagcctctataaaatttgttataatattttttcttttacaattaataattattgtctgttatgatatggataaaagttttttattttatttaaatatacaattttaagggaattttgaatgtactattttcagctgcttgtacagcttgacaaaatgcgcgacgacttgcgacatgcaagtgcagcaatggcagggtctgtttcagatatggtttctctttcgccaaaaagcctcccaaaaattgtgttaataaaatgtgaaagaagtttttctagttaattaaatttgtatatttttttcaaaagaatacagctttttatgcatagataatttgatttttattaaatcgaaattttaaaagattccactcaaaaattacatctttttaaatactgtactagcttgaataaa

SEQ ID NO: 68814 - DNA, 2730 bp, Heterodera glycines
  Genomic contig location: Contig_ID=SeqID_8669; Location=102..2831; Strand=-
  SCN-specific regions: Sequence locations=1-161,183-563,620-759,913 -1009,1079-1193,1350-1546,1790-1950,1992-2171,2200-2307,2356 -2425,2465-2730
atgccaacagtgcggcaaaacataatgccaaagtcggcgagcagtgccaccaccaccacaatgtccaccattgcagtcagggcagaaccccattcgacaattgttgtcgcaattgttagggtaaaatacggctttttctattaattgtctgtccgagagagtcttaaggcctttggaatttctggttctcggagatcactaatatttccaaagtgtgaaatttctttatttcgaaaattgtggccgagaatttaatcgagaactaagacccccaaaatccgagaaattttttagctcgagaaaacaaaatcgggcgagaaatctcggttatgccaactgaaaatgtctatctctaaatttaattcaacataaaaatttatttgataattttgagttaaaattttgaattttggacagagtgtcggctttgtggaattgcgcattgacgagatggagccgggcctgctccaaattggcacaaatccaagcgagaatgggcaattgttgctgctccatgaggacctttacgcgcgactgcttggcaaagaggagcaggcaaattgaatttaattaaatgtttaaatataattgaaaataaatataatatatttattttttaggtcgaagaacttctgggacgggctgaaaaactggtcactgaacaaacggagccggacgacattctgatttatgaagcgatggcggacggattggccacggcttggaaaagcttgagcaggtccatcactcaaatattaaaaattaattaatttaatttcaaatatattaatttaatttcattatataaaaaataataatttttgaatttttccatgtaattaaaggaataaattaaatcaaattattaattataattcaattaaaatatatgtttaattaaatttaaaattattttttaaggcaattatcaatccggggatatattctgacagacactcaacatctttatgagatcgcattgaagcatgaagaagtaatacaattttaaattattatttttatatttatttttatttataattttatttttaagttttattaattttttcttacttttttcatttacagttagcaaaattggccaattctcgtttatgcaaaaatggagcaattcaatcaccagatgaattacagagaattattgatggtatttttaaaggaattttaaccgctttaaatttaatttttttttttaattttctaatccattttttccttacaaaacaatttttttacttctatattaattttatatttttgctgattttttctttaattacatttttaacaattttattattattaaatttttaaaaaaagaaaaaattgcgaactcagataggggcgaaaattagtcatcaatcagcaatcagatgaactattccaacaaacatcacagttcgcagtcaaccggattcgaaccagcgaattttgtacagacaaaatgaacagagttaaccgctagaccaaataataaaatgatgtgctcgatttttttaaatctaaaaagagaaaaaaagtaaacaaaaatttatttaaagaaaaaatttaatttatatttaatttgctattttttttacattatgtattaattttaacacttttaactcccaaaaataagaataacttttaagagaatataaaattattttaattatagaaaaactcttatttaaataaaaatttaaaggtttattctttagcaattttttaacttttttatgtttcattagactttaatttctttttttttttttttaaattttttgtagaattagctgaattaacgcgtgaaggccttgagattggttcaacagttattgcgcaaattcgaattttgggtgcacttactgacaatgaagaaaggccacgtgaagtgctcaatgcatgcctggccattgagaagataatgctaaggtaaaaacttacatatttaataaatataattcaaataaaataaaaaattttaacggcaaatcaaataatatttaataaactcggattattattttttttttcttacgtaaaattcctatgagagtgtaggaaatctttctgaatattagattttgggtggtggatatagggatgtgtgccgacgccctcaaaaaatctcggcaaaatcggcattccgacacatccttggtgggatatttattacttttttatataaaaaatcaaaatcccaaaatattaaaatcggtaaaaatgattataaacatggaattctgccaaaatcggaaatatataaggctaatttatatttttccgaattttcatgttttcaatttaattttattttttttataaaataaattaaaaatatttaaatatggaattctccattaattgaaaaataaataaggataataatattttttttctgaatttttaggtctatacctaatttaatttagattttaaataaatttatataaaataacatttccattttacattagaattgcacaaagctgggagctcattgaaaacaattggcgaattcaacgagatggtggtcaagtagttgccattgaaagtgccaaaaaggaaaagccggcaccaccaaaaacagtcggcagtttcagtgccaacaatctagtggcagccgaacaatggctgctgacagccgcacaacggtttgaccgtgtgcgcgactgtgaggaggacgaggagttggaactcgccattttgatcaccgacatcaag

SEQ ID NO: 68815 - DNA, 474 bp, Heterodera glycines
  Genomic contig location: Contig_ID=SeqID_8670; Location=793..1266; Strand=+
  SCN-specific regions: Sequence locations=1-14,36-74,109-280,302 -308,354-393,416-474
atggcaaaaatgcttcatttattggctaccattgctttaaccgccggcccaattgatgagggaagagacagcaaagcagaacgaggagaggaagaagaagaagctgcttgttggagttcaactgatcttttagtcactcacataaagccacagcgggagggaaaagcacacccatcggcgccatcactctttttcttttcctctcgacatcaaacactattccttgagagagtaggcttactacgcccgaggcaatatggagggttgttaatcaatatggaaatagaagccaatttggagagagcactaaacagacagacaggcagggcagacagacaagcagcggataaacaacgccaaaggcaatcaatcggatttatattttattgttgttgtggagattgatcctgaagattaatccgtgtcttatgggtgatcggataaattggaccaaaagcatcttttggtcgaaga

SEQ ID NO: 68816 - DNA, 568 bp, Heterodera glycines
  Genomic contig location: Contig_ID=SeqID_8670; Location=546..1113; Strand=-
  SCN-specific regions: Sequence locations=1-20,42-213,248-286,308-568
tgtctgtctgtttagtgctctctccaaattggcttctatttccatattgattaacaaccctccatattgcctcgggcgtagtaagcctactctctcaaggaatagtgtttgatgtcgagaggaaaagaaaaagagtgatggcgccgatgggtgtgcttttccctcccgctgtggctttatgtgagtgactaaaagatcagttgaactccaacaagcagcttcttcttcttcctctcctcgttctgctttgctgtctcttccctcatcaattgggccggcggttaaagcaatggtagccaataaatgaagcatttttgccatcgggggacattcaacgaaaagaagaagcggaggaatggacaaattgtcgtcccaaaatgtatttagagagcaaatgagcatcacattacaaacaattccatctaatatgtatccaaatttaaatcgactatttaagggatctctctatttttcccgaactccgaattcctaaatacctgcaaaaaactacaaaaaaaatatttttagatactgttgcttctacctcctatgttttcggctcgaaaaa

SEQ ID NO: 68817 - DNA, 49 bp, Heterodera glycines; identical to SEQ ID NO: 51181
  Genomic contig location: Contig_ID=SeqID_40504; Location=350..398; Strand=-
  SCN-specific regions: Sequence locations=1-49

SEQ ID NO: 68818 - DNA, 165 bp, Heterodera glycines
  Genomic contig location: Contig_ID=SeqID_40507; Location=21..185; Strand=+
  SCN-specific regions: Sequence locations=1-165
cagaaacgtgcacaattttccgcaccctgcagcaatggaaacagccaacggtcgaagacgacggcagacaggaatattattacaacaattcacgtagaaatgattattactgattggttgtgagtgagtgacatgggattgttacggaaagtttttctttgccca

SEQ ID NO: 68819 - DNA, 192 bp, Heterodera glycines
  Genomic contig location: Contig_ID=SeqID_40510; Location=119..310; Strand=-
  SCN-specific regions: Sequence locations=1-22,44-192
atgaaagccctaagtctaccgaatttttatataactaaattatggacaaaaggtaaaagacaaaaaattatcttgaatatactcttaaattaaattccaggttttctcattgaaatttttacgaagcaagaaaaaaattgatggcctaagaaactgagggtagtcactgactttgacgcacgcttaaataaa

SEQ ID NO: 68820 - DNA, 1058 bp, Heterodera glycines
  Genomic contig location: Contig_ID=SeqID_40511; Location=58..1115; Strand=-
  SCN-specific regions: Sequence locations=1-362,389-811,837-842,864 -1058
atgctagcacattcgcatgtgagtgccgaaaagtgtccaaattaccattaaggtaattccgttttcttctccctattttcagaattacacaaaagcttcgttgcaacacgtacaaaggaatctgatgaaaaacaatgtggcgccggacttgtttcaggttagaggtccaacttcaatggcattttgagaatggcaacttaaatttagccatatgtgacggaaatctgtgaccagttgaaggaggacgtgttcccaaaattcttggacagtgacaaattcacgcggtattgccaatggaaggtcggaacgaagagcaaagcgtaaaggggacgaacactcggccatttgacaatgggaaaagcaaaattcttaaatattcatttttgacccaatccctattcaaaaaacataattttgaatttggaaggaataatagcatattttcagaatttggaactgaacatgcaattggcgatgagcgacttttccggtagtagcacaaaaaggagaaaaaaaacaacaaatatttggccttcatttagttcatcgaataattggacgcggagggttcggcgaagtgtacggctgccgaaaggcggacacgggcaaaatgtacgcgatgaaatgcctggacaaaaagcggatcaaactcaagcagggcaagtgacgagcacaaaccaaacatttattagaacatttacaggggaaacactcgctctaaacgaaagtgagtgccaatcggcgcaaaatttgtcactaattgcctccgaccaaatgcagggataatgctgagtttggtcagcacggggcaggactgtccgttcatcgtctgcatgacatacgcatttcaggcaaacaaaacgccaaatgcacagcaaaacaaaattatattttatcagactcccgacaaattgtgcttcattttggatttgatgaacggcggcgatttgcactaccatctctcccagcacggcgtattcaatgagacggaagtgatgttttacgggtccgaagtcattctcggcttggaacacatgcacagcaggcaaattattaaa

SEQ ID NO: 68821 - DNA, 464 bp, Heterodera glycines
  Genomic contig location: Contig_ID=SeqID_40516; Location=442..905; Strand=+
  SCN-specific regions: Sequence locations=1-464
atgatgaaattaatccggcgattcatgttcttcgatttcttaaaggagcctttctgggtatttgaagacaggcccaaaattggcctcaattttgtcaccaggccaaaacaacgaaacacaagggaacagttcgggtgaagaagcattggcagaaatattgacagaacctgtgtaaaaatcaaaattaaaatttttgtgaaaaacaaataaaaactttctcttaaaattttgatttaaaaaattgtaatccccaaaaattgttattcaaatttaatcatattgagaatgaacgtaacaaataaacagttaggttacatggatacggtatttgggcaaaaaccaggtccgggtatcgccaggcccaaaaaagccgggttcgagtccaagtttttaaaccgagcccgggtatccggttgaaattgtatattcgagtttaatcatattgagtacgataatgcgtacaa

SEQ ID NO: 68822 - DNA, 483 bp, Heterodera glycines
  Genomic contig location: Contig_ID=SeqID_40519; Location=96..578; Strand=+
  SCN-specific regions: Sequence locations=1-461
atgagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtactaaagtgattaaaagaggtacaaaagttattagaagaggtaaaaaatgataaaagaggtacaatgattagaagaggtgcaacagtgattagaagaggtgcaacagtgattagaagaggtgaaacagtgattagaaggggtataagtgattgaatgtggtacaaaaatgattagaagaggtacaaaaattgaatgcaatttattataaattttaaaaa

SEQ ID NO: 68823 - DNA, 728 bp, Heterodera glycines
  Genomic contig location: Contig_ID=SeqID_40520; Location=35..762; Strand=+
  SCN-specific regions: Sequence locations=1-600,633-728
ccggtgccgctgcggtcttctgcgatgcggtgcccagtgtcgatgttcctccagccggtgccgctgcggtcttctgcgatgcggtgcccagtgtcgatgttcctccagccggtgccgctgcggtcttctgcgatgcggtgcccagtgccgatgctcctccagccggtgccgctgcggtcttctgcgatgcggtgcccagtgccgatgctcctccagccggtgccgctgcggtcttctgcgctgcggtgcccagtgtcgatgttcctccagccggtgccgctgcggtcttctgcgatgcggtgcccagtgccgatgctcctccagccggtgccgctgcggtcttctgcgctgcggtgcccagtgccgatgttcctccagccggtgccgctgcggtcttctgcgatgcggtgcccagtgccgatgctcctccagccggtgccgctgcggtcttctgcgctgcggtgcccagtgccgatgttcctccagccggtgccgctgcggtcttctgcgctgcggtgcccagtgccgatgttcctccagccggtgccgcttaatgctgcggcagtggacagaaggtagcgatgcttctgtcgtggctgattttttaaaatcatttcccttttcattttcagaacacggaagagccgcaaatgccggccggaccggaaggggcggaggccagcgccaaaccgacgggacagagcgcagcacctggtggaacttccgcg

SEQ ID NO: 68824 - DNA, 583 bp, Heterodera glycines
  Genomic contig location: Contig_ID=SeqID_40520; Location=1..583; Strand=-
  SCN-specific regions: Sequence locations=1-583
  Gene Ontology: Cellular component=nuclear pore; Biological process =pronuclear envelope synthesis
cggcaccggctggaggaacatcggcactgggcaccgcagcgcagaagaccgcagcggcaccggctggaggaacatcggcactgggcaccgcagcgcagaagaccgcagcggcaccggctggaggagcatcggcactgggcaccgcatcgcagaagaccgcagcggcaccggctggaggaacatcggcactgggcaccgcagcgcagaagaccgcagcggcaccggctggaggagcatcggcactgggcaccgcatcgcagaagaccgcagcggcaccggctggaggaacatcgacactgggcaccgcagcgcagaagaccgcagcggcaccggctggaggagcatcggcactgggcaccgcatcgcagaagaccgcagcggcaccggctggaggagcatcggcactgggcaccgcatcgcagaagaccgcagcggcaccggctggaggaacatcgacactgggcaccgcatcgcagaagaccgcagcggcaccggctggaggaacatcgacactgggcaccgcatcgcagaagaccgcagcggcaccggctggaggaacatcgacactgggcaccgcatcgca

SEQ ID NO: 68825 - DNA, 3642 bp, Heterodera glycines
  Genomic contig location: Contig_ID=SeqID_1151; Location=1186..4827; Strand=-
  SCN-specific regions: Sequence locations=1-415,437-1445,1492 -1737,1760-2956,3054-3543,3565-3576,3598-3642
  Gene Ontology: Cellular component=membrane; Biological process=lipid metabolism
cggcagcggatttcaaaatgcaagcgccagattggggcaactacgacaccaacggaaccgactacgactacatctacaacaactcggacgaacgggacaactggaacagcgagcaggccggcgtgttcagacatttagtgacccaggtagacgacgcgttgttcgatgaattgttttaatagaaattctcttttcagctcggcaccactcagactctgcagaatttggcgctgcccaccttcgtgctggaacgacgctctctcctcgaaatgtacgccgacttcttcggtgaatacattgctttttaaaatttttccaagttcaatcttatctcatttcagctcatcctgatgaactgatcgccggcgcctacgagaatacggctgagaaacggtcccgattggttgacgacaacgcttttgaatcaacaatttttcagattccttgccgtcctcaaatactacttgaactccttctatcctgcacgcaaaaccgacgccgcgaagaagccgtacaatccgatcctgggcgaagtgttccgttgccgttggaccctgcctggcgtgccgttgtccgcaagccgaaccgccggtggaccgttcccgggctcagcaaccaaccaggtccagtttgagtgatagcctcgtcactcattgagaaacctaaatctgttcccacatttcagatgacgttcatcggcgagcaagtcagccatcatccgcccatctccgccttttacgtcgaacatccggaatccggcgtgacctgcacatcgcacatttacaccgagtcacacttcgctgggcttacatcactgggcgtccgcaacatcggccgggcgactgttcgactccaaaacgtgagttttgtaattttttgtgccatttgttttatggttttaatcgtttgttccccattttcagcacaatgagacgtacatggccaccttcccagatgccttcgcgcgcaacgtcttcggaaggccgtggtttgaactcgctggaaaagtgggtccatttcgctcgattttgctttttcagcaaacaaaatttttccacacaggttgaactcagctgcttgcaaaccggatacagtgccaaaatcgagttccaggcgcggcccatgttcttcggaagtgcgcaccaaattcatggccaagtctaccacagggaggtggcggtgatgcaactgaaaggcgactggcgaggcgaaattgtcctgaagcgaagtgcccgcagagccttcgaaccctttacaaatgtgcgggcgaagtgcgacgtgacaaaggttagaaaatgcccaaataaaaatgaactttaatgcacccatttctaatttccacaggaatgtgtcagggtgctggaccagaagaacaacgaaagccgaaaattgtggcgtcatctcaccgctgctctgtacttcaacgacacaaaaatggcgaaccaaggtgggaggggagggaggaatttggattaagaattaattagttttccccttgttttcagtcaagcgcttcatcgagcaacaccagcgggacgaggacaggcgacgcaaagaacaacggagaccccagtggaggccgcgccattttcaacgcgttgggactggtacgccgaccgacgcctggagataccgcgacgcgcaggaatgaatgtgatggcgattcgtgcacacctccgatgctgcctgatgtattaaaagaggatgtttgtaaatcatttggcccaagttgcctccatgtataattgtatatgcatatatcacttggccctgagttgcctctctgtgtattttgtatgttattgcgactcactattgtacatttcctacatatatttattaaaaatgaataaactaattctttatgtgttgtgagtgggttgatttcgtcaaaacaccttcccgggtttctgcagggttactgatcacgaaatgacattcttattgatcgggtcgatcaatgcgcagtgaccatagatcgctcgctaattaacaataatcaaatgccacactgatcagtgttccgttgcgcagctttgtctcccgcccgttccgcgcaatcgcctcgcggttcgtcgtccctgcttaatgcaaccattcctctccatgccaacaatgccaatgtttcgccttttctgttgtcccctgagcatgccgcttttccccattggcaccaaaggtcgcgctcatcagacagccccgctgggtaacgatttagcggttttttactcctccaattgaaggagtacggcatgttacagttgtattaaaatgcaggaagccgctgtcccccaacgatttggctgaccttttgcgccgtcaccccgtccccgtcgatgggtccatcactaatccttcctatgtgccaatgcaggaaaaccaaagcatcaaatttgtattggcatttctcatttttgacagtcaattaacaaatttcattaagctgatcccgaccgcaaaagtcactcatttggccgcttcgccagcacctcaatttgcagcacaacagcaagaagaacggacaaaaaggccaatggcaatgccacgggcggaaagtgcgaagaaaaacggcggagggacggaagacatttcattgcgctgcccaacttcgcaggcgccggtactgaaccgagcggaaatggcagcggagggattgccgggggcattcaatggtcggtgggcgaggaatttcgaatattttcagacttcctttctctctcgtcagatttttcgatgtccgtctccgaacagtgccgtcccaccactctccgacttggccacccgcctttgccgccttccgtgccgtcgcccgacatcgcctccgtctcttttggcctgcccacaaccaatagcatggccaatggacagaacggcgccggcggatgggacagcggaatgtgcgcgagcagcagcaacgagggggtgtgaaatgagtgacatgggggaaggaggatatagagagagagagagagatatagagagagagagagagcggagatagggagacagagacaacaaagtgacagagtgtgtgtgtgagagagagagagagataatctgacagaaagtgagaggaaatgaggaaagagagagaggggggggggggggagaggtgatcagagtgatcggtcaacccaattttggttgggacttcgatcaactgattataagtgccattgtcattagaacggatcaagtcattaatcaccttatctttcccattcctatcaatcaaatgttttctcaggacgattgttctccccaaatgtttgccccgccgaaaaacgtcgcctccggcgactgttcctccgctaccgttttccctaccgctgcgccgcgtgtcggtccgctccgctcgtccaatgcttctcaccctttacacatttcgccgccctttccgccccctccggtgccgcccaaaacgcggaaggacaaagaggggccgcgggtgccgccactgccgcgcaaccgacggatgatgaagcaatgaccgcacagaaagagacaatgcaaatgattccattggcctcggcactttccactcattgtctcgctgctctctcccaaatacctattctttttcctttgtctgtctgtccactctccgctttaccattgtgccttccatttctctctatttga

SEQ ID NO: 68826 - DNA, 1147 bp, Heterodera glycines
  Genomic contig location: Contig_ID=SeqID_8674; Location=163..1309; Strand=+
  SCN-specific regions: Sequence locations=1-4,40-558,702-865,887-1057
atgccctgctcgtcctcctcctccccctcctcctcttccgccgcttcgttttcctccgttttccccgtccctttccccgcttcccatccatggaatcctttcgcttctgccgccccttttgtcatcgcaattggcagtggttctgtgtgcgtcaaaaatggcgaatgtcgccagtacaaccaactgaaacgacactaccacgagtcagcaccggtcgcagcagaagtgccatcagtcgacgagggaatgaacgcgacggacaaaaggagaaagaaacgcggaccatcggcactcgcaactctttccgcccttttgctgcttggcgtggcgctaattgtcagtttggcattcgtcgcgtggacaatccatcggatggtaaacgaaaagaaaaggccaaacgatgccagggaaagtgggaaaattgaattgcagaacgaacagcacaaagaatgtgcggaagcgatgaaaacacaagcggaacgaatcgaagtgttggaaagtgcggtgacaaagcaaaaacggacggaggaaaaggaaacggaagagccaaatgacaatgggaagaaaagccatggtaagggagggaaaagcaatggtaagagaaaggaggaaaagcctggtaagggaagggaggaaaagccatggtaagagaggggaaggccatggtgagaggagggaaaagtcatggtaaggagggggaataaattacagcggcaggtgtcagcgaatggaactgccaaattcggaccaaatgatttcggcgtttttagacaaaaaacgccgcgacaacaaaacttcggctgagcagcaaattgtcaccacgcaaagtaacaattgggaaagcagtggtgaaatgataattgtcacaattaaaataaataaaaattgacagatcgtcgccaattttcgcagcgaaaacagccaaaagaattgacgggaaacggcggcagagattttgtgatttttatgaagggacggccaattagcggaagacatttcatggcgcaagggaaaaaagcaaagtgaaagaaggcaaagggagaacaaaaaacaaacaattttaattgtcatttctcattttaattttaatttttcatttttatttgtttaagattttatttttcaatttaattaatttgtaaaagga

SEQ ID NO: 68827 - DNA, 373 bp, Heterodera glycines
  Genomic contig location: Contig_ID=SeqID_8674; Location=1322..1694; Strand=-
  SCN-specific regions: Sequence locations=1-61,84-373
atgtgtgcccagcaggaagtgcaattcaatcgaatttggcattacgataacgccaaaaacattcattttgggagagggcgaaacgtgacgaatttgaaatggacaaatggcaattttgaggaagaaaatggacagaaaaagtggcaaaaattgggggagggaggagagaatgacaatggagaagcatttaggaagaacgaaaacggacgaaagcatcagcaacatcagacggtgttcccggcagagccaattccgccgaagagaacggcgagggaaaggacggaggaatacgtttgaatggaacggacaaaatggcaaaaggaaatgcaaaattgtcaattggtatcggacaaaatggcaattgacaaataaa

SEQ ID NO: 68828 - DNA, 432 bp, Heterodera glycines
  Genomic contig location: Contig_ID=SeqID_8675; Location=1593..2024; Strand=-
  SCN-specific regions: Sequence locations=1-13,105-139,312-331,428-432
  Gene Ontology: Mol. function=protein binding; Cellular component =axoneme; Biological process=N-linked glycosylation
atgaaaaaggcgaaggaggaaagagaagatgaagagaaagaagaggaaaagaaaaaggaggaggaggaagtggatgagaaggaggagcagaaagtgaaggaggaacagagagaagatgaagagaaaaaggatgagggaaaggggaaagaggaacagaaagaagaagaagagaaaaaggaggaagaggaggaggaaaatgtggaggaggaaagggaagattataatgaagaggaggaggagaaaaaggaggagggaaaggggaaagaggaacagaaagaagaagaagagaaaaaggaggaagaggaggaggaaagggaagattataatgaacaggaggaggagaaaaaggaggagggtaagtggaaggaggaggtggaacacacagctgatcaaatgggggaggaagaagaagcagaaaaaggaagggattaa

SEQ ID NO: 68829 - DNA, 560 bp, Heterodera glycines
  Genomic contig location: Contig_ID=SeqID_8677; Location=865..1424; Strand=-
  SCN-specific regions: Sequence locations=1-83,105-342,372-560
  Gene Ontology: Mol. function=metalloendopeptidase activity; Cellular component=mitochondrion
atgagcgagaaagtcggtccggtgtccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggttcgtgaaacagtcagaaatagttaggagagaccataagcatttacaaaaacggagaaaaatttgaccttcgtatgaaaaatcgggcccgagacacccccctgtcccaatcgtccgttgtatggcccttgggctgagacaccccttgtgcatgtatgattcatttcctttcatttttcttatttttaggttgctcttcgactgttggagaaggaaatcttggcaagggaggacatgatcgagttagccacacgtttccttccctttaatccttcactttcacagattgttgggtccgaggccttttgccgagaagcacacttatgaggagttcgtggcaggcacaggatcaatggatgaggacacgacgctgccgaaag

SEQ ID NO: 68830 - DNA, 962 bp, Heterodera glycines
  Genomic contig location: Contig_ID=SeqID_40524; Location=7..968; Strand=-
  SCN-specific regions: Sequence locations=1-153,179-326,348-349,372 -563,585-790,821-925,947-962
atgcatttcatcgtccggctcgcgcagcacagtctcgcgcacggcgtcgcccgcactttcttcgacttcgtccaatgcctcccgaagacagaggaagaattacaacaaaagtggacgcgtaccggtaagaaaaaatttgcaaattcaagccaaacacacacacacacacacacacacattcacttcctagataaatgtgaatgccgattgccccaatgttccgcccggtgtactgccgaacccaaaaactcgccagtaccaggtcaagagcgttttggcgcaattcactcatgcatcggggaggaaatgctatttcttggagtggctcggtgagtttgatgatgaaattgaaagaaaaaatgtgtgaatgaaaaggtggacggatggataaggaaattgaaaatttattgtaaaattccaaacgtgtgccgagttaacctggtttagcttcgccacttttggaacggaataatttgagggtgtgggccgagttaacacagtttagcttcgctacctctcttgctatttcactttaaattttctttttctttttccattaaccaatccattttcttctctcattttttctcgcaattataggctttcgcggtcgcaactcatggtgtttgtcggaggacaccgactgtacagagtacattgaaagatttgggacagtggcaacagtcgacgctgtactgtctgcgctattgggcgaaagcgtcccagcttcgatagctgatgagctccagaccaatcctaaatttggacaaggtgtggagagtgaggggaattaaaaattgcataattttttgtcagtgttggcaaagttggatgacattgaagatgaattcatattgcggacaactcagtataatattttgttcgcaaaagagcttatggaaagcgccgagggccaaggaataattgaggaagaagcacacaaatgcacttttttaatttaa

SEQ ID NO: 68831 - DNA, 966 bp, Heterodera glycines
  Genomic contig location: Contig_ID=SeqID_8679; Location=598..1563; Strand=+
  SCN-specific regions: Sequence locations=1-577,599-649,726-966
acatgctcaacagtggtaaagtatttgaatagagtggtgcaaaatgccgacaaatgcggcatcaaagactgcgtggacggggggaatttgcgcgttatcctcgcggagctcggcgacaatttctacgccaccattttggcccatgcgctgtccttcgcttacaatttggccggtgcgatgcttttgctgtgcgacgtcagcacgtacaagtcggtggggcgggcataaaaccaggctattattatttcccattagaaagtgcattagcgcctggggaattgccgagttggagaaaaagttcgacagtttgcacgcgttggccaaccttttggtggtggtccccgataatttgccggaggcgtgcaattcccaacttgtggtgagcagtgaaaagccttggggattttcaacgaaaattcaattaaaccgatcggtctttaagaaaaacgtggaccgtccgttgatgaacgaatttattcagcgacgccacgactacaaatcggctaaactctttctgaacacttactgaaaagtcaatttactaacaattacggtggaagtgcaattttcttgtctttttgatgctgtgatacattttcaattataatttatcttcggaggaagaaagaaccaatttaaaaaatatattttttatttttttgtatttatttttttttataattatattgatttaataaagtttggttttttctattttattttgtaattctgctatacattatcagatggatgccatttattgtaacaagaaataaatttttcagaaaaccgttcagtgatatgacattttatggttcttcggcgctgccaaatggaacgaagggcccaaatgccgacgactttttgtacgccaatggcacagattcaatcgccgcatcgaccgccgaattgtcaaaggacgaaatgtttgtggaggatttgttgcacgcgcacgaggccaagtaa

SEQ ID NO: 68832 - DNA, 105 bp, Heterodera glycines
  Genomic contig location: Contig_ID=SeqID_8680; Location=341..445; Strand=+
  SCN-specific regions: Sequence locations=1-105
tgaaaagaagcgtgtgccggcgtggtgcgaccgcattttgtattgggtcaaggacaaaaatgtcggcattgaacaagtgacctacgaatcggcacaccaaggcaa

SEQ ID NO: 68833 - DNA, 138 bp, Heterodera glycines; identical to SEQ ID NO: 50950
  Genomic contig location: Contig_ID=SeqID_40533; Location=457..594; Strand=-
  SCN-specific regions: Sequence locations=1-138

SEQ ID NO: 68834 - DNA, 121 bp, Heterodera glycines
  Genomic contig location: Contig_ID=SeqID_40534; Location=641..761; Strand=+
  SCN-specific regions: Sequence locations=1-58,80-85,107-121
ggttaaccataatggtttccttaaaatattagtaaaaataaaaacaaaatgattatgtaaataaatttctttattccttttttggacaagaaatgcttaggaaaattttttactaaaataa

SEQ ID NO: 68835 - DNA, 676 bp, Heterodera glycines
  Genomic contig location: Contig_ID=SeqID_40539; Location=23..698; Strand=+
  SCN-specific regions: Sequence locations=1-38,61-101,124-676
atggatgtaactccaacgttgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagcctcgtgctaggccaagcacgggccctaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccaaccaagcgaggcggcccgccaccgacacattgccacgcagcagccatacacaggctttcacatgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggttgtgccaacgctag

SEQ ID NO: 68836 - DNA, 933 bp, Heterodera glycines
  Genomic contig location: Contig_ID=SeqID_40539; Location=1..933; Strand=-
  SCN-specific regions: Sequence locations=1-6,42-788,811-851,874-933
tctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcacaaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggttggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgaggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcaacgttggagttacatccattggcacgcctggttcagggtcg

SEQ ID NO: 68837 - DNA, 165 bp, Heterodera glycines
  Genomic contig location: Contig_ID=SeqID_40540; Location=159..323; Strand=-
  SCN-specific regions: Sequence locations=1-16,38-165
atggcagccgacggcaagaaaattgaggactctgagcggccatttgtggtttggcagcggttggacccatcggacaaattgggagcgccgaaaccggcaccagtgccatctaaggtcaaaccaagcagcggacagtcgccgtctccgagtggcattgagaggcgc

SEQ ID NO: 68838 - DNA, 853 bp, Heterodera glycines
  Genomic contig location: Contig_ID=SeqID_8681; Location=537..1389; Strand=+
  SCN-specific regions: Sequence locations=1-155,179-330,363-694,716-853
  Gene Ontology: Cellular component=membrane; Biological process=lipid metabolism
atgatcggagttctgggccttggagcagtggttgtttccttatgggacaaattcaatgacaaacgttacagaccttttcgcgcaaccatcttcagtctgatgggattaagcggtaaatgcttacattaacaaaaattcaggaaaaaaatatggaattttgtgtctttttaaggcatcattccgacgattcattttgtgtatacggacgggttccgtcagttggttgctgagacttccttttactggctggtcgcaatggccgtcctctacttgttcggtgctcttctctatgcgactcgaacaccggaacgtttttttcgtatgcggaacaaaaaattttaattttacatataaaataatttcagcgggaaaatgtgatctgctatttcagtctcatcaattgtttgtccatttaactaatttttgtggaattaatttgttaccatttttttttttgaaggtttcatctttgcgttgtttgtgcggcattcactcattattatggcatcagtgaggtaagcaatcccggaaaaacgggagaagtacccgagtcaattttcaagtcccaatcccggacatttcaaaatttctggctctaattaacttcttttttagatggcgatgaatcgactcactggcacttgtcacattagcaccccgtcatcttcacatattcacactgaactttaggcgggcagcaagcaaattttgttgaacaatgtgtgataatagaaagactattgtatttggatgaatatgtgttgcctttgcctgctgtaatctgtgctgctttcttttgctgcttatatataatattatattgtcatgtcattgtagcagtataggaaaccga

SEQ ID NO: 68839 - DNA, 136 bp, Heterodera glycines
  Genomic contig location: Contig_ID=SeqID_8682; Location=792..927; Strand=-
  SCN-specific regions: Sequence locations=1-136
atgttcttcttttgctgtgtgtccattttgggttatccgacttatgtgatgctgaaccttgacaatgtgcgtccgttcaagcagacgcacttcaacgacgagctcaatgagaagctggaggagcgccgtcgcttac

SEQ ID NO: 68840 - DNA, 811 bp, Heterodera glycines
  Genomic contig location: Contig_ID=SeqID_8683; Location=581..1391; Strand=-
  SCN-specific regions: Sequence locations=1-411,443-811
atgaacactgcgatctcaaaattatttgaattgaggcctgacccatacgataattcgcaaagaaaatacttgcgtctttgtttggtaagtccatcggttttatttaccaattaggtatccttctacaatacattcagtttttgaacgtggaaaatgcatcagacttagcggatcttgtaaaagttatggatattgcattgattcgcgcagaactcgtaattcatcatactttcaaattggactgttaatttatattatttacaggtacttgagccttttatactccttgtagcagcgaatcgtgcactttttcaagccgctcacaaccaactttcaactcgtacgtgaattcgtccaaaattgctataaaaaaatgtctcgagggtaatagtttagatggtgctacacaccttttttaaataaatttttatagtttataaaagtcgtaaaaacacatttctagggtgttttcggggatgccgatcccgaaaatgacactttcgagtgattttttttcattttttaggttcactgtctgctgaactgatttactgtctttcgcccaatcgtaatattcgcgagtcgttggccacttttggcattgctggcacaacccgtgctctgttggttgcaatatttgatgatgccaaagggaagaaaatgcgtgaagccgccaaacatatcaaaggcacaccggtgacattagaaaaattgagggaaaacgctgacgaggcactaatcagacaggtaattaatcaaactgtggcgtattatttcggtgaactgccgatgctaatttatcactggatgg

SEQ ID NO: 68841 - DNA, 788 bp, Heterodera glycines
  Genomic contig location: Contig_ID=SeqID_8684; Location=316..1103; Strand=+
  SCN-specific regions: Sequence locations=1-513,535-788
tgcgacgtcaagaaggcggtgccacaaaacaaacgcaatggtggtgctggtgccgcgtcgttcattcgtggcggcaacctgatcatgcgcaacgcgtacattggtggtggtgcggctgcgcaccatgccagcattggcatgggcggtggcggcggttcaatgcgaggttcttctcatcatcacccgcagcaggtgggggacgctttttatttgttttttcattttttgtgttaaaaaaaactcattcattcgctaattcatggaatggttattaatatcctatttgtgtacggaaaactttgattccatgatccgatttggtaagggaatcgtgtttccaaacactgtcatctttttttcaagggggagaaggttgggtcaaattgaatggtttgaggaaccttggcaaattcggtgttcttttggactcagttttagtttttttgttgttgttgacaatgtgttttacagggctgcacgcaattacggattttacggaaaaaaatacggtgcttttttgggagttaaaattttactctattatcccccgcataattaaaaggtatatataattaataaagtttttttcattccagcaaatgcccatgtattcaaatgcgtctgccgcggcatacgcccaatggtactacaacgcggcggccgctgctgcatacggggccggaggatatctgtcataagacatattagtctaatttatgatttcgacccatcaacgattgatttttcttttcatcaagtgcttcattttcacccgcgtattgatgaga

SEQ ID NO: 68842 - DNA, 80 bp, Heterodera glycines; identical to SEQ ID NO: 51817
  Genomic contig location: Contig_ID=SeqID_40543; Location=229..308; Strand=-
  SCN-specific regions: Sequence locations=69-80

SEQ ID NO: 68843 - DNA, 165 bp, Heterodera glycines
  Genomic contig location: Contig_ID=SeqID_40544; Location=857..1021; Strand=+
  SCN-specific regions: Sequence locations=1-165
atgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggg

SEQ ID NO: 68844 - DNA, 388 bp, Heterodera glycines
  Genomic contig location: Contig_ID=SeqID_40544; Location=185..572; Strand=-
  SCN-specific regions: Sequence locations=1-367
gcttaaaaacattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaa

SEQ ID NO: 68845 - DNA, 275 bp, Heterodera glycines
  Genomic contig location: Contig_ID=SeqID_40544; Location=796..1070; Strand=-
  SCN-specific regions: Sequence locations=1-20,42-275
aagggagggatggttagacgaaaagaggaatttttagataagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaattatttcaaaaagccaaaaaaaa

SEQ ID NO: 68846 - DNA, 1244 bp, Heterodera glycines
  misc_feature (37)..(37): n is a, c, g, or t
  Genomic contig location: Contig_ID=SeqID_40546; Location=63..1306; Strand=+
  SCN-specific regions: Sequence locations=1-143,165-649,673-1057,1200 -1244
atgtcacaaaatgaatccctcgacaacgcacaacacnagcaacagaaacagcagcagaacccgaacacggaggccgaattggccttgcaacaggcccaagttggactcaatctcttctggctgatccaacaagcggcagcgatgcaacagcagcaacaacaagttgaagaaggacaaggaacggcaccgacttcctctttaactgagtaaatgacaatttgagctcggttaaatccatgccgagttgtaagcagttcgttcttttcaggcgacagaatgtgtcgctgcactcggcactttccaatttggttggctttgctaaggcatcgtcgcctccaaattgtccgtcgccttttttactgccgacacaacaacaagcaaatggaattagtactttgaacgatgaaaaaaggagaaggtgatcggccgaacttttcgggataccgtacccaaaaaaaggaaaatcggtcatttccctctcctctggaaggcgtcagtgactagtgatcagccttgatcagcctgcattcagtagctatcggggttaccgtacccataaaattggccaatccgggacgaccatttccctcgagggactgccattgactaaaaaagagctgcgcacgcatcgccaattccaatcttttagagatttgtcaatcattgggagacggtgggagtatgtgagcgacgtgcagagcttcgtcgagttcgagcagctccgctgccggcatcaagtgtcgcgcaaccgcacattcgctcacggcattcgctattcgtgcacccaaaagacccaactgagaagcaattgcccctatttgctgttgtgcttattctctgatggagcaggtccaattggtgggagatttattccaaattaattagccaattacaggcgaacacagtgcgccgggggtcggcaccatttcggtgtactctcgaaacaaacacacgcacccggtgaatggcaaggggaaggtgccaattcaccaaaagcattccgagttcaggtcaaagtgatcaaagcgcgacagccgcgacgattcgccaaattggcgaaaagagaaaagaaatgggacaaaaaggaggaggaggagcagcagagaaatggaaaaagaaaggggggaaacgaaattggcgaacccaaagagaaagaaggagacgaagagaaaggaggcgaggcaaaggaagaggcggaaatgggcggaatggcgggagaagcactgatcgaatactctcaaaat

SEQ ID NO: 68847 - DNA, 289 bp, Heterodera glycines
  Genomic contig location: Contig_ID=SeqID_40551; Location=22..310; Strand=-
  SCN-specific regions: Sequence locations=1-289
ccttaatccaccttaatgacccctgcccctccatcgcatttcacttaagcttcaatggtgccgtctccggttatgacggtggtcccttttctgtcggtggtggcacttctgctgcagctgacggtggtcgaccatggcggcaacatcaaaagccaacaccaccactaatggtggcacaacaaaatgccgtagtgcagcagcagggcaatgctgatcattggcaaatgccgacaacaaatgggcccgaaatggaatggaagggaggagaagcggcggcgaacagtgacgg

SEQ ID NO: 68848 - DNA, 597 bp, Heterodera glycines
  Genomic contig location: Contig_ID=SeqID_8685; Location=7..603; Strand=-
  SCN-specific regions: Sequence locations=1-289,311-459,481-597
atggtactaattattattctcatatttttcgccacttttaatgggatttttggggttggagaaggtggtgaagaaaacgatttgttcagtgatttgtggaagaattgtttcaacgcaaaaaacgttcagaaggcaaatgttggccgaaacggaggacaaaaagtgaccaatcgcgtaaagatggaagaaagggacggtggtgtagaaatgggtgcggttggcattcgcatgccacccaaattggcacaaatgttgatcaaaactgaaccaaccgcagcagcagcagtttttgatcagctattgaaaaatgtaaagcatgagccaaaagaggaggagtttgagcaattggacattggaaaaatgggtgtggttggcattcgcatgccacctaaattggcacactctgtgatcaaagatgaaccgccatttgatcagcagagagagcatcaacaaaagcaagcaaataaagagccaaatcatttggactatgggatagaaagaatggaagcaacagaaaattcattggaatcgaatgggaaaattagccaaaaaagtgccaaaaaaggggcaaaaaagaaaagtcaatggcaaaaggaa

SEQ ID NO: 68849 - DNA, 378 bp, Heterodera glycines
  Genomic contig location: Contig_ID=SeqID_8685; Location=1203..1580; Strand=+
  SCN-specific regions: Sequence locations=1-55,77-91,126-277,299 -336,359-378
atggtgagtaagcactaattaaaacaaaatcattatccaaatttcctgacagcaattttaagcaaattcttttttcagccaaaaaatacagaaattaaaaataataattattattataaattttacttttcagaaacttggacaaaactttatttttttatcaaataaactttgtttttgccaaattaactctgaatgcttaaattaaataaattgatatgatgcactcttgatagctctattattttagaaaattctaaatattagtttgggtaacaaaaaagttatttccataaatctcaaaaaatgattttttaattgcagttttggcgccgcttaacttttttaaaaaaggttgaaacattttaattttggcta

SEQ ID NO: 68850 - DNA, 2938 bp, Heterodera glycines
  Genomic contig location: Contig_ID=SeqID_8686; Location=345..3282; Strand=+
  SCN-specific regions: Sequence locations=1-12,119-123,237-363,394 -409,431-856,878-895,917-1247,1270-1295,1317-1402,1424-1565,1588 -1609,1631-1667,1689-1880,1902-2042,2064-2317,2342-2343,2375 -2670,2694-2702,2733-2804,2833-2938
  Gene Ontology: Mol. function=thioredoxin reductase (NADPH) activity; Cellular component=nucleus
atgtcaatgtgtgagaaagagaaagagaaaaagagagacacagtggtacggaaaggaagagaaaagagaatgggagacagaaggaatgaagggaaagtgagagagcaatggagaaaaatattaggcggacaaagcaagacaaaaagagggagaacagagataaagagagcgagagaggtaaaagacgaaaagaaagggaagaagtgagcgagagagaaatagagagggagagagagtaaaatggtaactgcgataacaaaacaacaccgcagctcaactgttgatcactttgatcaaaaattaaacattcctcatcctaaccactgttactcataagaaaatgaattaatattttttgcacaaaaaacaataaaaattgagaaaaataattttattaatttctccccatttttatttgtaaaaagaagatggcacaactgttcgaaaacattggcgttcgacgcaaagctgatgacaaattggtgaacgggcaagaggcgctaaaggtcatatttggaatgtatcggggaacccggattgggactaggccggattttccagcatcccgattttttgggtccactgaacaccattaattacctaaatgccatagctcctggaataaacaaatggaaaagccataactttaagcatttttaacaaactaaatcattgtctattagtcggaaaaaattcaaaaaattgcgctaaattgtggaaaaacgtttgaaaaataaattttttgagttttttagtcgtatttttaaaaaattagcggaaatttcgtaaactaatagaaaaacacttatgattatcgaaagataacaagaaataaaaattttttgctttgtaacgaaatggttttgttaaaaattttcatatttgtgttttttaataacgaacatttcctgtggtttttaagactcaacccccactgacccatttttaaatgtcccaattttccatcaaaatgcccattagcttaataatgcaatcgccggtatttagggttgcgaagtggtggcactttatttcagtgcccattggtgtccgccgtgccgcaatttcacgccggtgctcaagaaattttatgacgaggtgtgtccgaggggatgccatggccaaaaccaaagttcatagcacaggttcaaaagcacggcagatttttaagcaaattttcaatgcaaaaatttaaaaaaaacacagatttatcacaacttttcggcaattctatagagtatgagtcgaaaaattaaaattttttattgtcaaatcaaaggaaaaggagatttttgatttgcaaagattttaaaagggtcccccataggtcttgcaacaaaaaacttatttttttacccctattctgatttttgtgtcgtcccaaatctaagaggagcaatagaaaatttaaataccccaaaaactcggcatggacacttagaacttggaaaatgccaaaattttccggcatgcagttaagcataagacattgcctgactttaccgcaatttttaataaataggcttaattaggcgctgcttacttttaaactctttgaggcatacaatatatttaattaattaatttctgtccattcgattttagggataaataacaagtataaaaaactattcaaactcgggaacgacaaaacaaactgaaaagtgactaagaaaaacacattttttcccggatataaattaatttttttccactttttgcaaaaaaaaaaaaatttagttgaaaaagtcgccggagacggcgcactttgaaattgtttttgtgtcctttgatcgttccgccgatgatctgagcaactatttgcgcgaatcgcatggtgattggctgtacattccgcttggaagtgagcacatcgagtaagtggaggagggcattcgtgtgtgcccttttcaaggaaaaattttgcaaaaatggccatcacaggaaagggaagaaattgggcctcacgaccaggatgaggatttttaaaggcggaaaattttagaattttagttgataattttaaaaaatatggtttttctatgaaaataattaagattaatgcaaatgatttgttttcctttgttgcaattgaaaaagagtgcaatttaatattctttgaaagaatgaaaatataaagcgatttttggcttttttcagcaactttaggatttttttttttgaaaatttaaaaccgatccttcgggttgaagagatgaataggagcgttaaaataaatacacaatttttttttcatcagctaagacttcaaccatagtcagaaaactcaggaaagacagtaacaattgaaaataggtaaaataaaaattgccatttctgatcaaatttttattaaattcatttatttaaaattggatggtgtaaaacaatttttaacgaattcacaaatctacagaacattgtccaaaaaatttggcatcagtggcattccggcattggttgtgctgaagcaggacggcactttggtcaccaaggatggtcgagcggatgtgcaggtggaggacaatttgttgttttttgatgatttttctaacaaaattggacaatgagacgcggaattgaaattttccaaatttgaagggttgggggcggtcgattcagtatcgtagcaatttacacttggctaacttccagaatcatcgaactcgcaaaattaattaaaaatttaaaaagttgtggtcaaaaatttaaaaaaaaaaaattttttttttgaacatttatttggtcgaggaatttttgtaaatcaaaagcaaagcacacagatgtgccgactttttccttcatattttgtttattttttcacttggaaaagtaaattcctggcccctgttgaagtcccggtcctgacttttctggtcctcgcaaattcctgcccttttttccttaaattcccggttccgtgacagctctaaattaa

SEQ ID NO: 68851 - DNA, 57 bp, Heterodera glycines
  Genomic contig location: Contig_ID=SeqID_40552; Location=13..69; Strand=+
  SCN-specific regions: Sequence locations=1-57
gctatagggaagctactcccgaaggattcgtgtctccccataaatctgggcgcatcg

SEQ ID NO: 68852 - DNA, 674 bp, Heterodera glycines
  Genomic contig location: Contig_ID=SeqID_40554; Location=626..1299; Strand=-
  SCN-specific regions: Sequence locations=1-674
atgggtaaaatttttcataaattttacaaaaattttggatttttttctcttttttcagatattgatgatgacgtcatattggttaactctcagtcatctcacgcagaggaacgccctgtgctcaagaagaggggccgaaagtctcgctgggaaaaactgctggaggacgtgaacaacgcaaagaagtccaaccccgcagaggttgaagtcacagatgtcgacgaacgcaaagcagccaacgtcttcgactacccaacaattttctggaagctcgcacgcccaaaggtaatgtttgctctggtggcagccctacaatgttcttcttccgttgcagtatggggtgttcacctttatgtgcaacgaatgccgtaacgaaaacttcaagcgaggcgacaagcgcttcatcctcaacactggcagtggccaagagaagctggagttcacccaaacattctgccaagactgtgccaagttgaactttgactgcaccgacctgatcatgaaacaccaaaagaaagatgacggaccatctgcacagaagaacgtaggacggaacacctattttaagatggaaaagtgatctctgatcattcattcattgatttttcgttgaaatgagcaactctttctttgtaattttgcccagcaatacgccgggatttgtcggcaataaa

SEQ ID NO: 68853 - DNA, 56 bp, Heterodera glycines; identical to SEQ ID NO: 52733
  Genomic contig location: Contig_ID=SeqID_40557; Location=605..660; Strand=+
  SCN-specific regions: Sequence locations=1-56

SEQ ID NO: 68854 - DNA, 669 bp, Heterodera glycines
  Genomic contig location: Contig_ID=SeqID_40561; Location=80..748; Strand=+
  SCN-specific regions: Sequence locations=1-16,39-59,81-248,270 -378,415-536,568-669
atggagcccggtgcgaagaagcgcagaaaaaggaagaatgccgaaaacaccgacggcgaggctatggaatgcgaagaagaagaggatgccgtagatgaggacgccgagaacaactggatgctggggtatgaagaagccggggagaagccggagtcggtgacaacatacgcgtacgcccacgccggtaattttggaattattttaaaaaaaaacttggaagaaataaaatttaaaggttcccgctacgatcatgtgctgatttatggtgaaatgctgcgcatgggtgtccgccctgaactcatccgccaggggaaccatctcctggaaatgaaggcccgcaaaacaggagtctacacaaccaccgttttccgggacaggtaaatattttgaatattaaatatttttaaaatttttgatcactttagttacaagttgatcccaataaaacttgccaattttgtcaagacgtttggcctagaaattgagggcgtggaaaacaagaaatattttccacacaaattcaataaggtaagaggaatttataaaaaaattaaataaaaattaatacaatcttaggcggaaaattatggcactgtgttggacaccctgccaccgattgagaattattacctcaggtggactcttcccggcagagcgcgcaaagtttga

SEQ ID NO: 68855 - DNA, 3890 bp, Heterodera glycines
  Genomic contig location: Contig_ID=SeqID_8687; Location=555..4444; Strand=-
  SCN-specific regions: Sequence locations=1-158,180-253,307-710,732 -732,754-798,820-992,1034-1155,1188-1282,1304-1389,1421-1676,1698 -1721,1744-2108,2149-2670,2718-2850,2872-3043,3065-3089,3134 -3334,3359-3498,3540-3628,3650-3823,3846-3890
  Gene Ontology: Mol. function=protein binding; Cellular component =nucleus; Biological process=pathogenesis
atgtctttttcaccaaattcaacaattgccgaatttacttctgatcagggtaattaagcaataaaattggagtaattattatagtaaaattgttgactaaggatttcaaatttaattttagcaccgtaccaaaatgaaagtctgacgccaaccgaggaattgcaacaaatgcgaattacagaaatggaacggattcaaaaaatgtctttacatggcggatacggtagaaaattctttgcttgtacatttggagattatattagaattttcaaattattattatttatttttttttcatattaatttgttcaaatttttcgctgtagacagtggacacaaaatggggatggcaaagccggacaccttggcggatcgaatgaaattgttgctgagcacggccaaaggtgtcgatgcgcattttttagttgggcaaagtgacaaaaaagaggcaagtgaaattaataaacaattaattaattacggtctaattagcgaatgacatttttagacaattaattacggtaaaattaaattttaagcttgtgcatgctcacaaagccattctgattgcttcttcgaatgtttttgaggcgatgttccaaacggacaaagaaaactcaaatggtaccaatgcaggaaagagtaagcaaaaggggatgaattatgaacacataagcaaattaatatatatgtatattggactagcctcatctctgttgtttttactctgctaattgccctaattattttcaattagtctctgctaattgccctgattattttcacttagtctctgctaattgccctaattattttcaattagtctgctaatttccctaattatttttaattagtctctgctaattgctctgtggtggaggaggtccccgacgttgaaccagcagcgttcaaagtgatgttgagcttcatttacacggatgatttaagcgaattgaatggagacaatgcaatggctgtgctcaacgcaggtgaattattttttaaattatttagttaattattttgtaaattagccaaaaagtacaatatccctggccttattcgtccatctttgcaaattcccatctccgaattgcgcaatgttttcttagcatatgaccaggctctcattttcgaactggaggtgagaaagacaaatttatttttaattctattatttttattatcccttttttgtataattttgataatttaatgcttttttaaggatttttccatcaaatgtttgcgttacatttgtcaaaatgcgggccaattgttcgaatcagatgaatttttgcaaattgatcagaaaatgttatgcaatcttctcgagagtgatcgtttattgctcagcaatgaatttgaaatttggaaatctgtaatttcaatttaattttttattttcattttttaatttcgatatttttttctatttaggcactccgttgggccgatgaaaaatgtcgtcagaatggcattgaatgctcctcgggaaatcgtcgttccgtacttggtcctgcactgttcaaaattcgttttcctaatatccatgaggaggattttgcaaaatgcgtcggtaaaatttttgaaatcgaaaattaaattgaatttgttttggttgatatgaaattttacctttaatgcttgaatttcatacatggacaaggaggggggtcagaattttttcaaatttatgtgaaattggccgaaaaaaactgatgcctacagaataatttatgttgaaattttacagttccatccggtgtgttaacagtggaagaagtgctcggcgtttatcagttcaattcccatccgtttctgtatcttcgtggagtgcccgggctgtactcgtcgaaattcccaagccatggacgaatttttaattggaacaaagccaagggcaaccgaagagggacactttcgatggaaattgaaaaaatgtcggaatttgcgcgagagtctgtcgggagaagcagattcagtgatgccgtgtatataaatggatttccatggaaaattgaagcagaaataagaaaaaagaccgaagacactgatgagaagaaatatttgggattttacttattgtgcgatgcaaaagaaggtccaattttaataaatattaaaaatataatcattattaaaataggaggaccatggaactgcgttatttcggcaacctatcgaattgtgtcagaaaagaccgaagcggagaattcaatttggacattgtgtgaccgggttatcaacagatcaaacatcggccggggatttggatttttaattacttttgctgtgagtaataatttaacatatttacttaattgatataattatggttaatcaaggaattgatggactcgaacaagtgcttttacaacaaagcagaggacaaattggcattggccattgatgtcataactgttgatgagccaaaaatggagaaattcatttccgatcccaacaaatccaacggcacactttcaatggaaattgaaaaagtgtcggaatttgcgcgtgaaataattgggagtcaacgtaaaagcgaaactgtgcacatcaaaggaatgccatggaaaattgtggcacaaattgaaaagaaagatgaaagcactgacaatgagaaatggttgggcatttgccttttgtgtgatgctccaaaagaaggtgtaaaattactaataattaatatatatattaacaacaattaattaattgatattgagcagaaaattggagttgcaaatgttcggcaaactttcgaattgtctctctaaagagcggcgtaaaggatttcaggagaaaactcgatgacgatgtttttgacaataaaacgtacagctggggatatgccaattacatttcatttgctgtgagtgacaattcaaataaatagtgctcaattaaattttaacataattaaggaactgatggacccaagcaaaggcttttacgaccaaagcgaggacaaagtgacattggccatcgatttcactgtgaaagaagcaaaacggaggacgaaacataaatgcccaatatgatttggggaaaaatgcccattgaatatcctccatcctatgatgaacctgtttttttatttattaatttttcttgattatactttcaaaactactgatatatgaattaattaattgtcggagctgttttagcagactctcatttttgagtaccgaatttcaatgataaacattttagtcataaacccaattcaaattttaccattttaggtcaatgtttacaattttttggacttggatttattgcattaattttgttaggatttacgtaaacattttttaaactttttttttaaattgaaacctttcctaattgactgatcattttttccttttatttaagcagaattttttgggaccagaaatttgggaaccgggaagtttgggcttattaaattaaaaattgaaaaactattactaattacgctatgatttcattctttaataatccaagctgcgcttaaaaatttatatttactacaaaattaaaaattaaaatatggaaaagtgacaattttattatttagtcaattcttacagctgtttaaacgtggtgttgagtgtcaattgtacataattccttaattggcataattattattaattaaggaattgatggaccaaagcaatggtttttataacagagaagaggacaaagtgacattggccattgatgtcacagtgaaagatgataaaaaggagaaatgcatttctgatcccgacaaatccaatggaataatttcgatggaaattgaaaaagtgtcggaatttgcgagagaaatcgacagaagtgaacgtaaaagcgaatctgtcacttacataaatgggcttccatggaaaatattggcataa

SEQ ID NO: 68856 - DNA, 507 bp, Heterodera glycines
  Genomic contig location: Contig_ID=SeqID_8688; Location=424..930; Strand=-
  SCN-specific regions: Sequence locations=1-98,132-507
atgccatcgtcaatggatcggatgaaacatttgttgagcacgggtgagcattcggatgtgcactttttggtgggggacggagacgcaaaagaggcgagtttaattaaaaataaaaattttattttatttttcaattgcaatttcattaattatccacgtttttaaaggttttgccagcacatcagctcattttgaagagcgcttccgatgtttttgaggcaatgttccgttttgacgccaagaaagaaagaccggaaaatggtaaaaaaaaatttattttatgggaaaataccaattaggtatgttgttcttcattttgtctcttctgctaatttccctaattaatttcaattagcccctgctaattgccctgctgatgtggaggtccccgatattgaaccatcagcattcaaactgatgttgagcttcatctatacgaatgatttaagcgaattgaacggagacaatgcaatggcagtgctttacgccggtggttttattatttaa

SEQ ID NO: 68857 - DNA, 778 bp, Heterodera glycines
  misc_feature (17)..(17): n is a, c, g, or t
  Genomic contig location: Contig_ID=SeqID_40571; Location=272..1049; Strand=-
  SCN-specific regions: Sequence locations=1-166,199-267,292-385,425 -558,581-757
acatttggctgtatttntggaaggattttgaccaaagacaaagaaatttgtggcaaaatcgagcaaattgcgctcgaaagtaagggaaaagcagcgaaaattgagcaattaattgtggaaaatcgcattacacttgagaagaaaacggctaaagaaaagcaaaaggtaatttaattaattgtttaattatttttattagtttaagtttaatccacagttaatgaggactaaaatggaatttgtaaaaggatcttcgttagcaatacataaagatttatttttcaaaaaattgcatcaaatatttttcattctaattagtaaaattggatttttagctgctcgaaaagcaaaaatgtgctaaatgcctaaccgaaatacaaataacaattttacattattaaattttaaagataattttaaatatgttaatgccaggaattctttgtgttgtgggagaatgggccggaagacgtcactcttttaaaggcactaaaaatatgcgcggaagaatcattcgacgaaatgcacaaaatggaccgaattaaaaattatgagagcaaaaagaaagcactgagaaattttgctgagtcaattggcgtaacatttattatttgtatgagcaaaaatttaaaaaggaaaacaaaaaaggataaatttttgtcgagaatgcatttcgagaaaattagccaattaattgacaatcaatcaaaaggggacgaattcaaagaacttttctcaaaaaatggttaatttaaatatagagattttaaaaaataaa

SEQ ID NO: 68858 - DNA, 749 bp, Heterodera glycines
  Genomic contig location: Contig_ID=SeqID_8689; Location=289..1037; Strand=-
  SCN-specific regions: Sequence locations=1-75,107-231,253-331,353-749
atgacattagaaggcgaaagaggtggattagatgcacttttgactgctcggttggatgaggatgaggtgggggaaattgaggaaaagggaggaggggaggggaaagtcgactgaatttcgaagttgccctgcattttgttttctcctgttgagttagtgttttactcttcagcaattcattgcgacaataaattacctgaacgacaatttgcgtttggatgccgaaacgacggagcaaaaactcagaatggtattggaggaccgggagctggagctgaaccaacagtacttggaacagcttgaaaaggtggtggagcaacggcgaatgtgggaaaatacaatttggaaatttaattcagatgaatgaccgcgtgcagggatttgtacagcaaattcggtcgatgaattcgatttgctgcgaactcactgaacgcattcaaacgaacaaggaaaagacgcgcgagttgctgaagagaacagccgttctgcagacggaaaagcgcgaattgggtgccaagaatgcatttttggacgaatttttcgccaaatattccctaaacgaagaggaggagacggcattggcactacccaatcagcagggtgactcatcccgtccactgatcactctgaattataaattactgttaagggtcgccttccgacgcatttttctcggccttacgacgtttgttagaagtggagaaaaatgtgacggaacaattggcattggagccgaacagtttggcatt

SEQ ID NO: 68859 - DNA, 1181 bp, Heterodera glycines
  Genomic contig location: Contig_ID=SeqID_8691; Location=349..1529; Strand=+
  SCN-specific regions: Sequence locations=1-787,809-1117,1139 -1157,1179-1181
gtccgcggcgcactccaatgccatcgcgacccgagcaaacatcagaatgtggaagtacgggtcattgaccgggacggatggggcccgttgaaggtgttggaccctgacgacatgatggggtgtgccggggttaaatgttgtcaacgaccgattgattgtttattagtgttttcaaggggaagggtgccattaatcgatgcttaattatgccaatgctttttagcgtgtcttttactgagcaggacggcacctttcagctcgacggttgtggcaacgacatgaacttcctcccgggcgtggtcagtgagtgccgtgacactgtccctccgttcctttgcccatgcccatccttcgttctcccccccccctttttagcccaatttgcccgaccctttcgttcgcattttgcatttctgcaacagcgaagaaggcgaaaccatcgaattgcccgaattccgaatttttgtggtcattctcaaattgtttgtgctcaaattggcttttccgcttcagccggacacttatgacttgggcatcctcgtgttggaccagaagactttgcccaattccaccgttaatttccccgtgcccgagaacccccgtcgacgcctgcagcaggcaaaaagaccgacggaagtcggcactttggacgaaagcaatggcaaaaagggggcggaagatggggtgagaagtgaacggggcaagaaaggaaaacaaattcgaaatttggacattccgatgaattttttttttggataatgtgaaattttggaattgaaagtcggccaatgaaaagtttctgaaaattattaaaaatcgcggcaccaccttttttagtttgtgactgtcgacgcgccaaaaagtcacaacgccaaaggcctggacgaccttttgccgcccggcaaaacggtgaccaaaacgaacggcgatttgttgtgggagacgcaatcggtggagatggaggaagtgccggccgaatacgacacgtcgatacggcaaagtcagcagcacaattgggaggaaggtaagcaaaacgaagaagccaaagagaacgacagacacaaaatgcgaatgttggcattttgttgcttcacttttcagagtccaaaggcgatggaaatgaaaggaaaaattggacgaagaaaaagcaaccgacgaaggaagagaaaaagaggaaatga

SEQ ID NO: 68860 - DNA, 305 bp, Heterodera glycines
  Genomic contig location: Contig_ID=SeqID_40576; Location=64..368; Strand=+
  SCN-specific regions: Sequence locations=1-305
aaaattccctcaaaaataaaaggtctattgcgcaccgccctccctatcatgctcgagagcatttgtatgtgtataaaatttatcaaaaaaagagatagccatttttctgggatagagtctaaatataaaaatcctctcaaaaataaaatggcgattgcgcacagccctccctctcatgctcaagagcttttgtatgtgtataaaatttctcaaaaaaagagatagccatttttctgggatagagtataaatttaaaaattccctcaaaaataaaaggtctattgcgcaccgccctccctatcatg

SEQ ID NO: 68861 - DNA, 368 bp, Heterodera glycines
  Genomic contig location: Contig_ID=SeqID_40578; Location=400..767; Strand=+
  SCN-specific regions: Sequence locations=1-290,314-368
tattcggtgacgcacaattgttaattaattattcggatgcgctttttcatgatggcacaacactgatccatgtgattggcactctgtccgctcagctcagtgtttggattcgttggatggattctgaactaatggagaagcaaaattcaatgcggatagtcgatagaaaaatctacgagaaaatatgggccaatgcaaggctggaatttgaggtgaagaagggggtcttgttggaacttttcgcaaaaaataaaaatacgaaattgaattgcacaaatattgaaaatttcgccaatattatgattttgataattagggctgccaaaaatatttgcaaaaatggtcaaactatgtacataaatatgtaa

SEQ ID NO: 68862 - DNA, 339 bp, Heterodera glycines
  Genomic contig location: Contig_ID=SeqID_40579; Location=97..435; Strand=-
  SCN-specific regions: Sequence locations=1-39,61-86,179-339
atgaacgtttgtgttaaccttgtcgagttttgtgggcatgacaacaacaacacgacgtccgccgatttgcagcttattggacagtgtaattttctttttttttgaaaaaaaattttataaaatgaaaattaatgaaattaaattaatgaattaacattttttgcattaattaatatatgccaattcaaaaatttttcagtcatttccactaattgcatgcgcatcagtggggagttcaacatcgatggccacctgctggtttagcgagagcaattgtccggcaacaattttgtggagcaaagaaagtgccattgtcagtgaattttggatagaattaaa

SEQ ID NO: 68863 - DNA, 3012 bp, Heterodera glycines
  Genomic contig location: Contig_ID=SeqID_8692; Location=44..3055; Strand=-
  SCN-specific regions: Sequence locations=1-227,249-425,447-817,840 -2224,2246-2406,2428-2670,2692-3012
atggaccctgaatcggttgaaaagacagcatttgtgacggaattcggacttcacgaattcaatgtcttaccgtttggcctctgcaacgcagttgcaactttccaacgcttcatgacgcgtctttttgaaggaatgattaacgattctgtttttgtgtacatcgacgatgttttgatcgcttctgaatcttggagtgaacatttaaagcatcttcgagaagttttcaagcgaattgatgaagcgggtttgaaactgaaaatttccaagtgccgttttgccgttaaagaaattccatttcttggccatatcttaactcgagaaggtgtaaaaatggacatggacaaagtcaaaccagtcattgaacttccaacgccaaccagtaaaaaagaactccattcactccttggattcttaacttactaccggaaatatatttttggttttgggtctttggcagcaccactgtttcgtctcctaaaaaaggacgtgaagtttgaaatcaaggaagttgaattaggcgcaattaaagcactaaaaaagagcattttggaccacgcaatgctttatttcccggatttcaaagcagcagtagacgaccaaaaaaggcaatttgtgatgttaaccgatgccagtaaaattggtttagcagccatactttgtcagccggacgaaaatggaaatttaagacccatttacttcgcgtcacgacaatgtaatcggcatgaggcgcgatactgcccaacagagcttgaggcgttggccatcagatttggcacaaagaaatatgctcaatttatcactatgattccaacaagagtgataacagaccatcgtgcactcgtttcaatgttcaaaagcaaaaacgagactggaaatagtcgtgtggataaatggttgatggcgatgaattcccgttttatccttcaagtcgaataccagcctggcaaaaagaatatacttgccgacctcctttctaggtccaaaacattgcttaacgcaacagaaaacgtggaaagtgaaaattcaaaagcggaaatcccaatttcaaaagaaatttttcgtattgggcaaattcgagaaaatcaggtcgccgaacaggctgaagacttgagtgatgaacagaggaaagattgggttgaaaagaccaaagagagcgaattggcgtttgtctatgaatttttggaaaaacgtgttttgccgcatgacgttcgcgatcgacaaaaattattgtcatctttgcacaatttttcgttaatcaacggacttttgttccgcaatgagaacgatggaaaactacagctttttgtaccaaaagagttcagggaaatgatgataagagaaaggcactcgggaatttgtgcggggcaccttagcggaaaaaaaatttttcgtcagctctcggagctttacttttggccaaatatgtacggagagtgtatccgggcggcacttcgttgtagagtttgtgcacatgcacgaaaaccacgatcaaatgagcctcccctgaacatagtcgagacaaaggagccgttggaattggtttgtatcgatattttatcgattggacccgcagcatcttcaaatcggtacattttggtggcagtagatcatttctcgaaatacctcgtggcctgcgcgatcccaaacaaaaatgccgaaacgattgcgaaaaatgttgtaaaaaacttcatttgtatcttgggaacgccgaaaaagcttcatagcgacaaaggaaaggagtttgttaacgaaacattggaggaaatttcaaaaacactcaaaattaagagaacgaccacctcaggatacgatcctcaggcaaacggtgtaacagagcgcgttaatcagacgatactaggaatgctacgaaagtcgacttattcagcctgggaatgggacgaaagactgccttttgtagtgtttgcctataattcgacaccatcagaagtcacgggtatttccccacatcatttaatgttcggaaaaccagccaactttccgttggaacacgaattaaaattcgccgtaaatccgctctacacaatagaccaaaatacgtatattcaactttttcgcgagtccctaatgcaattagtggacgaagcgcgaaaaaattcccaaataagccgtgcaaaaatgaaagaacacttcgacgcacaagcaaaagtcacggagaacaaattccaaatcggagacagggttatggtcatttttcccgggtcccacattcgatcaccacataaaaagattttgtggaaccattttggcccatttcgtattacggaattgaataaatcgacggcgaccgtaatcccgtccgataatccatacggtaatccaatgacagtccctcttgaacgattagtgcgcgtaccaaaggaattgcaaaacatttgtacaatgccgaaagggaaaaacccctataagaatgttttaaatggactgataagtgtggccggattaatttgtcaagaaaacataaaattgtatggggaagaaaaattgaactctaaaccggacggaataattgggcaattgaggtcaattgcatttttaggcggtgaggaggagcacatggaaacggaacagacggacgacaaagaggcggagaccaacgaaagcgaaaacgaagaaaatgtagaggaaaagatggacggcaaagaggtggacgcgaacgggagcgaaaaagaagcgaatctggaagaagaagaccaaatttcggtcgttcaggaagaagaggagccgaaaacgctttcttggacattggcatgtgccggagacgagcacaaatgctgctccgatgtggtcgtggccgacttggatgccgtccttgaccgatcaggcattgggctcacgaagatcgagaatccgctcaaagcgctgttgacaatgtttctgctgaagtctgaagcggtcgcatcggcatcagctgccaaaaagctcatttcgcaaattctggacacggatgccgattgggaactcgcaacatattgcagtgcccgagaagacgac

SEQ ID NO: 68864 - DNA, 1055 bp, Heterodera glycines
  Genomic contig location: Contig_ID=SeqID_8693; Location=1..1055; Strand=-
  SCN-specific regions: Sequence locations=1-374,396-572,594-890,913 -1055
tcgccttgtgttgattatagagggctgaactctgtaacagttaaagatgcatttcctttaccaaacatcgatagcactttgttagcgctcggcggaaaaaagtttttctcggtcatcgatttcatgtcaggatattggcagataagaatggaccctgaatcggttgaaaagacagcatttgtgacggaattcggacttcacgaattcaatgtcttaccgtttggcctctgcaacgcagttgcaactttccaacgcttcatgacgcgtctttttgaaggaatgattaacgattctgtttttgtgtacatcgacgatgttttgatcgcttctgaatcttggagtgaacatttaaagcatcttcgagaagttttcaagcgaattgatgaagcgggtttgaaactgaaaatttccaagtgccgttttgccgttaaagaaattccatttcttggccatatcttaactcgagaaggtgtaaaaatggacatggacaaagtcaaaccagtcattgaacttccaacgccaaccagtaaaaaagaactccattcactccttggattcttaacttactaccggaaatatatttttggttttgggtctttggcagcaccaaaagagcattttggaccacgcaatgctttatttcccggatttcaaagcagcagttgacgaccaaaaacggcaatttgtgatgttaaccgatgccagtaaaattggtttagcagccatactttgccagccggacgaaaatgggaatttaagacccatttacttcgcgtcccgacaatgtaatcggcacgaggcgcgatactgcccaacagagcttgaggcgttggccatcagatttggcacaaagaaatatgctcaatttatcactatgattccaacaagagtgataacagaccatcgtgcactcgtttcaatgttcaaaagcaaaaacgagactggaaatagtcgtgtggataaatggttatggcgatgaattccccgtttatccttcaaagcgaataccagcctgggaaaaagaatatacttgccgacctcctttctagggccaa

SEQ ID NO: 68865 - DNA, 493 bp, Heterodera glycines
  misc_feature (35)..(35): n is a, c, g, or t
  Genomic contig location: Contig_ID=SeqID_40582; Location=370..862; Strand=-
  SCN-specific regions: Sequence locations=1-109,131-190,222-238,287 -393,490-493
atgattgaaccaggcaaaagtgttaatcttctgtntaaacttaaatgctcttcctgtcttaatttcaaatatgaagaagaaaaagacggacaaaatggaaaatacggacaaaatgtaacagacggacaaaatgaaacggacaaatcaaagcaaccaaataaactactattaactaaaacttcttacatcaaaaaagaagaaacagaaaatgagatcaaggtaggccattttctaaatcaaatttatttaaataaatgataaaaaaatttaatctaaaattattaaagattgattttgaattaaaaagtgccattttcaacggaaacgcggccgaaattgtgaggaaagaggatattacaaaaggcaatgaatttactgcgaaatatttagatgtaattttatattttatttttaagttgaaaatgattttatttatgcaatttttcattttacatagttttattagttttttaaatttaattatttttagtaa

SEQ ID NO: 68866 - DNA, 356 bp, Heterodera glycines
  Genomic contig location: Contig_ID=SeqID_40583; Location=1013..1368; Strand=+
  SCN-specific regions: Sequence locations=1-356
atgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctatattttggtcaagaattttttttgtttgcgtttcaaatatcaaaaaattgtttgatagggccagacaagagaaggcaactg

SEQ ID NO: 68867 - DNA, 772 bp, Heterodera glycines
  Genomic contig location: Contig_ID=SeqID_40586; Location=42..813; Strand=-
  SCN-specific regions: Sequence locations=1-412,435-772
atgcatccacaggaccattatccggaaagtgaggactgctcgaaggccgaacaaattgggcagcattacatcgaatctgccgcttcaccgatgttgttttcctgcaaatatgggccattaaaggtacattttgctttagttttgtgcaaagcaattaaatttaacgcacacaaaatctaatttttagccaaatcggaactattcggccactgtgtgggctgaaaataaggccgggagtagcattgccgtctctatcggtagccaatgtgttatggattatgcggagcctgaacacattgaaccgcccagcgtcgcctctcgtcccaacatttcgtcgtttggtcttcgttttgagcacgagccgaaccaagaaaatgggcctattgtgtaagagaattgctttttgtattctattcatatttatcattcaatttcagttgctattatttggctattctgcctttgcctttgaatgtcagcatcgaaatgcttccgatgcctgcaaatgttactatggacaattatgataaagcgcttaagaacaaccaaaaccaacacgcaatcaccaataaacaattcttcgcttacattgcggagagttatttgcaatacccaagacaggtccaacaacagttttttttgtgtcctttcatttgaaaattcattgatttttaattattttttttagactgtcgttggagacagagaaacttcggctggcactgacgcgtgcactgtgccttatatgaccagacacactccgtcagactaa

SEQ ID NO: 68868 - DNA, 556 bp, Heterodera glycines
  Genomic contig location: Contig_ID=SeqID_40590; Location=5..560; Strand=-
  SCN-specific regions: Sequence locations=1-114,136-556
atgtctttcgggttgggccgtgccgagtcggtcactcggctcagcgcattcgagccaaggccgaatccgtcggtgagtgagtgccgttgttggtaactgcccccccccccgttctgataatcccagtgcccttttcttttggctctttagctcgtccgttgctcctctctgatcgatgtcaaccgtttctcccgtgattttgatcgcttttctccgcgttcgtcgcgtctgtcccaaaatgactcgagcgcattgtggtcgagcagaatgtaccgaccatcgtttgtggtaatggtgccaagattggaggatgcaatgattacatatttgcagatggacaaccattggttcgacaagttttactatttctcgccaattttcaagggcacccaaccgtacaaatgtcacgtggccaggcgagcccttcccccgggcggaactgtcatttctctccctctttagccatcgtctcacttatccctcctcttggcatcagccccacgactattggcgccgagtacgcacttttggtggacattggccaatcatcaataaa

SEQ ID NO: 68869 - DNA, 334 bp, Heterodera glycines
  Genomic contig location: Contig_ID=SeqID_40590; Location=627..960; Strand=+
  SCN-specific regions: Sequence locations=1-11,123-197,223-334
atgacacttttaagcaaagagagcagcggagagggagaggaaaaagggatggaagagcagagaaagagaaaagcggatcagagacacaaaagtggggaaaagcaaaagcaaaagacaaaaagcatggaaaaagcaaaagcatggagaaagagcagctgtcaaatgggagggggagaagctgatcagactgatcaatcaatcaaaagaaaacaaaaagcatttattaatagtctaatcattttacaatgaatgaatgattcacagaaattcgctttaaatgccttcgatttgctcaagtgtgccatccatctttttccatttcaaatttctttca

SEQ ID NO: 68870 - DNA, 354 bp, Heterodera glycines
  Genomic contig location: Contig_ID=SeqID_40591; Location=285..638; Strand=+
  SCN-specific regions: Sequence locations=1-9,32-108,132-354
atgagtcccgtttttgtaagcatatttttaacaatcgcataatcaattaaaaaaattgctcaaaaataaaacttttgagtaaaactaacgaaaatttaaaaaaaatcgtttgtggttaaattcttaatttttgagttccgtgctaccgtcagtcagctgagcgttcgtgtagttgccatcaccacgaattctatcaaagtccagtggtacccgatcaccgcaggccaaattgacaacaagaaaattgtcaaatacaagttgcactacaaatgcacctctccagaccaccaatggagtgagactgatgcttatgaggtaaaatttgaggagagattgtactttgactttgtatga

SEQ ID NO: 68871 - DNA, 2706 bp, Heterodera glycines
  Genomic contig location: Contig_ID=SeqID_8694; Location=11..2716; Strand=-
  SCN-specific regions: Sequence locations=1-13,36-125,148-304,350 -444,466-491,594-611,644-644,966-1063,1090-1095,1117-1543,1566 -1661,1683-1795,1818-1883,1905-2466,2488-2516,2540-2706
  Gene Ontology: Mol. function=ribosome receptor activity; Cellular component=integral to endoplasmic reticulum membrane; Biological process=N-linked glycosylation
atgcagcccgatcttgagaatttattttttaaaattgaacttcaaatggatttgattgcctggagcgaatcggcgacagacaaagcggcaaaaaaagcacacaaaagggaaattatgtcattaagaagtgacaaagacaaactttttcccgaagaagcccaagtgattgtaattgaaaaaggtgaagaaaatcggtcaaatttattagcgacagagataagtctgttgacaatgcatgacgaaatcatggaaggactgatcgaaaatgagcaacactttttggacaaagttaaaagtgagtgagaattaattaattgattatttcataattattagttaatttaattaaaatttcagcaattttcattaacgaacaacgccttcaaaaaatgataccacggatgacattggcataccaaattttaatggaaaatgccaaaggaagcaagcagcagaggaatgaaaacgaaaacaatggaaaagaggacgatgaagaaaaggggaaaggaagaggagaaatagtggaagaaaaaggagaagagaggggaggagccaatggagaagtagaaggaggaggagaaaaagtaggagaaaatagtgaaggaagaaaggtaacaaaagaagacgaaaaaacacgaaaaagggaagaaaaaggagatgaaaaggaagaaagagacaaaaaggaaaaaggagaagagaggggaggagcagttgaagaaaaaggagaagaaggaaaaagtggggaaataaatgaagaaggaaacgaaaaaggaagagaaaaggaaccagcgggagaaaaaagaaaagcagaagaaaaagaagaagagaggggaggagcagttgaagaaaaaggaggaagagaagaaaaaggaagaggagaacaaaatggagtggaaaatagtgaaggaagagaagaaaaaggagaaaagcggggaggagcagatggagaaaaaggagaagaagaaaaaagtgaggaaataaatgaagtaggagacaaaaaaggaagagaaaaaggaagcgaaagtggtagagcagaaaacgaaagatgcgttgattcggatggtaaataatatttttaatttattaattcgctgaatttttgccaaaatcaaatttgtaataaattttcaaaacactctccaactaattgtcattagcttcattaatcataattgttttgattatttggctttcattattaagctgattcggacttgatcagctgctaccaacatttgatgttggcggatcggccaatttcaagccgtgataaaaaattgttggaggtgaacaccgtatattaccaacttaaatcactgatcaaccaactcttatcaatcataaagcaaataaaaaagggtgtggcaattgaaattgaaataatggcccaaaaaacgcttctcttgggaaaacccgaaaattttgacgaaaaaattgtgaaaatttgctatttaaaaagtttttgggcgtatgtcatttcaaatcgcaatttatacaatgaaagcgaaagctggagaacatattttacatataactttgctggaaaagtgagtttttaaattaaatttgaaaaaaacgaattaggacaatgccaaacttttagctaaatgcgccattccccactgaaggagaacaaaaatgggacaattccatttgcgaggaaatgaaaaatgttttagaaatttttcaaggtttcttaaagtcaccaacatttgaagggacgcaggaatttgtactgaataacttattggagaagaacaagaaatttgttgattttataaattataattttggcaaaatgccaatttttaaaaaatatggtaatttttttgaaggagtcgagcggtgttttatagctaggaagattaaatttcttattctagtttttaaatttttgtgacaggccctttaagcactcaaacatcagagggggggaatgacaaagttctgcaaaatttagcattttttttgtcaatttttacacaccaaccagcattgcctagctttacatttttattattttttgattttttccaaaagccttcatttccgagttcctcgtccaaatgttttttttcttgtttaaagtctgtttctgggactcaattaattgtcgatatcaacaagcttcaaacccagttttttcagcaagatttgatgacgtccacgagatggaccttttctatttggcgttgttttcctccaccgattcggacacaacttttcaagcagagatatttctcggcatcaaattgatggagtcgatcatatatcaaaccgagaaagtggtgattaaccctgctaatttcacggaaattattagaacacgggccaaattgcgtgccatggtggctgtgcaactgcacttttggcatgccgaaaaattccgcataatttgttaccaaattgcctatgtgacctatctggtcaataagaggaacttcccatccacagattggcagtcgcccaccgaatgttttttaaacactcgcgaagaaactttgtcctcaatgcgtacagtactccaaagttcccattgggactttgtagtcaaccgagtgacgggcacagtgcgaaacggtatatcggatacagtacgccacaagcgtggcgccattgcattgctggagaagctaattgggggtacagcaatggttaaactgtgggagaacaaagaagccagggcgaagttaatggaggcaaact

SEQ ID NO: 68872 - DNA, 1067 bp, Heterodera glycines
  Genomic contig location: Contig_ID=SeqID_8694; Location=3125..4191; Strand=-
  SCN-specific regions: Sequence locations=1-79,103-210,232-533,611 -662,684-1067
atggccatttttgttatgtccaattcatttggaaaaatgaaactaaaagggcgaaagggtcacgaaacaatgaagaaaatttatccagaaataagaaaaatttggagtgaaaaattttgcgaaatttgtgcgcaaattaaaacgaatgtacaagaaaattcctttgagaaaatttacaaattttggcacaagttggccgatttatacaacaaaattccaattttggaaaaacatgaaaagattttgataatttacgacgaatttgcccttcaacggaccgatgaacttttatggagggcaaaagatcaactaatggtggaacattccgaaattgtgactcaactgaccgtgtgccaatcagcggagtgccaaaacgcactcagtcgctttttggcacattcaattggccaaatgaaaggggccaaacatcgactgagaacatttttcacctcaccattaaaaggcactgcaattttggataatttactacaaggaaatgcgagttttgcgcaggtgttccgttccggtgaatgttttattttaattttttgaatgaatatattatattttaatttgaatattaccgtaatataaaaataattatttaattgcctcctaattaaaatcagatttgacaacagacgaaataagccaattacaagtcaaatattatctaaattatatggacagtgacagtgaaacagatgttcacacgagagcactttttatggccaattttttggcattttatcactggtaagttagggatttcggggcctttcccgaggcttacataatacgattggacggaactcgtctaacaatttgttagtgtttggtggatggaaatcgatctctggggttggaattgagcgggccaaaccccgaaacccggcatagcttagttttcaataatttttttggttgaaaaactttctgtttttctattttggtttacaagaaaaataatcagaaatccggccgcaattccgttacatccctgcagcaaagttaccagggatgggctttgctttttcacctttcaacgtttggggcaaaagattaaa

SEQ ID NO: 68873 - DNA, 1244 bp, Heterodera glycines
  misc_feature (63)..(63): n is a, c, g, or t
  misc_feature (653)..(653): n is a, c, g, or t
  misc_feature (702)..(703): n is a, c, g, or t
  Genomic contig location: Contig_ID=SeqID_40596; Location=1..1244; Strand=+
  SCN-specific regions: Sequence locations=1-270,293-333,356-675,702 -923,945-967,1001-1244
gtctgtgcgtcgtgagcgggtgtgtggggcaggcacataacacactgactggggatggtggtntcgttcccggtcttacgtgccgtaactagcggtgtgtttgtgcttgctgctacgtccgtggccgtgatgagacgacgtggtagggcccgtgcttggcctagcacgtggcttaagactcaatgagtgtcagctcgggcaccgccagctttttcttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgcttagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcacggcggggacancccgtggaaacttaacatttacataagcggaggaaaagaaactaacgannggatcccgtagtacgggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtaccc

SEQ ID NO: 68874 - DNA, 123 bp, Heterodera glycines; identical to SEQ ID NO: 67087
  Genomic contig location: Contig_ID=SeqID_40597; Location=271..393; Strand=+
  SCN-specific regions: Sequence locations=1-77,100-123

SEQ ID NO: 68875 - DNA, 205 bp, Heterodera glycines
  Genomic contig location: Contig_ID=SeqID_40601; Location=865..1069; Strand=+
  SCN-specific regions: Sequence locations=1-205
atgaaaatgccgggaaggcccaacatccctcacaaaaatccatatcattataaggtgcaacagcaaaacagaaaccaagtgcagtacaagcaacagaaaacgattgaggaaacaatccaagaacaagagaaaggccgcagcagcgtcctcggtaaaaaacttcgccacggggggaggggaaatccggttcatgctttgaactatg

SEQ ID NO: 68876 - DNA, 1209 bp, Heterodera glycines
  Genomic contig location: Contig_ID=SeqID_8695; Location=911..2119; Strand=+
  SCN-specific regions: Sequence locations=1-218,240-1209
atggattcattcggaactgtcgcctggattctgcgaccaacggctcagacgacaggcactgctgtgggctcaatggagtacgaagaggaggaaaacgggacaggaaagttggtccacagtgacacagctactgtcaccacacctaccaccgccgagtttagactggaaaaagaagccccctcctccgagaaggacggtgctgaagagggcagcggcggccacggcacactgctgttcatcgaatccgatgatggggaggaggaggaggaggacattgaagacacccccgtcgccacagactccccctcggctacgacggcaaccgttgtggatgactcttccaacactgttaaaggggtggagcagcgctccagtgagcacagtgacatgacgaacggtacgggcggtggcggtggaagcgaaggcgcaaaactgctcggcgggggagaggaagaggaggtaggtggaggccagctaattttctacccccccccctactgtttgtagcctgttcgaatgccgctgctcaactacctgtgcgcgttcaacgactgttcaatgaaggagcttcaactcctcttccacagtgtccacgcgcgacagcgtatggtggcgcatctgcaacaacactgccgacttcataccgcgcatctgaaaccggcggagcgtaacattgcgctccactgtcacgacctcagcgtgcagaacgccaaccggacgttcgcctgcggtggctatctggagcttaccgtaagtcggtgagtgtgtagaaccagtcatggtgcggccttctgtccaggttcgacaatacttcttcgccaaacacgggctaaagctgaagcacccgtacatgccgtgcatgatcgagttcgggggcggcacgcacgcctcctactatccgtaagcggggggtacgcaaaaatgggggaagtgagcgtaaacgccttcagcctggagctcgtccatgtcgtgctggagcgtacgaagcgcgctaaacaggaggagacggtgaagcaagaagagccataccgtcgtgaatccggcgacgtggctccgacaaagtcgatggcaatgccggaacgacattgttgccgctgttgctgtcgatgcgctaacaactagctttttgagagacatggtcattgtagatttgcgcgcgtgatcacgtgacttattgtgctgttatagtttttgtgcactttttttgaa

SEQ ID NO: 68877 - DNA, 324 bp, Heterodera glycines
  Genomic contig location: Contig_ID=SeqID_8695; Location=2993..3316; Strand=-
  SCN-specific regions: Sequence locations=1-275,300-324
atgcctgacgcggagcagcgagtgcccgtcccctgcacccgcttcgtgcgtacgaagcgtgccgaggtgttcacgcgccgcggcaccaagctgtaccagcccgtgtacaccaaagggctggtcgttgcgcttgacgagagggaggctggcggcggcgccggaaatgcctacttcaccagaccgtttggctggtacgacgacgacgacgacgctgaccgtgacaatgctgaggaggaggaagccgaagatggggaactcttggacgaaagcgacactgatgatgatgatgatgatgatgagattgattttttggtacttggataa

SEQ ID NO: 68878 - DNA, 827 bp, Heterodera glycines
  Genomic contig location: Contig_ID=SeqID_40602; Location=377..1203; Strand=+
  SCN-specific regions: Sequence locations=1-191,215-357,379-827
taattaaatccattccttcgggggaccgtgccgggtgccgcggggtaagcagtgctggttcgttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgatttttt

SEQ ID NO: 68879 - DNA, 267 bp, Heterodera glycines
  misc_feature (215)..(215): n is a, c, g, or t
  misc_feature (251)..(251): n is a, c, g, or t
  Genomic contig location: Contig_ID=SeqID_40603; Location=2..268; Strand=-
  SCN-specific regions: Sequence locations=1-267
atgaattttggcaccaaaaatgggatgacattcaattcgtttttgactcaattcaagcttttaatccgtcgaaatctctcttatttcctctcaacaaaatgtcagacaatcgaaaagaagcggcggaggaagaaatggcaaaagcaatgtaaaattaatgccaatttcacataaatttcatttttttcagcttcatctccgccgactggtggctntgtgtgttcgatctgcttccggctttcacacttggncttggaattgcgctga

SEQ ID NO: 68880 - DNA, 615 bp, Heterodera glycines
  misc_feature (563)..(563): n is a, c, g, or t
  Genomic contig location: Contig_ID=SeqID_40605; Location=400..1014; Strand=+
  SCN-specific regions: Sequence locations=1-445,467-615
atgcaacctttttacccgctcatctgctcaaaaaagcagcaacaacaatcgcttcaagtgcattgcctccgaggaaaacgccgcgtccaaccaaagcgtcgcaacttcgaacggacaaaggcacccttttgggaggcatggcatttaaaggcagcagaggtgagtggcaccgttaatcaaaaaaatgtttaaattgtgtaaatacagagtctctggacagtttaatgcgctctcctccgcctggtcacatccacgcctcatctgtgagatctttttttaataatttcatttggattagcagttacagtgcgtgaaactgtctccaactggcattaaggacagcgacgttattgtcagtctgaaggtcggagaaatgatttttttaattttcaaatttacagttgatttaaaacttttagaaatgccttcaagagaaggaagcccacttggccaagctttccatcgaattgagcgagcggagtaacgatgccggtgacaaatattcagaatttgctttgttaaaaataattcatatttcagaccgactggcacatgaaaatctngaatttgaagttgaggattagtgaaattggatgccgatctaaatgcaactga

SEQ ID NO: 68881 - DNA, 420 bp, Heterodera glycines
  misc_feature (66)..(66): n is a, c, g, or t
  misc_feature (70)..(70): n is a, c, g, or t
  Genomic contig location: Contig_ID=SeqID_40606; Location=491..910; Strand=-
  SCN-specific regions: Sequence locations=1-87,109-307,353-385,409-420
atgggatgggcagtactgcttcacttcattaatggagttggcgtagtacaagctcaaccagcaatntatntcataaattaaggcgcaattcagaaaaggaggaccagaattgttaaatagttctatggattaatacaacttaaattatgggttttaacaattatctttgtaaaaaataaaattttgtttgatataatgcaaatttatggggagtttttaaatgagcaatattttcaagcgcgcagtgaaaatcaatgccacataatttataatgccatttgcgtcatttgttgcagcctaattgccgtttaatttcttattttattaaaaaaatcaattgaaattttatattgactaattttcatttccttcatttattggagctaattgctttttagcaattttattttactaaataaa

SEQ ID NO: 68882 - DNA, 107 bp, Heterodera glycines
  Genomic contig location: Contig_ID=SeqID_40606; Location=1099..1205; Strand=+
  SCN-specific regions: Sequence locations=1-4,47-107
atgattttgtttttgtttacatttttgactcatctttgcttcatcacaattaatgcaaataatgtcaaaataaccaatgttcttggtgacggaaactgtctattccg

SEQ ID NO: 68883 - DNA, 1511 bp, Heterodera glycines
  Genomic contig location: Contig_ID=SeqID_40609; Location=156..1666; Strand=+
  SCN-specific regions: Sequence locations=1-122,145-868,890-1511
  Gene Ontology: Mol. function=tRNA dihydrouridine synthase activity; Cellular component=mitochondrion; Biological process=tRNA modification
atggtagatgctcattttgctgggtgtgcacatatcaagtcggagtacgtcgtattacgaagcgaaacgcaacggcaagaaggaggcaacaaaccaccaaatgaatccaatccattggaagggaattcgcacgagggaattctgccaagaaatgtgagggcacgcggaatggaccgccaaagagagcaaaaaatggccaaggcccgagcggaaaaccgtcaaaaaatcgtaagaatttgtccatcggttctttttgagagcgaaggaaggaagtgcaaatatggagagaaatgcgacgcggagcactcgctgacaaaatattgggcgaagaaaccgccggacattggcgagttttggcacccaacgccaaacaccatctttctttggaaggtccgtcctgctttttgttcgaccaaatgggcaagtgctctttctcattgagctgctgtttcgcccgagcccatacgaatgagtcggatttgagccagaagagcaaagcggggcactcggaatggcagtccgttctcaacacgcacactttgcccattcagcaacagctcagaaaacgcacttacgacttttctcggttctcccccttttttccttgtttaatttctctctttttctgtcagttctgaacgtgctctgcatgaatcaccatcgggttgtatggaacgcgaagcaccgaagtgggacatgcgcactctccgcggcaaaaaatacttggcccctctgacgacggtgggcaatttgcccttccgccgtttgtgcgttgaattgggcgcggaagtcacttgtggtgaaatggcaattgccacgcatttgttgcaggtgctttgcccttgggctgtggtcattatttgtcctattccttttacagggtcttccttcagaactttctctgatgaaaagacatccgtcggaaaaaatctttggcgttcaattggcaggtaaaagttagggagagagaaacctttgcaatatattttaaggaggctaccccgattcacttggtaaagcagtccaactgatcaccgacaatttcaatgttgatttcatcgatttaaatttggtcggtcattattcgttttgtcaattttccttattttttagggttgtccgctggacagtgtcaatgaaaagggtgcaggctgttcgttggcgaataaatccaacaaattggtttccgttttgcagtgcatgcaaaagagtgccacgggagtgcctgtgtccgtcaaaatgcgttacggagtgaaggaaggagaacggactgcgcattacaccatggggacaattgccgaacggagtccccctcagctgctgaccctccaccctcggtcacggtcagccgaaccttcaaacggacgaattgatgccgtcactatcacagggaacagcgctacacaaaggcggccgagtgggattacgtcttggagtgtgagcagcgaatcaacggacgcttcccattttttgtgtgtggagatgtaatggattacgaagagtattatcag

SEQ ID NO: 68884 - DNA, 912 bp, Heterodera glycines
  Genomic contig location: Contig_ID=SeqID_40611; Location=343..1254; Strand=-
  SCN-specific regions: Sequence locations=1-379,409-511,534-565,602 -673,698-912
atgtgccaaagtgaacggaatgccatgaacagtgatgaaatgaagcgccaaattcaaaagttgacaacgaacggcccactaattctttccgatatgaaggcagcagagaaggaacttcaaaagtcgaaagaacaaaatgagaacgaacaatttcgacataattttgccgatttggcaacaaaactatgttcaaaaacattgccaggaggccatttcaaaaatgccgtaatcgaattcctgcaaagaaaaaagggccaaatgctgtggcccagcgatttggcacagtttctccttaccaaaatgaatgttgtccgtgccaacaatgcaaacggtgattgtaaaaattcggaaattttccaaaaaattatggcatttgcagaaaatttagaaataataattaaatatattcataaagtagcaagaccaactgtgcaaatggcctagtggctagtctcttcactttcccttcttctttcccctggttcgatccctctacagaaatgaaaatattttgaaatttctttttatatatactcatggctttcctatcgacaaaatatgattcttaatttttttttaattgtattttatcatttttaaagaaaatccgtacaaattgagcctagtaatcccaaaaccagccttttttgttgaaaatctgttaacaaattgcacccaaatttttaaaatttcccccggcggcgcctatcggcaccgccggtccccctttcttccgctaagtttttggaaaaagcgcgccgaaaaaatttatgtgaaacgtaaatctgaatttctaataatattcgatcacttagtccaaaaatgattaattgtttgaaagtaatgaagaaaatttgatttgaaaattttcattaatttattagctttaacttttgggttttattaaataaa

SEQ ID NO: 68885 - DNA, 1974 bp, Heterodera glycines
  Genomic contig location: Contig_ID=SeqID_8696; Location=509..2482; Strand=+
  SCN-specific regions: Sequence locations=1-1300,1323-1746,1768 -1885,1907-1943,1972-1974
atgctctacggcagaaaattcactctgttgaccgatcacaagcccctactggccatcttcggatcaaaaaaaggcattccaatatattcagccagccgacttcagcgctgggcgttaattttgtcaaattacgaatttgatattaaatacgtcaacacaaaggcattcggaaatgccgatgtactttcgaggctcatcgcaaattacccgaggccatcggaagacatactcatcgcaaacatctgcaacgacactgattgctgtgttaattttgtttttgaggcaaaaattgagcaacttccgatcaccgcgaaaataatagcggaggaaacagcaaaagacgaaattttgcaacaaattagcgctttcaccaaacaaggatggccacaaaagctgaacgacattaaattgtctccttttcttccaaaaaagggacaaatatccgaaatcgaaggatgcctcgcctacggtgaacgaattatcatcccttcgtcactccggaacaacatcctcaaatcattgcattttgcgcaccccggcattgtgcgaatgaaagccattgccaggaaccacgtttactggcccggaattgactcagaaattgaacgagtggtgaaacaatgcgaggaatgccactcagcggccaaaaatcctacaaaagcgacccttcagccatggaaggcagcaaacggagtttttgagcggattcacattgatttcgccggcccgtgcgctgacggccaaacatacctggtattggtcgacgcctactcaaaatggccagaagtatggcaaatggaaagaacatccagccaactcaccatttcaatgctcaaatcattcgtgcatcggcttggaattcccaaagaaattgtctccgacaatggaagccaatttcgatccgccgaatttgcacaattctgcaaagaattcgacataaagcacaccttcacgccgccgttccacccaatgtcgaatggggcagctgaacggtttgtcgacatttttaaacgatcaatgaaaaagtgccgtcaagagggaaaagattggcttcaaaaagtgcttttggcgtatcgcacgacaccaaacacggcactcaacggccattcgccagacgaacttttcctaggacgccgcatgcgcacaagaatcgcacttgtccatccggaaaaacaaaaactccagccaccaaacttggaaaattttcaacaattccaagggcagtacatcaaaaagatggaaaaccaattcaacataaaacatggagcaaaatcagccattttccaaaatgaggaaccaatttatttttggaatttaaaatacaataaagccacttggcttccgggaaaaattatcgaaaaattaggcacatctccgacgtatcgcattttggcaccgacgcttggccgagccattcatcgtcatgccaaccaaatcaggcgacgtttcccaattgaattggaggacaatgatcaagttgtagaaaatgatcaaacccaggcacaaaatccgcaacaatcgccgatcgcgcacaaaccgcagacaaatcgtcagcaatcgcctgctcaaccagttcttttgcgccgatcaggaagagtcaaacaagcacctcaacgactggtcctggatccgacaaagcctaaatacggcttaatccgatcatgaatcccaaatcgagggacattcgacttaaggagggaggtgttggatagggatcaaagatcactttcccatcattgttatcgacttttcccctccccctttctctgtcttacattatttccattgtcttcctctctgcctatctcctccacatttctctgaccccgcgtctttataagggtgcccattccctcactcatggctctccgctccattcattcgcattggacatttttattattttattctcctccgtcgctgcactcctccgacctcatcaatttgtgcatttatttttatttgtgtttatta

SEQ ID NO: 68886 - DNA, 610 bp, Heterodera glycines
  misc_feature (351)..(352): n is a, c, g, or t
  Genomic contig location: Contig_ID=SeqID_40613; Location=7..616; Strand=-
  SCN-specific regions: Sequence locations=1-22,46-96,118-413,435-610
atgctggttagtgcgcctctcatccaacaacagcaacagcagcaagtgttccaacaacaacgcccttccacttccgcttcttccgccgatggtcccttttgaaaaccctttaaaattggctttattagtgtttctttatccaattttagctgttttgcttccgcatgccacggaagcttctgcaccaactccctatcagcagcaacaaacggaggatcagctcgaattgccgacctccgtaccctccgctgccgactcccagcgccaacaccgcgccacccaacaaccgcagagattcttcaaatccggatcggttggttacatttactaaaaaatcattaaatacatggnnggtacttgtgcagtttacggggcaatttcacatacattttcaaaaaaaactgaattttagaaatcaaagaaaatgttttatggggttttcgaggtcgctgatcacgaaaccgggctcagaccagcgctaccgttcatctgccccgtaaactgcacaagtaccaatacatgtgcaagtggtgccccatatgaacaacacgaccataaaatatttgacaattttaatgcattgtacaagcatcaaaattacacattattg

SEQ ID NO: 68887 - DNA, 447 bp, Heterodera glycines
  Genomic contig location: Contig_ID=SeqID_40615; Location=275..721; Strand=-
  SCN-specific regions: Sequence locations=1-447
atgcctcggctattgaaattacttgtcaattttttgacgactgtaaacgtgagaagttgattaccggtataattaaataattcttctgcagttctcaagagtcaacagttttcaatggatgcgtccttcaaactttcggatgctatgagtgcgattggtattttttcttaattttcgttgaatcaattttgaattaagaattgatgaatgaaaaaatggattcgggtatgaaatatgttgagcggaaacttgattttttcaccagtaatacaatggttataccaaattaaaatacaaacattaattgaaaaaattattttgtaggacatactcaacaaattaaagtttgctgatattatcgggatttttgatgcctcatattctttgttggcgtcatggttaactggacaatcgcctgatcagacggtaccactcgttatcgggtga

SEQ ID NO: 68888 - DNA, 811 bp, Heterodera glycines
  Genomic contig location: Contig_ID=SeqID_40617; Location=635..1445; Strand=+
  SCN-specific regions: Sequence locations=1-210,232-615,638-811
atggaagatttttacattgtacttccctcaaacacacctggtccaggaaatactgcctcaaattttacggttagacttccacacaccttagagcttgactccaaatggtccgtcgcattatcagcaataatctatccatattcattcccgtcgatcagtgtggacgaggatgactctatctctgtcaaactggttaatcctaactatagagaagatgccggaaattctgacgaggaatcgcaaaagtttatcaatttgtcagtgaagattccaaatgtacaattccaaagtgtgcaaagtttacaaaaaacactgaatcaaataatccagaatgcttacgatacaaaattggcggctcatcattaaatgatggtacacccaacaaaagagccaaacgacaaaccgaattgtcagaatcaggcgctggagtaatcgaagtagagaatttcttcactcgaaatccttttgattactggcaacagattggagaactgagaaaaaagcactatcagctcagagaaagggttgaaaaaatgacaaaggagtacaattcaacagcggatggcgaacgaaaaacatttctctcaacggaacttggggtttttcaagggcgagaaacttttctgaaaaaacatttgcatttgattgaagaagaggcgaagagaagggacggtgagcagcaagaatccaatgaacaaagactcattgaccgtttctttgcccgataccctgccaattatagagagcagctggacgagtggaggtcaagttacctccgagatgtgctagatctacagacaaagatgggaga

SEQ ID NO: 68889 - DNA, 103 bp, Heterodera glycines
  Genomic contig location: Contig_ID=SeqID_40620; Location=591..693; Strand=+
  SCN-specific regions: Sequence locations=1-103
atggcattgtggcctacttgtttggacttcatttccattgtccaactgaacagagacgaactccttcatcagctggagaaagcgcttcttatatttattttca

SEQ ID NO: 68890 - DNA, 1199 bp, Heterodera glycines
  Genomic contig location: Contig_ID=SeqID_40621; Location=1..1199; Strand=-
  SCN-specific regions: Sequence locations=1-192,216-358,380-1199
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaagaatagatcgattttttccagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataacaattatttagatgaactgactatataatatttaaaataggttatttctcttcctttcagtatccctgcagaagttggtgcgcttctgatcagtttctgaaaaaaaagttaagcctaaacttgttggcctgtttaaaaaggaattacaaatttttaataagtgtattcatctccctttttgatagaaaaagcatcatag

SEQ ID NO: 68891 - DNA, 809 bp, Heterodera glycines
  Genomic contig location: Contig_ID=SeqID_1153; Location=1096..1904; Strand=+
  SCN-specific regions: Sequence locations=1-590,612-748,770-773,796-809
atggtcgagtcggtcagcagcgagacgaacattgtcgaaatggaggccaaatcggacgccaaagtgagacggaaaatttaaaaaaaattgcgaaaattaacgaattcgttgaatttgcattcccataccgtacccctttgcgttagcgtacatctaccgtatctatctcacttttttacagactcccggcctgcccgactgggcgcacggcttcttctcggcgctggacaagaatttgctgattcagaccgccaatgtggccaactttttgtccgccacccaatttgtggagcacttggccaatttcatcgcgttgaaggtgggcacagcaccagcagcacaccatcgggaattcaaactcccgattggtccgtccatatatccgggcttatttgcctattttttggactttggtctcgagccttgaccattttgaataacgttttcgtgaaaattcactcgaacgcattatatttttttgagtctcattctcgagatttcgattctctaataccccctattgttatattatttttggcattttttgaacgaaaatataattttgcgttccatcatgcgcagtgccgtgagatggactcgtcggctgagatcatggagttcctcaatgtcggcaccgacgacttggaaggcgaggagttgcgcaaggagttgtacaaccactgatcgaccatccgtctcggtcaattgatcgggaggaaagagacccagctaattgatttattgtggcaaaatttctgatcaccccccaaaatcttgtgccctttggctttgtgtattgtatatcaaaa

SEQ ID NO: 68892 - DNA, 124 bp, Heterodera glycines
  Genomic contig location: Contig_ID=SeqID_8700; Location=624..747; Strand=+
  SCN-specific regions: Sequence locations=1-34,57-85,107-124
cggacatttgcggccaacgaaacgccaaattgtcattcctttttcaaattaattataccaaatatttttatttaacacattcaccaattattttgttcaatgacttataataattttcaactaa

SEQ ID NO: 68893 - DNA, 208 bp, Heterodera glycines
  Genomic contig location: Contig_ID=SeqID_8701; Location=2272..2479; Strand=+
  SCN-specific regions: Sequence locations=1-208
atgaatcgtaaaaaaattgaaaatcttcaaaaatgtcgtaagcgcaagtttttggataacaatgacagtgaaaacgaaacgctatctgctgatcaccgtgaacaaaatgagaacaacaacgaccgcgacgatgattttgaagaacacgccatcgtaaacttcgaacttggagaaacgaaaagaggaggtgtctgcatttggtttaatg

SEQ ID NO: 68894 - DNA, 393 bp, Heterodera glycines
  Genomic contig location: Contig_ID=SeqID_8702; Location=1033..1425; Strand=+
  SCN-specific regions: Sequence locations=1-66,146-233,255-297,319-393
atggacgatgattacgacaattatgtgccccaaatttcgaccatggactacagtctgttgcagccgggcggaagcggcggcggcggtgccacgggcggtggtggcactgccggcatgggtggtagcggtggacagccgcaacagcaacattttttgtacgatgccgggggcgggggttgcggcacagtgatgccacccggcgcggtgacagcatcgggcggcagagcgggcctccctcccggcagcggcggcgggcacccacaatttggggggcacttcggtgccgccgagtttggcggtgctatgccaggacaggttaatatgcctaattgtaaagctaaggatggcttatattagtcaattaaacgataatatcggtgcggaggcggggga

SEQ ID NO: 68895 - DNA, 543 bp, Heterodera glycines
  Genomic contig location: Contig_ID=SeqID_8702; Location=1981..2523; Strand=+
  SCN-specific regions: Sequence locations=1-38,62-240,287-461,484 -507,530-543
atggcaccaccgccccatatgcaacaaatgatggcacaccgccagcagcagcaacagcagttaatgggtggcggtcagccgcagtttgacccgcgctacggtggtgggagtgcagcggttgtgccaaaaatgtccgccgctgcggcacaaatgatgtcacagcatcaacaatcaacggcggcttctggcacaaaagcggggaaaagcggtggcagcaaaaagggtggcaaaaaagcgtctgccgccgccgctgcagcggcggcagccgcagcggcagaagcagcaggcggtggtgccgtaacagtgatggaccatggaggtaatcaagcgccatgcgccgcggtaggaaagggaaaagccgtgatttgccggcttccaagcgcgtcgttttgtctcatgcgtcatttcgtccaccaagccaaatcaagttaattagtccggcaaatttcccaattttttccgctttaaaaagaaaatcaatgtatttaatcaaaaaaaaatttttgggaaagacaaaaattgaaataacaaacattgagatca

SEQ ID NO: 68896 - DNA, 696 bp, Heterodera glycines
  Genomic contig location: Contig_ID=SeqID_40622; Location=191..886; Strand=+
  SCN-specific regions: Sequence locations=1-7,54-218,247-500,534-696
atgctcattgtttctttattttttgttttctgtcaaattttgctgctgttgacagtaaaaggcgatggaaattacagtcgacaaagcgattacggtagtgccggtgtttccgacggttctccgccgcccatttcttcgggtacaaatctgtacaataagcaaaaactgatccaaaataattgaattgtattaaataatctcgttacattaaaacttacaaaaaaataaaaataaaaattttatttaggggctgaaaaaacggtagacgaatttctgtccaaattcgaagcgttgtccgcccgaactgattccgatgatgtcggcgttctcatggcacaactttcccaaaatatttcctccttttttgaattggctctccccgtcggttcactcatcgcgggggcccttcaaattagcgacaaagtaattcataattatcattcaacggaatatacggtagttcggcgtaatgcatactgtaattgattagaaaagcaattaattaataattgtgccaaaaatattttgctttgttagcccgaatctgaacaatacaaagcgatggagaaactgcacgataaatttgatgcaaaacttaaagaattggacacgaaaattgtgagatcttggcaaaagattgacgtgagcacgcgaatattcaacagttacgaagatgtaattagctaattatagtaa

SEQ ID NO: 68897 - DNA, 840 bp, Heterodera glycines
  Genomic contig location: Contig_ID=SeqID_40625; Location=5..844; Strand=+
  SCN-specific regions: Sequence locations=1-6,28-315,337-341,363-840
  Gene Ontology: Mol. function=manganese superoxide dismutase activity; Cellular component=mitochondrion; Biological process=superoxide metabolism
atgatttccaaatgcaacggagtttgtcggctttctattgggtgagtgcagtaaattcacagacacacattccatttaattgcaaattcatttaaattttccagttttcgatcgctaacgagcgctcagcgcgagaaacacactttgccggaccttccgtaaactcccaaactttcagttgtttattttacacttccaatttcatttagctacgattacaatgcacttgaacctgcaatttctgctcagattatgcaacttcaccaccagaaacaccatgccacttatgtgaacgttttgaatactgccgaggaaaagactcaggaagctctttcaaagggtaacacttagtaaattggaagcaaaccaagaaacagctgtataaatttgtctctgtttttaagcatagttccatcgtttcgttagcgctttatatttccctcccgacttcatttgtcttcccatttctaggtgactttcgcaccgcaattcaactgcagccaatgctcaaattcaacgggggcggccacatcaatcacagcatcttttggacagtgttggcaaaagatggcggcgagcccagcggcgatcttttgaagaccattgaacgcgacttcggttcggtgcagaaaatgcaggagaaagttagcacgaaagctgtcggagtgcaaggctccggttggagttggcttggctacaacaaagagctgaagcgattgcaggtggccgcctgcatgagccaagatccgctggaggagaccactggtgagcattcacatacgaacattttaggttaattatatttaaacctggtaaggctatacttattcttccggtcca

SEQ ID NO: 68898 - DNA, 207 bp, Heterodera glycines
  Genomic contig location: Contig_ID=SeqID_40627; Location=187..393; Strand=+
  SCN-specific regions: Sequence locations=1-207
atggtcactcaatttttgcgtaccatcccacaatttccgcctgcattggacaaaaatggcactgttttgcttggcactgttggcattgatcggatgccgtcaccgtccccacatgcggcaaatgcaccggcaacaaatccgctcaaatgggtgccggccgccgaacgggcggcgcgcgaaggcgaacttcgccgaagcaaacgaaaa

SEQ ID NO: 68899 - DNA, 398 bp, Heterodera glycines
  Genomic contig location: Contig_ID=SeqID_40630; Location=602..999; Strand=+
  SCN-specific regions: Sequence locations=1-398
atgtttgtaaaagaacggtttgtgccattgtccaaatttgttcaacaatctccggtcatttctcggcagtttttgggcgaattttgcacaaatcaacacggaagtgccattgccaaattgaatggcttcgacaaaatcattgcctttctttggcacggattcctcgaggagccgaccgacgagttcctttttttggggttgaaatacgaaaaggatcaaccgactgaccttttgggaaaggcacggttggtagaaaagcttgacgaagggcggacaagggacaattcggagggtggcggacacgagaaagcccaaagagccgagggaccacggaatgccgaagaacagcgactgattctctccatcctttggcatttaaagcatcaaaaaggccaaca

SEQ ID NO: 68900 - DNA, 1236 bp, Heterodera glycines
  Genomic contig location: Contig_ID=SeqID_8704; Location=1680..2915; Strand=+
  SCN-specific regions: Sequence locations=1-11,33-348,370-417,441 -654,681-720,749-1102,1124-1236
atgaaatgtagagaccggaccgggccgggcccggtaccggtttttaccgggcccggaaaccggaaccggtgatttttggaaaaatccggtttgaccggttttccggtttgaccggtttttgagagaccgggcccggaaaccggtcgttttttaaaatgcaacccggcccggaaaccggccttttggaccggttttgaccggttttataatcaagccaaaaatgtttctttttgttcatttttctttgaaaatgtctttttggcataatgtttttaatttttttttgtcaatgttcaagttgaattttttaattctaatgtttgcttctttataattattaaataatgtcttttttgtttagattttatgcaaatgagtcttatttggcaaattggcctatttaaaaaaacgtccaagactacagcaatttgtctcgagtgccaatcaaatgaaaagccgaaatatgaattcaagctcaccaaaggaacggtcaaaagcttgcacacccatcttcactgctttcacgaaaactccgaattctctgaaaagctgaatgctcttgaatcgaaagctgaaaaggagaaacaaaaacagaagccaatctcagactttcagtcgtcctgcggaccgactttttcggactgtaattcagccaaatttttttaaattatttaatttttgtttcagcacaactctcctcgtttgataagaaaattcttcattttttggtgacaaaaaacatttccttcggcgctgtggatcaccaaacttttcattctttatttccccatcaaaaagtgaaaagtgaaagtttctataggtgatgagttacattaaaagttatgagaaaattacatttttgaaattttcagaaaaactgccttgccaattgtttaccaacgtgtcagacataaaatcaaagatgaattaaaagaatcagcatttattacactgacaactgattgttggagcggaagcacttgcaaccttctgtggtacattattactttgtttattaatcatcatgggttttactgcagcctaaccgcgcactcaatttctaaatggaagtctatgtcacgtgttttggcaattacggaattttctgaatcacacacagggaaaaatatcgcgctcaaaattgaggatttattgctcaaatggggtattcctaaggaacgtgtgcatgcaattatctcggattcagcagccaatatgaaaagagtgataatctaa

SEQ ID NO: 68901 - DNA, 101 bp, Heterodera glycines
  Genomic contig location: Contig_ID=SeqID_40633; Location=1084..1184; Strand=+
  SCN-specific regions: Sequence locations=1-101
atggcagaagtgaaaaaggagcccatttttacggaagtgaagaaggagccaatttttgcagcggagacgccagcagccgagccgagaagggacagcgctta

SEQ ID NO: 68902 - DNA, 369 bp, Heterodera glycines
  Genomic contig location: Contig_ID=SeqID_40634; Location=1..369; Strand=+
  SCN-specific regions: Sequence locations=1-369
taagaaaaaaggtaacgaaaccagtggacaactgtcggcctcacctgtcaataatttgtttgaggcttgcgattttttgttttggcattttatcacaatttctagggcgttgagttgccgccgtttactgacaatcagatgaatgtttggtttaagtatttgtcctgcatcaattcgcggatcagagaagtattttttttagattattatatggaacgatgtccgtccttttatttttagattaccgaggatgcatgagattattttatttacctaaaagggaacggatctgaatttatttatcgtttcggtgcaatttaaagctgattcaatttgtaaaaaactatttgactattaaacaatattcga

SEQ ID NO: 68903 - DNA, 1041 bp, Heterodera glycines
  Genomic contig location: Contig_ID=SeqID_40634; Location=724..1764; Strand=+
  SCN-specific regions: Sequence locations=1-89,111-530,562-568,590 -787,809-824,850-1041
  Gene Ontology: Mol. function=protein phosphatase type 2A, intrinsic catalyst activity; Cellular component=cytoplasm; Biological process =cell organization and biogenesis
atgccaaacactgtctccgtacaatcccctgctaccatttgcggcgatattcatggacaattttacgacctaatgaaattgtttcaaattggaggtgacattctcgaaaccaattatgtgtttctcggtgactacgttgaccggggctattataggcgagtcaatttgaaaatcaaattttattggtcgtccaatgaatgtgcagaatggcaatggggcacacgcaatcacaaattttgcgtatggttccttccacaaattgagaatttgggcctggtttcttaatgagaagctcggccttgttttcattattaatttatccacgtaaaaccaccgaaattaatacacaaaaaaaccttttcatatgataaaatgtttagtttggaaacgatctcttacctaatgctgctgctgctaaaatacccggacagaataacacttctccgcgggaatcatgaaactcgtcgaggtaaccttacgactgggaccttgtctttgagtttggccctaaaactaagttggctgtgaaatttgggtttttcaaaaatgaccaaatttagcggttttgagcaaatatttcaagaaaataaggatttagggtcggtggttccgatagacgccgcccgggataaattgaaaatttcagtgctatttattcatagaattatacaaaaattgctagtttttggctcaaaatcgctaaattggtcgcactctctttgtttattacattgctttttttatttgtagtcttttctttatgttaattgtactataataaaattcatttgcttcaatttcctttttcattaagtctcacatcagtacggcttttacgatgagtgccaacaaaagtacggaaattctgtggtttggtcctggtgttgccgcgtcttcgacgtgctgcccattgccgctgtcgtggacaatcaaattttctgtgtgcacggaggattgagtcctgaacttccgacacttgattcaataatgtgccttcagcgcaacgtggaagtgccggcaaatgggcccctttgcgacttg

SEQ ID NO: 68904 - DNA, 346 bp, Heterodera glycines
  Genomic contig location: Contig_ID=SeqID_40635; Location=239..584; Strand=-
  SCN-specific regions: Sequence locations=1-1,24-160,190-319,344-346
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctattaaaaaa

SEQ ID NO: 68905 - DNA, 364 bp, Heterodera glycines
  Genomic contig location: Contig_ID=SeqID_40637; Location=23..386; Strand=-
  SCN-specific regions: Sequence locations=1-364
atgtcggagtttgaaagtgaatgcagtggcactgccaaactgaaccagttgggcccggtcgaaatcaatgccgacactctgtacactacgctggttgtccatgctgttgaacaccacgatggtggtgaccaagaaatgccatcaaaaaacaaaaacaatgccaacaccgacggcaccaccattgatggagggggacaacgacgacaaattgttgatgaagaggaggagttgaaggaggaaccgatggacgtgcgacggggccaaacgcaaacaatggaagcagacgaagaaggaggacaatgttgcaacgaggctgaaaagagcggcggcaccgcttcatcccttgacaaaacgtcggatggtg

SEQ ID NO: 68906 - DNA, 442 bp, Heterodera glycines
  Genomic contig location: Contig_ID=SeqID_40640; Location=436..877; Strand=+
  SCN-specific regions: Sequence locations=1-77,100-231,253-442
  Gene Ontology: Mol. function=general RNA polymerase II transcription factor activity; Cellular component=transcription factor TFIID complex; Biological process=regulation of transcription, DNA -dependent
atgcaaagaccgataatcgtaaatataattgctctcgctaatctcggtaccggaattaaactaaactctctgacgatcaccgaatgcgaatttaagtataaccctagaaaattcaatgccgcggttatcaaatgtataagccccatcaaagccacggcattattatgggaatccgggaaaatgatatgtctggggacgaaaagtctgatagactgtgaaaatgctattaaaaaatttatagaaataattaagtgctcggggtgtccgggggcttcttacaccggacacacgattgaaaatattgtttcgacctttaaattcggacatgaaattgaactgaacgaattcagaaaaaatcgtcgtgccttttatgaaccagaaatattttgcggtttaaatttcaagcggggtaaaagcatgacagcgttaattttctggaccg

SEQ ID NO: 68907 - DNA, 651 bp, Heterodera glycines
  Genomic contig location: Contig_ID=SeqID_40641; Location=1..651; Strand=-
  SCN-specific regions: Sequence locations=1-573,596-651
  Gene Ontology: Mol. function=extracellular matrix structural constituent; Cellular component=collagen type III; Biological process=positive regulation of body size
gaccatttccatcttttggccattggctgttgctccgtcgcacttttcagtgttctcgcattggcaatcggtgtgccgattttgtactcacaaatcgactcggaacgttcaaatattttggcaaaatcgcagaaattcaaggcatttttcgaaattccagcttaagctctcctccccccctaaggctgattccaacagagtttgggctgttctccattttccgactttcactgagtcgcgaaataagcgctcttcctcagccgaacgtggcggccaaagtgccttagactccgcttgcagctgttcaatgttgagttgcccacagggccctcctgggccaccgggattgccaggcccggacagtcctcctgggcaagccggaagtccgggcgagtcaggcgtggacggattggacattgtcgtggaatcggaattagacttgccgtgcactgtgtgtccaggaggaccacccgggcaaaggtttgttcatggtatagcatattttaaagaactttttcttaagaggccaccaaggcgagcgagggatgtcgggcattgcgggactccgaggggaggaaggaattgaggggagagagggctccccgggaccgagaggctctgttgggcctcggggcaatttgggcctaaagg

SEQ ID NO: 68908 - DNA, 444 bp, Heterodera glycines
  Genomic contig location: Contig_ID=SeqID_8705; Location=318..761; Strand=+
  SCN-specific regions: Sequence locations=1-164,199-371,393-444
atgacaacaaaggagggtatcaccttgtggtgcacccgagtggacaaaacgcaattcatccctttcgatgtcgtctatgatcttcctgggcattgcttcttccgtgtaaaaaataaagcgagagtgttcaatgtcccatacagtgatctatcctctgacacaatcagcaccactaccaccaccacaaaaacaacaacatcaacccaaggcacgcagactgaggagcaggagttgaagcgtaaggccaaggttgcgcttgacttggtggaagcaggactattggctgacgctatgcaggacggcgcgcggtggaagaaagcaaagactgcaattaatgtgcttggcaatcttttgttggctgagtcgttgagcaacaacaacaacaacaacaaagccgacaaaaaggatgaaccccctgtgaacggaccatcaacgcaaccaatt

SEQ ID NO: 68909 - DNA, 423 bp, Heterodera glycines
  Genomic contig location: Contig_ID=SeqID_8706; Location=323..745; Strand=+
  SCN-specific regions: Sequence locations=1-323,345-423
atggggcaagttaaaaaacctcaacaacatgtaaagattggtcaactaataaaagacaactccaattggctgtgtgccctggcgaggacgaaatcccagaaaaaatgtaagaagttgatactcaaagcaaacaccgaacaactacttgcactggtggaaatttgtttgaatcttgtagcttcacggttccaattgactacccgtcagacaaaaagattaatgccatatgtgcacactgttcgcaggatgagtagggcgagaagtgagcggggcgccaggcgtgctattgtacagaaaggagccggatttggtggactattcgctgcccttttgacgcctgttttgatcgaattagcaaaatctgttgtatccaaaaacgcataaataccgcgcagtattgtatgtttcatatgcattcatcca

SEQ ID NO: 68910 - DNA, 3070 bp, Heterodera glycines
  Genomic contig location: Contig_ID=SeqID_8706; Location=1036..4105; Strand=+
  SCN-specific regions: Sequence locations=1-16,43-107,131-437,461 -1029,1051-1508,1536-1687,1710-1902,1924-2386,2408-2430,2452 -2478,2502-2917,2941-3070
  Gene Ontology: Mol. function=zinc ion binding; Cellular component =secretory vesicle; Biological process=cell proliferation
ctccaccccgacctcccgctccaccacctcctcctccaccgcgtggaccaagacctcccgctccccctcgtccgccaccgcctgggagacaccctccgcgcggaccaagtcctccagctccaggtccctccccgccaacaagtcctccaccgcgccccgaacgtcctcccagacctagtagagcttctcggagaggtggtcgtctggagaaatggtggaaaagtcgatacaatatacagcgacggcagccggtggtgcgggaccttctagcagaagcagctgctgccccattgcccgaaagtgacgatgaagatgactatatgttggagagtggattcgcgctgccagcgccgtcacagtactatggcgatttgcctgtgctaccagacaatgcgaacgaaattgaggagatggacactgctcagcacaggattgccaccagaagaaaattacaaaaggatgaggcaaatgatgatgatttacgaaccaaaagatttttggtttatcaccgttcacctccacggctcccatctccgcctcgatcgaaagaaaaaactgaaccaagaccacctgcaccgcgtcctaccgccaagagagaaaaacaacaggcaaagctggattggaagaaaaccgaacaccctactccagcgcctcgggcgaaaagagagccagaacttaagctggacccgcggccatccacgtctaggcaagccgggtacttccctccctaaacgccgaaaatcaaaccaaaatatgagcaccaaccaacaaaaaggcccgtaccataccgtatcccggaaagagaaccaaaaattgaacgaactccacagcagcagcaacctcctcctcctactgctgtcgtcgaagaaatgccctatgttcctccgcctaggagggggaccaaacgcccccaccccgtaaatgatgagaatggtgaggtgcacataagaaaacgggtgaggcaaccgagtagggtaagggtacagtattcgccagagccaggtccatcgacatcagcacaagcttatgaacaacaacgacaacaacgtgaactgtttgccattccgtcaaatcagctgaccaagacacagagaattgagcgattatacatcaaatgtaaccattatgcggatcgtatgggcgttcggggaaatacaattaataccgcaaacggcaaaccgtttgcgcatagcaatttgcgaatgaccatcaagtatataatagaccggagagcgggcagccccaccattaaaccaccaggagcgaacctattggaagagcttaggcaggacccaattttgtattcatggacggccccaccaaagagaccatcgcagacccgaacggaacgggcaatcaagaaggaatttcgcccgaaaaaatggagctgatcaacaccactcttgacaaaatgtacaatgatccatcatccccagcggcattcgcaggtgttacagcgctgtggaaagaggcgcgaaagaagattaaacatttacggaaaaaggacgtacagcattattttttaaaaaacgccccgcttccgtaaagatgaatttgtgcgaatgagcagagataagggacaatttgagaagggatatttaccaaattatggagacgaaattctcgagattgatgaggtgttgaaagcggtgcgtccaattcgatacaaattgcgggatgaacatggtgagaaattcaagggcagcttctatgagcaggagttggcaagcgtgagaaaggacgcagagacaagctaccgtatcgagaaggtgtacaggaagaggaaaaaaacggacgggaccacagagatgcttgtgaaatttattggctatcccaatcgggagtgggttcatgagtcccaacttgtataaaagcgttcacatttttcaatatttatgcagataaacaatcatgtcaaacagtttctttgtgtttttgcctagtaatgtgagtgattaccctgacaatcagccgaataaattccgtgttcggctcccaaaacctttagattttaacggctcgtgggtgtgcggactgcacagtatcagttacccctactcatggtcaacattggcacattggatgagcaatggattgacattcacttcaccgaccgcagagcgaccgatgaggacagacagcgagtgatcagagtgccggtgcctaaggcatcgcatagtagggttgaacaactgagagaatttttgtctgtcactttgaggaatcatagcggtgcaaaactacaacctctccctcgtgaggtggaagagaatcggaatcgtactacaacaaagcctctcggctcgccaccgcctttgaaaatacagaaaagagatacggtgtttgacgcgaatagaaaacagattggccctcctccattgcataatgaaaatgatgacgatgaagaaattattgaggagtcaccacctcatcatgaagaagatgatgaagggccgattgaagagtcaccacctcatcatgaagaagaagatgatgaagggccaattgaggagtctccgccgcattacgatgaagagcaaaatgatacagtaacagctcctgtcacaccaaaagtgccggtacaagcgcctgtcacaagccctgcgaaaccaacaatagtaaaaacgccagttactccatctgtaacaacaccagcgcctcccacaactgcaaagccaccagtaaccgtcccttctccaaccacaaaaccgataacaccgaccctactcctaccacgaccacacctactccaaccacaaagtcaacaaccagccctccacctactacaaccgttcctccagcaatcacaaagccatcaaccagccctccacctaccacaaccgtccctccaccaatcacaaagccatcaaccggccctccatcaacagaaaagccaataacaacggtgcctgcaccgccaaagacaacaacaacaacaagtacgccagcaataagtgcagttcctagcccatctgttaagccgacgattccggtaccgccgtcgtgttggtactacggtagggtcggaggcgctgagcactgggcaacgcgtgctggagcgagtcgggaa

SEQ ID NO: 68911 - DNA, 182 bp, Heterodera glycines
  Genomic contig location: Contig_ID=SeqID_40643; Location=394..575; Strand=-
  SCN-specific regions: Sequence locations=1-1,24-182
aaaatctataaaaaatttaaaaatgagaattcatgcgagattttctggaaataagcttaatagggcctagttaagctgtaaaaaaaaatttgggggcgatttgaaagagaatagaaagaaccaggttcgatgaagttttggtaagccaaaaaaaatccaaacatttaaaaatctataaaaaa

SEQ ID NO: 68912 - DNA, 529 bp, Heterodera glycines
  Genomic contig location: Contig_ID=SeqID_40644; Location=95..623; Strand=+
  SCN-specific regions: Sequence locations=1-124,146-359,381-416,442-529
atggtagttgcatttgtaaaaggacagcaagaaattccattcagtgaatattcaaagcaaaaatatgaggcaaaccttggcattgtgtattttatgataaacaattggcactgtgacaaaatagatgagaaatttaaggaatatgaacggacagaatgccaaaaatatcgcaaatatttggatattttgtacgaatatttgtacagagagtacgtcggaattccaacagccaagccaaagtttgtatttcaaaaccaaattgaaattgacggtccaataatttatgcggtgaattgtctgaccaaaatttctcagttttatttaataaaatcggtgggacaaaaatatgaatataaattaaacaaaatgttctacttggttgacaattttgaaccaaaattgttgaatgagaagagatttaattataaatttaaattaaaagatgtatcaaaaatgccaattaatgaaatgattttgcaattagcaattgaaacagcgaatgaatggcaaacaaacgaaagtttaaacg

SEQ ID NO: 68913 - DNA, 945 bp, Heterodera glycines
  Genomic contig location: Contig_ID=SeqID_40648; Location=365..1309; Strand=-
  SCN-specific regions: Sequence locations=1-62,84-107,129-193,215 -371,394-416,438-465,487-539,563-670,710-750,786-821,843-945
ccctacccagccggctattggcatgaattgaccatgaaatttcatttctcccgtcgtgctggatggtaaaatgcaaaaataattggcacactttgccaatgaaaatgataaataaaataaattttgaaaacccacaatcaggtacattctgcaggcctacttacctacctacctcaccattttcatctgttcgttaaaatttatatgattttttccattagttttcacgcaaaaaaaaaaaaaaattcagcatggatttcttttgtgctcggtacacaggccattccggcccgaacaatgctcggtgttaattcacttttgggtgggaaatttattttatgtttcatcattttaatatttaatacatttctttcagcgatgaccttccaggttatattatcttaattaatggattcaaataaataaatgtattaattaattaaccatacaatttaatataattccatttgaatttttagtttggcaacataattcggtaggtcaaaaatgcagtgcagtcaaatggggcaggaaaattttgcttttaataagaaaattttcagaaatttgccaaaggtcagctatgttaaggcaatcgacatctggttgctttcctgcatgactttcgtgtttttttcgttgttggagcttgcttgggttggaaaactggaaaaaaattatgtaaattaaaaatttatataaatttttaggtgggctatttaagcagaaaggtttgttgttgatttaagcaaattaatttatatttatttttgattattattaaaggaagcggacagtcgcgaggctgcaaaagaggcccaagacgcagtggcggcggtggtccagcaggttacggtaccacctcctcgctacggtagcgtcgatgcgcaaagcgtcggggcctcctaccaacagctcaacatgcaacaacggttgatcaagtaa

SEQ ID NO: 68914 - DNA, 924 bp, Heterodera glycines
  Genomic contig location: Contig_ID=SeqID_40650; Location=143..1066; Strand=+
  SCN-specific regions: Sequence locations=1-107,131-357,380-620,642-924
atggagagtgatgtgaccgatggtctgtgggataaaatggtgctgtgtctgcgcagcattgtggcgttgccgccgaatttggacaggcaaagtgtgagttgtggaaatttatatgacatttttatatttgtaaatttgttcaaatttgattataaaaataaagacaatttttccgatgccatttcgttttaattgcataatatttcattgaagttagcataaattaagcatacacctcaatttcggcactataatgcttattttttgatttttaaaatttcaaggttaaataattacggctttttaaacctccgtaattgctgaatacgggtttcccgtaaatgacgcctgactgctccccttaataatttaaaattcaaaatgattgaaaaatattaacgaaaatttaatgcaggtttatccgaactcttcgtcatcgattggcttggccctgatcgtcagcaatttccgatttgaggaccgtgataacagggatggcacaaacgtcgatgagcagaatttgcgttcaaaatcgattccaaccttttttaaatggttttctatttttgatctatgagatatatttacccaatttttaagaaaaataagggttatagtggaaaatttttgaaaatttgtttggatttgttaactgattttgcctaattcggagatgattttttgataacaattttccatttcataggggtgtatttttctgaaatttttcggatcggttcttaggggggtgtatttttcgtgtttatggcatattggttattaattttgttgagaattgctgaagatattgttacaatcttttcttgatgacagaaacagcactgaatagcactgatgggtcatatcggcgcttaaatcgaaaagacaacaaatgatgacttgccaatatgagtagctgatcta

SEQ ID NO: 68915 - DNA, 817 bp, Heterodera glycines
  Genomic contig location: Contig_ID=SeqID_8707; Location=976..1792; Strand=+
  SCN-specific regions: Sequence locations=1-277,301-421,443-657,679-817
atgtcggaaatcggaattccgtgccatccctgttgtggatctcttggtagccaccaaacaatttttatttgttcgtctcatcgagactaattttgtattgcatatttcagttggagaagggcagatccaaatgagccgatagttggcacggtgaacaaccgaaaaacgagtggatgttgttgatgaaacttttgccatggagttttgggtcacttgatcactaatccggcaccatttcgaccaattttccgcactttctactctaacccaatgaaatttggatttattttttcttccaattcttgtccgggattcggaattggtcgaaacggatgccggtgatttaggatcactgtgatcactaatatggcaccgtgaatctgcagaattgtgacggaaaaacggcattgatggccgcgtgttggaaagaagcttttacagtactcaaaaatgcaacgttttgtctctaaaatttcaggacagtctccgcttatgcaagctgccatgagcgacaatttggaggcgtgctgtctgctggtggaggagtgggtagcagaagtcaaccaaccaaacatcgaaggcgaattcacggcactgatttgtgctgccagccggggatatttggggcggaaatgccgaaatggtggacatatgttggaagaatttggaaaaacaaaatgatttgcccattttcggttttaataatttacttgaacggagagatcaagaagtgacaaaagcccgcgagactcccaaccatcgcattttgaaaattgcaaaagacagttccaaatattttctgaataatttatttaca

SEQ ID NO: 68916 - DNA, 432 bp, Heterodera glycines
  Genomic contig location: Contig_ID=SeqID_8708; Location=979..1410; Strand=+
  SCN-specific regions: Sequence locations=1-432
atgggcgtcacattggcacgaaaagtgatccaaggtggatcggcacatattggaggtgatggtggtgacgagaaaagtgccagccctaacaagtgccatcttggcaatccaattcggcaccgtgtgcacacattggtcggcattgctggtgccaactacggcctctgtctgtgcacggcaaatttggctgtgctcagttcacccgcttgtaacaaggagaccggcttttggacacattctgacggatgtgccgccgccatgacttataaacatcatcaaatggaaagaagaagacttgaagagaagaggcattgtgatgatgggaaaagcgtgggaacagaatgccaaagcaaggaggaggaggaggagcaatattccaccgtgttgcgggagctgaacgcgccggacaaggccaaagatgccatttttgtg

SEQ ID NO: 68917 - DNA, 212 bp, Heterodera glycines
  Genomic contig location: Contig_ID=SeqID_40655; Location=718..929; Strand=+
  SCN-specific regions: Sequence locations=1-57,79-212
atgaacaagtggtctgcacttgtgtaagttttgtggggaggggtggggcttgaaccatggccaaatattaactctctgttcactttcagtctgttgatcgcgctgatcagcgcgctggacagcgctgttgttcgacaacagcgcgccgccgacgctgacgcatcgaaaccggaaccgaacaacgaaaagccaggcaaacttaaatgaattta

SEQ ID NO: 68918 - DNA, 236 bp, Heterodera glycines
  misc_feature (24)..(24): n is a, c, g, or t
  Genomic contig location: Contig_ID=SeqID_40659; Location=171..406; Strand=+
  SCN-specific regions: Sequence locations=1-65,88-131,166-236
atggaaaacactcacgcaaggaantgggaagaatttataggaaaaattaaacaaaagcttggcgtgactgaaagaacaattgaaaaatgggccaagaaaattaccaacatcaaaatatttcaaaagttatcttaatatttataacattttttaataattaaatttcagagcagaaggtttacacaattgtcgaaaaatggaactgaataagtaatattatcagctgaagaatgaaa

SEQ ID NO: 68919 - DNA, 556 bp, Heterodera glycines
  Genomic contig location: Contig_ID=SeqID_40661; Location=118..673; Strand=-
  SCN-specific regions: Sequence locations=1-556
atgtattggttacgcgggacgtagatcgaatggaaaacatttggtacgggtgcccagaattctgttgctaccgagtgcctctttaccatggaattaactttttcatgatgcgttaccaacttgagagcaacgaacgggcgcaacaagcggcacattggttttccatgaaccaaaaaaaaattgtcgaaattatcaggtcttgataatttgaaaaaaatgtattatttcttcagggaaaaccaaaaagcggatgagcttggcaccttggcaaaaatcatccaagacgaagttgggccaatcactgccatgccggcctaccacagcttcgtgtttttacgcgtaagcgccctctcggaaagaaacgccaatttaccagttggactttccaatacaatgtatatggggcagaccggatacagtatgttagaagtgtacatgcatcattggcttcccaaaaatgaagaacactttaaattgctattgttcctataaaatttttagggcatcttaaacaattgttgaaaagttcatattagcatttgattctggaaataaa

SEQ ID NO: 68920 - DNA, 2978 bp, Heterodera glycines
  Genomic contig location: Contig_ID=SeqID_8710; Location=1023..4000; Strand=-
  SCN-specific regions: Sequence locations=1-152,175-189,217-321,343 -387,418-448,518-654,676-783,806-863,915-1377,1399-1427,1451 -1795,1821-1839,1864-2061,2083-2121,2143-2339,2374-2472,2760 -2765,2825-2978
  Gene Ontology: Mol. function=extracellular matrix structural constituent conferring tensile strength activity; Cellular component= collagen type XI; Biological process=skeletal development
ggtgagcctggagcaccccctcttggccccccataccatcacatctcctcatccaatgccaacaacatcaacaatggcacggcaacttgctaccagccgtgccgtgatgggttgccgggtcgtgatggagtgccggtgctttcttttttccgatttcactatccttccatttctttgatttttaaagtcaaaaatttttaaataattttaaaatttcagggtgccaaaggcgagccgggagtgccaggcatggccccgtcaatgttggcacatgttggcggtggcaccaacacattgcttcaaggcccacctgggccgtctgggcccaaaggggaaaaggtgggtgggatggcgcttaaaattgaagatttctaatttaatttagcgaatttaatatttttgaaataaatttaattagggattaaaatggtattgttttcgaaaattctaaaaatattgattgtttaattaaattatttttgtaaaaaagcgaaaaaaaaaataataataaatttttctaaaacaaataggtaaatagaagcttttctttttttctttttttgtataattaattatcgattacatacatttttgaatctattaattaattgattgcgataattacggactgaaaagctttaatgaaaaatgtcctaaattttataaaaaataattctcgacacttacccttttccagggcgatttgggcccgcccggtctgccaggtcaaccgggcaagaaagggcgaaaggtacagtaattaaattattttttggcattccgtattctgtctgtctgactgtctttctcacacttttacacactgttttgtggtttgtcatgcacaaaaattgtggcgtatatctattgtagcaacaccaccaccaccataaacaacaccacaaaaaccagaaacaactgctggcgggagcagcaatacaagagcaagaattaccgtatagcaaagagcggcaggcacagtacggcgacgacatcaattatcagcgacaacaacatgcattggtgcaacaactgttgcccatgctgaaggaacaactgttgcgcaacctaagcagccaggctcaggtactgtattaaacaattttagggccactaccgtaatagccgaggaagatttactatattgatcttgcttggtctaaggggccacttccgtaattgcctaattgctttacggtatcaagctttaagggccattttttccaaaatcgggattgattgggcgggattcggtcgggatcccgaatcgggatccctcccgaccatttggccaatcccacgggatctcgcgggattgaagtccctataatttttagaacaatggtcaaaatttcggcatttggtcgtaaatatttaaaaagatttgagaattataatcaatataattcccagccataactataaagaaattatttaaataaataaatttgaaatttcccgtctctaattataaaacatatttcccagcatccgttcggcattcacactgtgcccggtccgcctggtccacgcggtctgcccgggctccaaggcctgcccggccatggcggtgaaaagggcgaacgcggtgacatcggcctacccgggctgcctggacaacccgtaaaaaaaaagaagaaaatttccaaaaatccattccatcgggtttggcctcctatctcgatttggaaccatatttagggttttctcagagattttttgctgccaatttcttgaaatccaatgaattgcctaaaaatccttttcaaatgaacaaaatgccaaggaatgtcttgacaaaaataattttaaaaataacagaatttttcatgggcgtcaaaaacctaaattttttataaaaatcaaccattataatgtttaaatctctaaaaaaaaatccaaggcgcctcctgccactccgaccgtcttcacaggaaatggtcaaccaaagatggtgattcctggcccgagggtaattaattatatattactcataaaatgcaatttttttttaatttttggcattttatttagggtccgcctggccttcccgggttgccaggcccacctgggccaccaggttggcattataactaaaaaccaagaataaaaaaattctacaggacctcttggaccacaaggaactcttgggttgccaggtagctgaaaaaatatgtaaaaataattttttacatattttctaggcctcccaggcccaatgggtctccgagggccgcctggcgtcgatgggagaagtgtaaatatatatttttccttaaattttctctttgcacgtgtgttttccaaaatttccattttttacttctttatattgtacgaaaaaattttcaaaaattttttttttaatttttagggtctgcccggcccaaagggtgacacaggcccacttggcccacccggcaccaaaggggacagagggccaaagggtgaccaggtaaatgatcaaaatgcatttaaaagataaaataaaaattgaaaatattttttttaatttgtataaatattgaagaatttaaaaaataatattaataataatataaaaataaggaaaattatatcagtaaagactaattttttacagatattttaaaaaggaaattaaaaataaatttgttactttttttttatttaaaataaataataaattttaatagaaaagtttgcgattcctttcataaattctttaattaaatatttttaattatttttaatcaaatataaaaagttatattttatttgaacccaattattttcaattacttttttatttattaatcaatttttaattttgtaaataatttttgcattttccagggcttgccaggcctcgatgtatgcccattttacttaaatccacaaaaaaaaaatgaaaattttttctttttcaggcgccctgtccacctgggcctgacggtcttccgttgccatattgcggtgaccctgctccattgcccgaa

SEQ ID NO: 68921 - DNA, 1147 bp, Heterodera glycines
  Genomic contig location: Contig_ID=SeqID_8711; Location=185..1331; Strand=+
  SCN-specific regions: Sequence locations=1-149,171-447,469-772,794 -799,825-1147
atggtgcataaatttttattgtaaatagtcacaaaaaaacttttttttactcgcaatatctaccagttatcatacaaaaaggcaatagttaggctttgagatataaaacaatcgtctagaataattatctcaacaatttgtcgggaaagttgaatacatttcagttgcaataggcatattggctctatacataaatgtagagcaggtttaaaatagaggaaataccaaagattaaaaaattggtggttatgagcttagtctggttggtctggtcatagggtcgcagagagtggagatagatctttttgttgatacatttgaaaaagtagagctagggtagatctattcgaataacttgaaattcgttcatatgtcctgacagccaatcagctgatgataggtccaggtccatgccatttttcggcaacctggatttttcctggacctggattttcctggatttttgtccaggaaatccaggtccaggtctaatgtgaaaaaaatccaggtccaggcaaaaaacgaaaaacctggattttcctggacaaaattttagaatttgttattttaagtgaccgatgtttttttcaagttttcaaaaaatgataaataacttagaaacacattattattattaattagatatttttagaggtttataagcaattaattgattttttcaaacatttttttgattattaaaatgagtttcaaaaaatccaggtccaggtctggatccaggtcccgaggagcctggatttttcctggacctggattttcctggatttttgtccaggaaatccaggtccagatccaggtccaggctttttcaaaatgtcgatctctagttaattctctaacgaaggaaaagccacacacgatcgcatggacaaaacccaatttcgagaaagcatttcgtatcacaaaaaatggtatttatattatatcaccacgagaaaattcagcaaaatttgaaagaccactttcaaggacgttttcaaattcaagaacgtccttgaaattttttgatccgttttctcctttggctttaatagcccaatcaaatgtatatctattggacaaaagaaaacagaaaaaaattcatttaaggactcaattacctgtgtgccttggtcgcctttgggaa

SEQ ID NO: 68922 - DNA, 255 bp, Heterodera glycines
  Genomic contig location: Contig_ID=SeqID_40663; Location=942..1196; Strand=-
  SCN-specific regions: Sequence locations=1-255
aaagacaaaaccttaaagcactagccgattgaaataaatggaaaaaaaagcaaagtcaaaacacaaaaccttaaagcactagccgattgaaataaatggacaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaa

SEQ ID NO: 68923 - DNA, 737 bp, Heterodera glycines
  Genomic contig location: Contig_ID=SeqID_40664; Location=71..807; Strand=+
  SCN-specific regions: Sequence locations=1-319,341-349,371-660,682-737
atgccacatacttttcgtacatttacaagtgcaaaaagcaatcattgggattttgacaatacgtgttgtcctgcccctctctctcttcaggtattcgccgcttcagcagctcagcgtcactcccgggaagcagtggccggcgactcttttgctctcggctgaccatgacgtgggtttgcccatgctttaatggcatggactcgggaatatttacgtgagattgttttcaccgggatttgagaccgagaaatcgaaccgagagcccaattccgagaagttctcgactcaaaagccgagagactctcataaccctcactattctgctgcttttttcaggatcttgttgatgtgtctcacacactcaaatatacggcacaactgtatcatttgttgttcaccaatgctgagagttggcagcgcaaccccgtggtggcaaagattttggtggaccaagggcacgcgttcaccggcacaccgaccgagaaaaaagtgaagcaccaattgcactaacaaaagccccattttgacattattatctttttcagatcaaagagaaggttgacatttacactttcatcgcgcgagcgcttgggctgaaatggaccgaatgattaagaacaaatccatctgtgtgatcactgatcagatcattatcgatgcaatatttttaggattttcttttcataaatttgcattccataaaattttgggacaactattcaaaagggaaaattcca

SEQ ID NO: 68924 - DNA, 1483 bp, Heterodera glycines
  misc_feature (27)..(27): n is a, c, g, or t
  Genomic contig location: Contig_ID=SeqID_40670; Location=1..1483; Strand=+
  SCN-specific regions: Sequence locations=1-5,27-1067,1089-1483
  Gene Ontology: Mol. function=alpha,alpha-trehalase activity; Cellular component=extrinsic to plasma membrane, GPI-anchored; Biological process=trehalose catabolism
cagattccagtgggttcatgtgccaancagattccttgtgcccggggggttgttcaagctgtatttttactgggacacttattggatactcaaaggcttttcagcattaaaattcattttaattggtttttttaggcctttacttttcaaatttggtcgaaaccgctcgcggaatgcttgagaatttcgcgcatttgctccgtttccgcgggttcatccccaactcgggcaacgttcagtaagcattggcacttttcgccctttttgatgcttttcgcttttccttccaaagactttcgcggcgaagtcagccgccgttgttcacgcaaatgatcgccgattattatgaggtgacgaagaacaaatcttttttggccgagtatttgccaatggcggagaatgaattggcttggtgggaggccaacagaacggtggaagtgcagcggaacggggaaaagcattcgcttttccgatacaatgtgaaaacggaagacaaacggacaaaagctgaccaaagtgcggcatttaaggccatcaccgattgcccacggcccgagaatttcctggaggattaccaattgggcatggagtccgacgacgcgactttcttctggtgagctaacaatgtgagaaggcatttgcaaaagcgcaaaaggtcttccacggcgagtgcgtgcgagtcgggcctcgacttcagctcgcgttggtacaaatggggcaccgaatcgaaagcaatgcgaaggactgccatcgccaccagcgaagtgctgcccgtcgacttgaacgtgttcatggcactgaactaccaaactttggccaaactgtacgacgaggaactgaaggagcacgggtagaaagaacggcacggcactttgggacaaagtgaacgatttaatcacagaaaggcacggaaaaacaaagagattgccgaagcaattacggcacacattgacagaacattttgggacgacgaagagggcgtttggttcgattttgacctgacggagaaaaaactgaggaaaaagttttatccgagcaatatttatccaatgttattgaagaacgacggaaaagggacgggggaaaagtgccaaaaagtggtggaatatttgaagaggagcggagcaattggattcaaaggtaaagcggcgggggatgagcagcgattggaccaattcatacgggacagacaaagggtcaaaggatcagaagagtcgtcaaaatgaataaattgaaataggcccctttaaattgaccctttgctcttgcgtaagtcatttgctctcttcccaaggcggagtgccatcgtcgttggaacggaactccaacgagcagtgggactttccgaacggatgggctccacaacaacatttggtggttctgagtctgctcaagtgccaaaatgtgtcgggcgaagctgccggaattgctcgaaaaattgccgaagcatttctcacaacgacttacaacggattattcactc

SEQ ID NO: 68925 - DNA, 622 bp, Heterodera glycines
  Genomic contig location: Contig_ID=SeqID_40671; Location=768..1389; Strand=+
  SCN-specific regions: Sequence locations=1-166,198-247,275-288,331 -331,364-523,545-622
atgaaattaaatggaaaattggaaggaaaaaagaaaaaatgccaaaaaataatagcaaaacatttgggcacaaatatcagaaacatttattattggaagaaacaattaaaaagtggaaaattggtgcaaaatcaaaaaaatgatgagcaaaaaagagaaattgttgaaaaatattttaaaataaaaattaaatttatgcaaaatagaaaacattcacgaaaagaatgggaagaatttagagcaaaaattaaacaaatgtttggaatttattatagaacaattgaaaaatgggccaagaaaattggcgtttttgaaaatgtttcaaaaagtgaattaaaaaaaataattaaaaaaaaattttttctatttacagagcgaaaaatattaacaattggtgaaaaaatggaattggcaacgcaatattatcaaatcaaaaaagaaaacccaaaaatcaaagaatacgaaattgcaaaaatatttaacattccaaaaaactcattacgcaaatacaaagccaaatttggcattaaacccaaaaacaaattgcactaatggaagaacattattatcaaaagaatttttagtggcaaatttcactgaaaagatgaaaaaaaaacctaaa

SEQ ID NO: 68926 - DNA, 633 bp, Heterodera glycines
  Genomic contig location: Contig_ID=SeqID_8714; Location=650..1282; Strand=-
  SCN-specific regions: Sequence locations=1-74,96-145,168-633
atgccacggcactgtttctttttccagcttttgatctctcttctgccattgttctcaagtggtggcaatggttcaactttcttcttccacaaagtttggccacttttctttcggagaatggcatttggcaaaatgccaatccctcgtcaaaaatggcttgcatttttcaccgatgttcagaaagattcggatgttttcacgcgtgaccatgtcaaagtgaactgctcggagcccatctgtatcggacattaccgggagatttactgcgaaggggcgattatgtgggcagcttggtacttcggccttcagaacgaatgcccgggcaatcgaatgcgatttgaggcggaagtcattctgaaaaactttgacaggtggacaaaaacaaaacaaaaaacaatcgaaagagaaaagcaaatggaaaaagcaccgaacagaggaatttgccaaatgccaatccgttttaagcagctttgatcagcagggaaggctttaccgggaggattttcgccgcttttgcaaggaaaacttcgacgatcggccgtatttggaggaggcgcaagtgaaagattggacggccgacttggaatttcttgacagaatcacatcgccaaaaatgaagtcgaattgcattga

SEQ ID NO: 68927 - DNA, 144 bp, Heterodera glycines
  Genomic contig location: Contig_ID=SeqID_40673; Location=635..778; Strand=-
  SCN-specific regions: Sequence locations=1-144
attttatggaaaattttatgaactttttatcatccaacaaaattaaatcagtatttgtagtccaacattgggatggccttgttcaaaaatatcaacatttctgcggttttcggctttaatctcgaacgtcgataatcataaaca

SEQ ID NO: 68928 - DNA, 467 bp, Heterodera glycines
  Genomic contig location: Contig_ID=SeqID_40674; Location=70..536; Strand=+
  SCN-specific regions: Sequence locations=1-467
atgtgcatccgtacagcgatgcaaacgggcgctgttcgcgcttattgcttaaccttctgtttttgaaaaaatcggtggcttccatatatcctctaatatataaaatgaacaaaaattttagatgcctacagttgtcattccagacaatgattggttccgatatcaagaagcgatcaaaaaattcacaattaagtcggatgacaatcctgagttgacgagcgaacccgcaattcaattcattgagaaattactccaaggtgcaccgggcgatgaaaaaaagtaaagagacgagcgttatatttaaaatgaaaaaaattacatactaaaagttagttgggcgagaactggattcccatgggaaacccggaatccctttcctttttttgccggtactgttaaaaatttggtacctccttattttaaaatattcaatcccgaaaattcgatttattaatattttacgatca

SEQ ID NO: 68929 - DNA, 748 bp, Heterodera glycines
  Genomic contig location: Contig_ID=SeqID_40675; Location=681..1428; Strand=+
  SCN-specific regions: Sequence locations=1-393,415-748
  Gene Ontology: Mol. function=calcium-transporting ATPase activity; Cellular component=integral to membrane; Biological process=hearing
atgtgcgttttagacaagcagaaaattttggccggtgtctctgacggcgacggagccgtggcgcaacacgcgccggacattacgctgggggaaggggcgaagcctttgctggacgaggagggggaggaaagtgagtggaattggcattgggccaatcggatgtttggcattccgtcaataagcattccaattattacgataaattgaccaattcgtcgttcgttttgattaattcccccccccctttttttaattttcccttttttattgtttttcatttgttgtgctttcattgtgtcctttcgcttattggatagtaagtaccaaaaccctaaaaaaagaacactttcagacatcaaacttgacggttacaatggcgcaatccctccggggtcggcaggaagggccaaagacgacttggaagttcagccggccaagaaggaacggtcggtgcttcaagccaagctgactcggcttgccattcagattggttatgccggtgtgtgaggggggggggggggcgacggaccggcgaaagtgtcccatttgaggctcttttgttgctgcttgtacggtgcttattttgggaattcgcttttgcatccaacactacctaatcgaccaaaaaccattcgttgtcgccgactttcgctatttcgtcaactttctgatcatcggcgtcactgttctcgtcgtggcagtgccggagggattgccattggctgtcaccctttccttggcctattct

SEQ ID NO: 68930 - DNA, 701 bp, Heterodera glycines
  Genomic contig location: Contig_ID=SeqID_40677; Location=194..894; Strand=-
  SCN-specific regions: Sequence locations=1-462,484-626,648-701
atttggtgcgctttagagcactttctgaaaaaatatttatgaaataaaaaaatcgatttattcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgctgaattaaagtacagactatagggaagctattcccgaagaattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaagaattcggtctccccataaatctgggcgcatcggttcggggggactgccccgaaaac

SEQ ID NO: 68931 - DNA, 130 bp, Heterodera glycines
  Genomic contig location: Contig_ID=SeqID_40678; Location=877..1006; Strand=-
  SCN-specific regions: Sequence locations=1-130
ctcaaataacaaacactaatgtttatcaaagacatgtcacacataattgtgtcacactaaactcaaataacgaacactaatgtttatcaaagacatgacacacataattgtgtcgcactaaagtcataga

SEQ ID NO: 68932 - DNA, 689 bp, Heterodera glycines
  Genomic contig location: Contig_ID=SeqID_40679; Location=294..982; Strand=+
  SCN-specific regions: Sequence locations=1-667
atgccgtcggcagtgttggcgtcgcaacaatggtggtggcttacagcaatggcggcaaacccaaatggcaccagcaacagcagcgaattgtgccggcctaaaatgctgccacgtattaatgatgaattgggaccagcttttttgttttattgggaacagctcatttgtgatggttgggaacagctcatttgtgatggttggaaactgagtgtgatgaattgggtccagctttttgtggtgaattgggacctgtgggaccaaatttatgatgtgggttcagttttttatgatgaaatggtaacaatccattgtgataaattgtgaccagatttgtatgaatatttccgtagttttcatgttagccaggtccctaaccagaaataacttcataccgagtaaaacgggttagaatttttttaaatatctcatcgcaaaccaatatttatccaatgctgacttctgttttccaaaattgggcgagaacaaatgccaccaggaaaattatgaaaattttggttaatttgttaacagaattattggaaattaccgaaatatttaaccatttttctttaaaaaaaattctgcccgctccccgctcctggttacggttctgatagccagcccatttcgggtaattaaccatttttagttttgttcgaagcttttattataaccaagttttatttcaa

SEQ ID NO: 68933 - DNA, 148 bp, Heterodera glycines
  Genomic contig location: Contig_ID=SeqID_40680; Location=92..239; Strand=-
  SCN-specific regions: Sequence locations=1-148
atggtggagaaagagaccgacatcgctgccgctgtgccaaacaacgctgcaaacatcggtcatgttgaagctgtcgacccatcggcatcgaagagcgctaaggaggtgccgaacaacaccgagaagcatagtgccgaagatctaatgg

SEQ ID NO: 68934 - DNA, 891 bp, Heterodera glycines
  Genomic contig location: Contig_ID=SeqID_40681; Location=155..1045; Strand=-
  SCN-specific regions: Sequence locations=1-604,626-891
atgaccctcaagtgccttccgcccgaacttttgttcgaacttatgccttttgtccctgctgaaaatgccgttccggatgcgatttcgtcatgtcgactgttccactgccttttgtttaaacgtgtcctcaattggaaaaaggtgagttttataaataaatcgcaaagaaaaagcagaattttttcacactcttatttttttactcgttcaattatttaattcgctggttcagatatccaaagttttagaatttgataacaaaagacttagaagttgtttttaaattgtatctaaaacgctaaaacaaggtaaaaagaatactgcgaattttttttcgcatatgaattatatatatcaatagattcctttcagtgaggggagtcgaatggtactatttttagggcgcggcgacaattctgaacagagttacagactcgggactgaagtgtccaaatcgctttaggacttgaccttaacaaaaccgattatatcaaaagcataataattatgattaaacataatttattatgactagggctgccaaaagtatgcaaatgcatatttttttcctggcttctccatgctctaaatagtacgaaaaacactttcttttttgtgtttgcgtataaaaatcgggacttttaaatttgcatattttgggcctttatgcatatttttgcttgttttacattttcatgcatattttgccattttttgtgcatattttccgattttttgcatattttgccatttttcgtaaaatattttccgttttgaatatcccttaagtaaattttggcagacaataggatgagctttagtgccgaaaatcttgagaaattattgattttcaattgcaaaaaaaaaccgataaaatttatgaggaataaa

SEQ ID NO: 68935 - DNA, 424 bp, Heterodera glycines
  Genomic contig location: Contig_ID=SeqID_8715; Location=210..633; Strand=+
  SCN-specific regions: Sequence locations=1-67,89-245,282-424
atgagcgaggaatacggcggctatgagattgaagaatattgttgcggaggggcgaagcagtacgcactgaagatgagaaacaatcagacgggggagatcgaatacgttatgaagattagagggattacgttcgatgtggacaacaggaaaacattgcactacgacacattcagggagatggttctgaactatgggaaaggggaggtggacccggcattcttcgtctataagaatgattttgggtgagtttttaaaaattatttgcttcattaataaatcaatatttaggccgacaagggattcgaaagtggtgacgagggagaagcataaaatgtacaggccggtctgccagaaggggatcatcgatgaggagcttaatgtgatgccatttggattttgttaattttgtatttttttttgttaa

SEQ ID NO: 68936 - DNA, 536 bp, Heterodera glycines
  Genomic contig location: Contig_ID=SeqID_8715; Location=2027..2562; Strand=-
  SCN-specific regions: Sequence locations=1-224,246-360,383-536
agaggataccgctggttttgaattgattcgaaacggaacgaccagcatcaaggtgcagtttaatgagcctataaaggacggcgggtatgagatgatagttctgggggaatttgattcgattctatctattaatgctaatcgtgtgctcagtagcgacggaagcatatgatgaattctcatgagattgaaatatttctatccaaacatccgacaacccgaaaatattttatcggggtttttgcttccgacaagatgccaaaattgaaggacaggcattttccgtactgttttgtggcgaatactgaccgggcgggcacaataggtgaacactgggtcgcttgttttgtaaattcgccgacagaaatagaatattttgattcattgggcgattatcccaatgaagatttaagttcatatcttaacctattcgaacgaattctctttaacgaacgtattgtccaacatcaattctcagatgcgtgtggtcaattttgcatttattttttaacacaacggtgctccggaatcctttattg

SEQ ID NO: 68937 - DNA, 377 bp, Heterodera glycines
  Genomic contig location: Contig_ID=SeqID_8716; Location=632..1008; Strand=-
  SCN-specific regions: Sequence locations=1-377
ataatcagttttgcgatctcaataaaacttttctttatttgtcaacttcaattgagagaaaagacaaaagcaattggattccgattaccaaggacagtgaagctgaccaacacgtcggtgtcattcaaaattttgggcacagctttgtcaaaaccttaaaggtgtcaatttcaggtgtttagtcttatgattccggcatttactatgcgtttagggcatatatgatgaatgaattgggattttcagaagatgtcaaaaagggtctctgtgaagcgtcctgctattatgtcgacgatgtcgaccaggatgattatacaaacagtggctttaaaaacagagcgtcacgttttgctgatggtgcaaaatgtgaaacaatg

SEQ ID NO: 68938 - DNA, 665 bp, Heterodera glycines
  Genomic contig location: Contig_ID=SeqID_40683; Location=412..1076; Strand=+
  SCN-specific regions: Sequence locations=1-314,336-344,381-538,574 -635,659-665
atgatgcgcaacgcaatgcttctcccggttgtctttgcgatgcttttttacttcagcgcacttttgcaatttggatacggtacagttactgtaatccaattttcacatattgaaaaaactgaatcgaaaaaaatagtataaataatttataatgatattaggaaaaatttaacaactttaaaatacaattaaattcttccttcgcattttggcatttttacccgtccatattttggcacttttttttaaaatccaccttctaacgattgacatttaattcattaaaaaaatacactaaaagaaagaaaattcagaaatttttggtaaaatttcttaagcatttcattttaataaaaaaaattattttttattatttttttcactttacatttttagcattgaaatgccgtgccctttacacaacggaaaatgccacggcaaatgaattaattaagcaaataactaatccaggagattttaaatgcactcgaaatgagaagaactgcggtgtaacattctgttcagctggttgatgctgaaattatttttataaatttaaaaaacaatttaaaaggcaggcgcctaaatcaaaaatatttgagagttggaaatgccatgactttttcttttcaccctaaaaaatattaaatataattttctaaaaa

SEQ ID NO: 68939 - DNA, 68 bp, Heterodera glycines
  Genomic contig location: Contig_ID=SeqID_40684; Location=886..953; Strand=+
  SCN-specific regions: Sequence locations=1-68
tgtccgtttggggtactcaaacaattatggggagcaaaaatccacgcagaattaagtacaggctatag

SEQ ID NO: 68940 - DNA, 728 bp, Heterodera glycines
  Genomic contig location: Contig_ID=SeqID_40685; Location=98..825; Strand=-
  SCN-specific regions: Sequence locations=1-40,62-112,156-310,332-728
atgcatcttgggtttgagatggcgctggccaaaacgttgccacaaatggagaaaaagaaggaactgctcaaaatgttaatttacgtggagaatgcactcattttagtgaaagtaaattttaaaaattcatatttaatttaaaaaaaaaattatttcatggaatttaatcagtagttgcgtagaattatatttggaaataatccatattttttacttttcgagttgatttttcgctaaaaattagtaaacattttaggtttaatgtttttttcttctaaaatgatttttaataccatatttaactatttttaaacattttactttacatttagcgtaattgaagaccttttgaaaaagtatataccgctaatttcgaaaaatttatgtccatattgcgcgattttttggtccactttttatgtccatatagccgattttatatccttatttttatgccctatttatcatactaaaaagtgtagtaatttttttttttggcgactagccattgaatatgtcaatgagctgtggaagcttttgagggaaaaactcgagggtgggccggctttgacccgttgtcttggctttgtttctatgacattagccaaaaaccatcaaatggaaatattttttgatataattttgctcaaaagcaaccaaatttttaaatcttcatatcattcgatagccctaaatgttttctcttatcctgcaaaatatctaataaa

SEQ ID NO: 68941 - DNA, 317 bp, Heterodera glycines
  Genomic contig location: Contig_ID=SeqID_40686; Location=34..350; Strand=-
  SCN-specific regions: Sequence locations=1-134,166-317
atgaattttacccggtactcattgatttacccgcagctgcgggtaaggtgaccagttacccggtttttttagtatcattatgatgaaattaccttaccaaaagaatgattaacttttctgatcataactctttcaatatttatttaaattatatgaatttttatagacttatagaggaccattagagctatcgaattataccaagaatgtttaattatattacttataaggaaagttattaaacgctaaacatagtgaatttttgtgggtatttcatgttccaaaggtcgaatatttttttttaaaaggagaataaa

SEQ ID NO: 68942 - DNA, 498 bp, Heterodera glycines
  Genomic contig location: Contig_ID=SeqID_40687; Location=180..677; Strand=+
  SCN-specific regions: Sequence locations=1-107,134-263,292-498
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagatttttattcatctccctttttgatagtgaaagcatctgagtgcctaaaataacttgtaa

SEQ ID NO: 68943 - DNA, 1161 bp, Heterodera glycines
  Genomic contig location: Contig_ID=SeqID_40688; Location=60..1220; Strand=+
  SCN-specific regions: Sequence locations=1-116,156-164,194-292,315 -336,369-481,513-659,689-872,894-903,937-990,1019-1161
atgtgttgtcattgcgacttcatccatataggtaggtattactgtgatttggaaccgaaaaaaatttcagaagatacacccctaaattgaaaaaagcttcccgaaattgattcacgaaaataattttttttatttaattgattttcaatttttttcaccttggcattaattttattcaaaaataaaattttaaggagtgtcgttggtgcaaaaaagcgttactttggcttcacttcttcgccaaccgagtaatacatacggggaatattatcaataatatttcgacatttcgcaatttcaaaggaatatttttaagacctattactttatttgaagaattaaaaaaatatataatatctatttttttacgaaaaacaaagttaattaattaattatgtgttgtcatcgcgacaatcacccgtatagatttttctgtaatttagctgtatcaaggacgacgaaaatattctcaacactttagaattttcattttaatttaaatcaaataaaagtaggaattttcttatcacttcgcgcttccgtcgatcaatttaaatttttttgtttgttttttaggtcagacggaggtggtcacccgcacaatgtcacaacagtgggaagtacagcatgatatgtatgattatgatcattaccctaaagacgatggaccaaaagaaaaaggctccaaaaactgctgcactataatgtaggaaatttggacaaatttcagacgctttttcgagtttggcgatcttagaaaattgtgtaatccgcttttttgaattgtcgaattgttgagtaaaatcttgttgttgctaaatatttgtcttacatatggtcaacaatttgggacacatttgcgaatcaaaattgaattttcaatgagtaacaaatttttgagtgacaaaaaattaattaaattttgcttttatgtttaccaggaatagaataacccaaaaaaaacactggacgtcgtgattcgaattggcaaagtatttttgaaaataggaaaaaattacgaaaatggagtccaacaaacccaaaatttcgcaagtcgaaggtcggaattgcgtttcatccctgatgcttactaggccaaaatttcaaacaaattcaaacagttgatttgtggtaaacagttttgatttgcattggaaaaaa

SEQ ID NO: 68944 - DNA, 56 bp, Heterodera glycines; identical to SEQ ID NO: 52733
  Genomic contig location: Contig_ID=SeqID_40691; Location=39..94; Strand=+
  SCN-specific regions: Sequence locations=1-56

SEQ ID NO: 68945 - DNA, 816 bp, Heterodera glycines
  Genomic contig location: Contig_ID=SeqID_8717; Location=321..1136; Strand=+
  SCN-specific regions: Sequence locations=1-81,103-173,205-285,307 -334,356-507,541-580,602-816
atggaagaaaaacaaaaatttattcaccaatttgacaaaataattggcaaaaaggagcaacaatcggtgggacgaaaggacaaattggaaattgctgaaagggtgggcattaatttgagaaccattgacaaatggaaaagcgaaatgggcttaaaaggtaaaatgggaaaaggaatttaaatcatattatttaaaattttaaatgaaaagttacgaaagaaagtcaaagaattgcccttgtaaaagaatactacagaataaaaaaggaagacccaaaagtgccgacaaaagaaattgccaaaagtttcaatgccagcaaagcgacattattttattggaaaaaacaatttgacaagaataattatgagtcatcatcatcaccggatggaccggaacaattaagctggtaaaaagcttctgcatttggattcccgttcactgcccgcctctctaattatccccaagtcgaaattccgtgccatccctggttcggacggactttctgccatggaaaaattttgtgttttttggcagctttcttccaaatttatttcacctatttttactccaatctttgggtattgtaaaatttagatttaaaaaagaccaactgacggcttttttcttacgtgacgaagacgaagtgctgaacaaaaaaaaggaatttgtctttttatatttgctcaataattttcaccttttcttcggtttcgcctatttgaactaacggcacttctcactttcaccgattcgtcccaaaattttgcttaaaagataagggagacacaattaattaattgaatttaaattatatca

SEQ ID NO: 68946 - DNA, 525 bp, Heterodera glycines
  Genomic contig location: Contig_ID=SeqID_8717; Location=3259..3783; Strand=+
  SCN-specific regions: Sequence locations=1-148,188-320,342-370,393-525
atgaagttagtgccgcggaaaatacttggattcaatggacttcctttgttgggattgtctcacggtttttttgatcttgatcccgaacatcattttaggccgggctcatgcccgaggcgccttaaaaaaagtttattgaaaaagtggattttttaatgtaaactattaatattcaataaattagtctaaatatgtctattaaataaatatgcaaactcgaaatcaaattctttgcttgagtatcaacctatgtttcagctggtcgctctttttgcggccaacggacgccatattttcattctttttcaatttaattacacaaaatttattgttttaatttgttcaccaatgattttctgaaaatgaattcttaattaaataaaattatttttcagcaaatttttcaatcctttccactggtgaatcatttcgtttctgtttattgaaagcatttgatgaaaattaatgtatgacaatgctttttttgatttatcgcttcgaatcgtcccattttatattcattta

SEQ ID NO: 68947 - DNA, 2275 bp, Heterodera glycines
  misc_feature (465)..(465): n is a, c, g, or t
  Genomic contig location: Contig_ID=SeqID_8717; Location=4308..6582; Strand=+
  SCN-specific regions: Sequence locations=1-79,101-529,588-694,716 -1015,1037-1079,1108-1152,1174-1443,1465-1530,1555-1621,1645 -1675,1710-1861,1899-2084,2106-2138,2162-2275
atgaacgcaaacaacaaattgaatatccgtagcagcagccttccagcggtgcgtctgctggttggcgttttgctgggctttttcatggcattggccatttctccatccaacggttttccacgcgctgccgcacaccaaacgaaggcatttgccgaacaaacggttaagatttttttttttgctgtttccacaagaaaaatgctaagtttttccttattactatggtcgcgatttttgttacgaaaaatctcgtaatagtaaactaaaatagtgaggaaaatgccattaactattttagtgatgaagagccaaaatagtgatttctagtgacctgtttaactcagttgggccggcacgtttgggccccagcatgtttttgcgctaaaacttttttctgtcgaccaaatccaacaatcttggtatcattcgaaaatgtaacatatttagaagctatttctaaagagngggttgcaccccccgaccccgccccgaccccgaaccccgacatttttggccatttttcggggttaaccccgacccgaaccccgacgcttccaaccccgaaccccgacccttaaccccgactcggggtcggggttaaatatacacccctaagaatggcatttttgtgagagaaagtcaagaaaatttaaacaagttttgaatttttgaaccattttgccaaatttttattaaataaagaaaatttgctttcttatgacatgtattgtggtgtattggttagtgcatgcatcacactgacattactgtctttcataagttcaataaccattgacgttctcatttttaatttatttttttgtgattaatactagagttcgggtacggaccggatccgtatacggatttttacggatccgtagtccgcattttttgggccaatacggatttttacggactacggattttccggatttttagtccgtaatccgtatgggtgcctagtccgtactcttggtccttatccgtattttctcaaaataccgatctctaattaatacattttttaaacaaaattatcaataaaaatagccattcttggcataattgttaacagattaaacccaaattttcaaaaaatttttactttcgttgaaatttaaaattcaattttcatgactaaataaatcatgaaaacaatatatttcaaaatattgacaaaatatcgaaacaattaaatttcaaaattcgcttggccgagtccaaaaattcgtaaatcttattaaaaaaattggctcaaaatcgaaaatattcagcactttttgggcaaaatctgttaacagcccatgcaaattttcaaaaattttcccggcggcgcctatcggcaccgccggacccctttctcatgaaaagtctttagaaaaagcgcgccgagaaaaaaagatggtttgaaaaagaaaaaagtaatcagaaatttttgatcattttttgaataagattcacttttttcaaattgccggatccgaaaccggtttccggattgggaaaaatttaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttattataaaaaataaataaataaatataaacaaataaaactttattatggaaattataaaaaattttgactatatggcataaggtaaaaatttaaaaaccccggaacccccgaccccgaacttgctgaccccgacaaccccgaaccccgacttttctaaccccgacgttcgggggtgcaaccctaggaaaaatgtttgaaaacataattttgaaaggagagcttttgagggttttcaaaattccaaattcgatagtgccttaaaaaaataatttttcattcttctaaatctgaaaaacatttagtctagtggctataattattcgtgcattacagaccttcatttgtgagatttggtttttaagcattctaaactttttccaaaaatttttagagctataagactgtacttgttaatacaataattctaaatgagtcgaaatggatgtcagcaaaataagtttcctgggtgtatttttcaattttcttctaatatgtaagatatgtttttatgtgccaaactgtcaaaatcaaaaatagttcggtgaaaatactatttttgggcttatctcgccaagattaaatgacaaaaaattttgtaaaaa

SEQ ID NO: 68948 - DNA, 771 bp, Heterodera glycines
  Genomic contig location: Contig_ID=SeqID_8718; Location=190..960; Strand=+
  SCN-specific regions: Sequence locations=1-148,170-771
atgccaatgccatcgccgacgccggaccatcggcaacggcgtcctctgccatgggcaacaaattggtcaccgcttcgttggacgccaactgggcacacacttcgctggtggccgagacaaggtttgtttggctgctgcgcaggatgccgtacttttttgtaaagcattgggtgccatggaaagaaaaaaagtcaacggggcagggtttacatttttgccacgcaattttcaaaaaaattattcgattggcccatcagaaaatgcgtttttaattgcttcaaaatttcataagattttctctcaagactaacccccacacacgaaataaatctttttgaaaattaaaaaatcccattatttaaaaaatgattcaatttttcagaaaataaataaatacatatccatgggtgtttgttgcgtttcacaagttttttttgccattttagtgaatttcttgcttccgccgacaattcggcgttttggcgcttcatcgacgcgttgctggacgagcaacatcgctcgggcaatggcaccggcacaagtttgtcctgctcatcatttccaccattttctaggcgaattcaaatcgatttcttcatttttttgagctatatgtaccccttttaagatgattttttggctctaaatttgactcagggaacttgccataatttcatttttgcgtatttgtctcacaattacccaagccgaggcatgctcgtatgtgttcgccggaagccaaaaaagctatttttgtattggctaaattta

SEQ ID NO: 68949 - DNA, 423 bp, Heterodera glycines; identical to SEQ ID NO: 65209
  Genomic contig location: Contig_ID=SeqID_40692; Location=258..680; Strand=-
  SCN-specific regions: Sequence locations=1-2,30-32,155-206,236 -236,320-325,358-423

SEQ ID NO: 68950 - DNA, 446 bp, Heterodera glycines
  Genomic contig location: Contig_ID=SeqID_40692; Location=700..1145; Strand=+
  SCN-specific regions: Sequence locations=63-147,200-335,371-446
catggccgttcttagttcgtggagcgatttgtctggtttattccgataacgagcgagactctagcctactaaatagttggctcattgcttctgtgggcacacttcttagagggatttcggtgttcagccgcacgaaattgagcaatacagggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 68951 - DNA, 808 bp, Heterodera glycines
  Genomic contig location: Contig_ID=SeqID_40694; Location=45..852; Strand=+
  SCN-specific regions: Sequence locations=1-183,205-256,278-347,369-808
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagaatgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcgatctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacaaaaaa

SEQ ID NO: 68952 - DNA, 691 bp, Heterodera glycines
  Genomic contig location: Contig_ID=SeqID_40697; Location=209..899; Strand=-
  SCN-specific regions: Sequence locations=108-124,210-211,252-317,365 -481,503-509,560-562
caacatttacgtcaccggtgttgtgggcgcggaaaacattgcgaacgcggaggcggctggccgacgcaaaaggcgttggagccaaccgcttgacgaaacaggcgtaggcaagtcattttggccgaaattttaattcatatttatttaaataaattaaattaattttttattttaaattttttaaataaaaatattttttttttttttttgcagtttttgttgcaacatctgacggtcgctatcggaaaaaagtaaattttgtataatggtccgatacataggaaagcatgatggaataaaactaatcttccaaccacaaaaataaataaaacatttttttattttaaaaaatcaaaaatttaatgaggcgttaaagtgagatttttggaaaatggtaatttttggaaataaaaaaaataaaacgttgacactgtcataaatgaaaaatggatctgatcatttgatttatctcttaatgaactgactttttaaaatgttattttccgaacattaataaaaaattttttttttaatattttagattttgtaatatttttttcagatcgtgtttggacaacttcaaattccgactgcaattgtcacattgccaaaacttggccgaatttgttacagcgatgccgggctggaagcaaaaattgagtgtgccgacatggacggaaatcggcgacag

SEQ ID NO: 68953 - DNA, 600 bp, Heterodera glycines
  Genomic contig location: Contig_ID=SeqID_40698; Location=9..608; Strand=-
  SCN-specific regions: Sequence locations=1-79,102-106,130-600
atggctgcaaaacgcaatggaacctctcaacaaagcggaccgtcgactaaaaaatgggattttagatcaatcgggtaagtaatttttaataatatatttaagagacaattttattcaataatttttcagaaacaattttattgaagaaatggaaacttttaaattgatggattatcgttcgacgatttgcgaaaaatttggatttacgaagaacattgcggaatttacgatcaacccggatgtgggacgccccgatgaagcgatgagggacgcaatcgacacaatgattaaggcggcttttaagactacggaagaaaggatgaagcggaaagtgaggatgtttggagtggtaattacgggcgccgggcttgctttcccggtgtgggtgccgtatcgggcgttcccccagaataatgcggatgttattatgcaggagattaataagttggggcagagcggggacggagatgaaaataagaaaatgctgttgctctcggagcaaattacgatgaaaataacgtgtgtgacaatgcccggtggagaggggccgaggaatgttcataaatttgattttggattcaaggagcatcagcggataag

SEQ ID NO: 68954 - DNA, 345 bp, Heterodera glycines
  misc_feature (276)..(276): n is a, c, g, or t
  Genomic contig location: Contig_ID=SeqID_40701; Location=6..350; Strand=-
  SCN-specific regions: Sequence locations=1-120,145-315,337-345
atgtatatgaatctgccccctaaactgaaagggtaccgaaattgttgatggaacgatgcagaaatgaagaagaagatccgccgatgttcattcattatttataaaagatattattgaccataattgtgtgtgtgcctttgctccctgggcttttaaattttattagttaaccataatgggctgagtaaaattttcaattttggaccaatggaatttgtggggattttcgaaaaagcaaagctcttctcttaatgggtcaattttatagatacccgnaatttttattttttcagacattctagaatttaacgaccaattattattaaatatttttgatcgaataaa

SEQ ID NO: 68955 - DNA, 762 bp, Heterodera glycines
  Genomic contig location: Contig_ID=SeqID_40701; Location=426..1187; Strand=-
  SCN-specific regions: Sequence locations=1-215,237-296,319-366,389-762
atgagcaatcaatccgcggctcaaatcgctgacgaatatgagaggtgggttttttggtgaaggtcctaatttagtgctctgttttacattttttttctgttttaatcaattttactgcatttaggggtgacggtgaagttatcaagagcaaccagggcaagcgcaccaagtccgaacaggtcggatcgtttgttgtataataaggctgattgtgcgtcattggcttttctaaaaaaggaccattttgatcagggacggtctcagtgggacgtatcccccccccaaccactcgaaatttcaaatagttttttctataaattttcaacacaatatagttttgcaaaaaaatgcgttaatggaaattacatttagtaaagaaaattaaattgaattctaccacaaacaatttgaactgctgagttcaactcttgatgccaaaatgaggctcgctttaccatccattgttaattgtgcaggcattttaaagactgcccaccaccactcctcattttgtggcaggttgagcacaaacatggacatccggagggcgacacgcgtcgcatcgtggacaacgcggtgaagggggaggagaagcgcaaggagaaggagcgcaccacgtcacagtcgtcgaagtgaacgaacgaatggaggcggcactttgccattttgggggaagagaaattgcggtactctttcagtttaatatgcctataaatgtattcattttacattgtgtctggtttttgcagaagagtaaataaa

SEQ ID NO: 68956 - DNA, 1395 bp, Heterodera glycines
  Genomic contig location: Contig_ID=SeqID_8719; Location=475..1869; Strand=+
  SCN-specific regions: Sequence locations=1-199,233-278,307-569,591 -767,826-923,1018-1055,1078-1395
  Gene Ontology: Mol. function=SNF1A/AMP-activated protein kinase activity; Cellular component=nucleus; Biological process=signal transduction
atgcgttcgatgaattcgacgggtgcacagccatcgcaagacacgccaaacgatcgcgagttggaacgtcttcgcgaattcactcaacaattgcccgaccgtcgtgattttgaaaaagctgcaaaccctccaattcttccgccgcatttgcttcaggtaattaattgtgcaacttaaacggaattttgaaacttttataattgcctcattataatctcaaaaaattgttcaagaaacatttacatttgtgtccatcattgtatactagcattacttttgtttgttaaggtttttcttttaatttaacaatatttcaaaaatcttatgccttttatacatatttcgcgctttttaagagttttttgtttttattttatttcattaaccggaaatcaatgaaggattcgccatttcaggttattctgaataaagatactcctgtgcaatgtgacccgaatgtgctgcctgaaccgaaccatgttatgcttaatcatctttatgcgttatccattaaggacggagtcatggtaaaactttcattccatttattatctttgtttcaaaaaagctgttggggaaaaaatttagggaaccatttaaaaaatggcccatcaaattatgattattttaacaaaaccttataagggcggcaataatgctatttatgataggcctactcattttttcagaaaatttttcttaccctattggacttttgaaaattacggatgcaccccaaaatttcgccaggacataattcgccgaagaaatttttttaaaaaaatttagaaattttcaagaaaaaaatcatagaatattttttatggaaattcaaggaaaattattgaaaatttttttaacgatttttggaaaaattttcgaaaaaacttactaatttattataaacttcaaaaaaatcgctgaaaattttttaaattttttttcttgaaattttcttataaaaaattctaagatttttttcttaaaaaatttctaacaataagtttaattatttttgcggcgtaatttcggcggcaaaattatgtcccatccccaaaattaccccaaaacctttttggctttttcagaacaccataaaggagatatctgatcaagtgggtgtaaaagattttcgatcaacataaaagttatctggcgggagtcttgtgactcccggtcccggtgttttgtccaagaaacagggacctgcagtccggcaaaatcccggcgtggccctgatccgttccgggttctaatcatcgactgtatgcttctttgcattttataggcgccaaaatgactcaacttaattttacttaaactttacaggttttgagtgcgactcatcgccatcgcaagaaatatgtgaccactttgctatacaagccaatttaa

SEQ ID NO: 68957 - DNA, 2834 bp, Heterodera glycines
  misc_feature (2190)..(2190): n is a, c, g, or t
  misc_feature (2277)..(2277): n is a, c, g, or t
  Genomic contig location: Contig_ID=SeqID_8719; Location=2139..4972; Strand=+
  SCN-specific regions: Sequence locations=1-992,1030-1045,1070 -1309,1331-1704,1726-2611,2640-2834
  Gene Ontology: Mol. function=Ral interactor activity; Cellular component=exocyst; Biological process=positive regulation of exocytosis
gcttcccaaagtgccaatacattccgttcgaatgcgccgttggttacaggagtttcacctcatcagggtgggcattggtcgttttactattacttccttttccaaatttcaaatcaaattaattctactgtgtaattgtcaaatgcataggtccacctggcactttgatcacaattcgtggcgaacgatttggagaggatgccaatgacctcgtgcgctcattgcacttttaatgtgaaaatggttttatggagtaggttgccctggtcatctgcggcaccgattgtcttgcgactgccaaatggaaatcctcctccaaaattgtggctcgtttgggcgggcaggcaaagcgtgggcccggggacattgtgatggtcactcgttcgggaggacgtggccaatcggcggttcaattccgagtgttcatcgagcagattgggccgttgcaagagtcagctgtgtgggtggacgaggcaaagacagtgccgggccgaaatttaattcggaatgtgcaggagggcggagatccggaagacgcacttgggctgggcatcgaccagtccgtttcttttttgtcaccaaaaagcgcctcattttcagacaaacgaagacggacatcgccagtctgatcaaactttttcctgatggaacgggcagccgaaagatggaaaatttcagccccgagtggtatttgctggagaattacaaattggcaaggtccctccctctcctccctttttttcgtttttttttttgctttttgcatttctttccatcgcttttatttgttgccatttctgttcagtgtttccgatttgaagcgggggatggccaatttggagaagcaaatagcgcatgaggaagaatgttcgaaaaatgtgcacaaggccaacctcttccttttgatcagttgtgtggacgcactcacttcactccactcaaaaattcagtcgaaatcgaccagcgaagattggccaatcagtgcgaaattggcagaaaaagtgatctgaaataaatataaaaatcatctttttaccgtttgaattctctctcccccttttttccttttaatgtcacttttatacaaaaaaatctgttcttttttatttaaattgaaggtcgaaaaggctgcaaaaacggcggaccgtctcttccgcgatgttttgactcggaaagaccacgccgactccacgcgaaatgccctgtcaatgctgacccgattccgtttcattttctttcttgctgagtccattgaaacgaacatggccaaagtgagcgacatccaatgaatgtaaaactttattatttcagggagaattttcaacaattttgaacgattacgcacgggccaaagcactttttaaagacaccgaagtgaatttgtttaaggaaggtgagcaaaataattgggaagacaaatgtatgcctaattaagttatggcggtgctcgacgaaaacattggaaaacttcgcgaatgcattcgcagcaaattgatggacatttccactcccttcgaagagcagaacagactgatcaaattcctgaaaatactcgaccccgagtcggaccccgcctggtacgcactgaaaacgcactaatcgaaggcattccatttctgttcagggattgcatgatgtcttacaacgggtggttggagaacattttatgggagttgcaaatccattttcatgggaaatgtaaatgctggctttcatttggcttttcctttttatatttcaatgctttagcgatggaggcgcaccaacggacttccatggcttatgagacggtcgatgtgtctgatcttttatcggaggaaaacaaatcgcctcaagactttcgccatgcttttgttattgaccttttgggacttcttacagaaaaattgcaaacattttggaaaatttctcaaaattttgctgtgactggtcccaccacttccgctgctgtttctgcgcttagtcagacagaggctgaccaattccaagaacggcaaatggacatcgatgtgagttgatcggactttgtgatcacttttggaccgaccccttcagcaaatgttgaccaacaccatcaacgttggctcgtggctgttgctaaatgcgttggtgcctgacgcactgcccgagtcggtgaacaaacaatacaaagaccgattcgtgcaatggcctcgtctcagtccaaatgcncaatgggatgtcatgttcccctccataaaaactcttcggtacgttcaattggtcaataaatccctgcttttatttcatttgaatttnaagggcctcaataaaaactttgactgaatgtctgagccgttctcaccttcagccgttagtcgaactttgtacaacggtccgtctcaaatgtttgggaatgttagtggagaggggcaaagaaggtgggcggtaaaagccaagcaaatattatgcatttccaacgtaagccatccgtttgtttcattgtcagccgttttgctgcttggtgcccaagagaattggcgcgtcgatttaatggccgacccgccgcgtacggcgctgcccgaccttttcgagacggaagtcaacgaattggtggctgatgtgaaagtcatcctttcttccaacaatttccctggggaaattgacctttttctaaaggagcgttggcgacaaatggtgcctttttggcattgtttttcgtcttccatttgtgaattgtttttagatcatcgacctttttgccgtccttttgctcggtgtccgcgactgttacgaccatttgctcaaattgcgtcgggagaacaaacggcccaacactttgttggacaatgtgtcattggaagtgttgatgagga

SEQ ID NO: 68958 - DNA, 652 bp, Heterodera glycines
  Genomic contig location: Contig_ID=SeqID_40702; Location=142..793; Strand=+
  SCN-specific regions: Sequence locations=1-356,379-383,406-652
atgcacgcgtttcgcgctcgagctatttatcatcgggcttgtcaatccaaagcgaaacaacaaagatgctgttttgaacgaataaagggcataggttattttgaagaagtgtcaaagaaacatgcagcaataagcctgcaaaatctaataagtggaaaatacatgagtatagaatttattttcagaaagtgtcaacatacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacatacttttggaaaaatatatttgcaatttatcaacaattttgagaa

SEQ ID NO: 68959 - DNA, 50 bp, Heterodera glycines
  Genomic contig location: Contig_ID=SeqID_40706; Location=45..94; Strand=-
  SCN-specific regions: Sequence locations=1-50
atggcgattgtgcccggccctccgtctcgatacgcaagcgcttttgtgag

SEQ ID NO: 68960 - DNA, 879 bp, Heterodera glycines
  Genomic contig location: Contig_ID=SeqID_40708; Location=1..879; Strand=+
  SCN-specific regions: Sequence locations=1-140,163-379,404-675,700-879
  Gene Ontology: Mol. function=ATP binding; Cellular component=integral to membrane
ttcaatcaatgggactcaacccaccaacattccaatcactgggactcaaccctccagcattccaatcactgggactcaatccaccaacattctaatcattgggactcaatccaccaacattccattcaacgggactcaacccaccagcattccaatcactgggactcaatccaccaacattccaatcactggcactcaattctcctacatttcaatcactgggactcaacccaccaacattccaatcattgggactcaatccaccaacattccaatcaacgggactcaacccaccaacattccaatcaacgggactaaacccaccaacattccaatcaacgggactcaacccaccaacattccaatcattgggactcaatccaccagcattccaatcactggcactcaattctcctacatttcaatcactgggactcaatccaccaacattccaatcactggcactcaattctcctacatttcaatcactgggactcaacccaccaacattccaatcattgggactcaatccaccaacattccaatcaacgggactcaacccaccaacatttcactgggactcaatccaccaacattccaatcactgggactcaatccaccaacattccaatcaacgggactaaacccaccaacattccaatcattgggactcaatccaccagcattccaatcactggcactcaattctcctacattccaatcattgggactcaatccaccaacattccattcaacagtgactccacccaccaccaatccattcactgctacacaattctccgacaatccaatcactgcgactcaacccaccaacattccttatcacatggactcaacaccaccaccattccaatcaca

SEQ ID NO: 68961 - DNA, 935 bp, Heterodera glycines
  Genomic contig location: Contig_ID=SeqID_40708; Location=1..935; Strand=-
  SCN-specific regions: Sequence locations=1-236,261-532,557-773,796-935
  Gene Ontology: Cellular component=DNA-directed RNA polymerase II, holoenzyme; Biological process=establishment and/or maintenance of chromatin architecture
atggaatgttggtggattgagtcccagtgattagaatggtggcggattgagtcaactgtgattggaatggtggtggtgttgagtccatgtgataaggaatgttggtgggttgagtcgcagtgattggattgtcggagaattgtgtagcagtgaatggattggtggtgggtggagtcactgttgaatggaatgttggtggattgagtcccaatgattggaatgtaggagaattgagtgccagtgattggaatgctggtggattgagtcccaatgattggaatgttggtgggtttagtcccgttgattggaatgttggtggattgagtcccagtgattggaatgttggtggattgagtcccagtgaaatgttggtgggttgagtcccgttgattggaatgttggtggattgagtcccaatgattggaatgttggtgggttgagtcccagtgattgaaatgtaggagaattgagtgccagtgattggaatgttggtggattgagtcccagtgattgaaatgtaggagaattgagtgccagtgattggaatgctggtggattgagtcccaatgattggaatgttggtgggttgagtcccgttgattggaatgttggtgggtttagtcccgttgattggaatgttggtgggttgagtcccgttgattggaatgttggtggattgagtcccaatgattggaatgttggtgggttgagtcccagtgattgaaatgtaggagaattgagtgccagtgattggaatgttggtggattgagtcccagtgattggaatgctggtgggttgagtcccgttgaatggaatgttggtggattgagtcccaatgattagaatgttggtggattgagtcccagtgattggaatgctggagggttgagtcccagtgattggaatgttggtgggttgagtcccattgattgaa

SEQ ID NO: 68962 - DNA, 85 bp, Heterodera glycines; identical to SEQ ID NO: 65905
  Genomic contig location: Contig_ID=SeqID_40709; Location=613..697; Strand=+
  SCN-specific regions: Sequence locations=1-85

SEQ ID NO: 68963 - DNA, 621 bp, Heterodera glycines
  Genomic contig location: Contig_ID=SeqID_40711; Location=38..658; Strand=-
  SCN-specific regions: Sequence locations=1-18,40-91,123-309,340-621
atggtaaaaatccggtaaagataattattctatttctttttgttttgctggaagaaaagtgccgaaaaagactgaaataccaaaaatgaagctctttgaaggacataaaaatgtaaaatactgtcctatgactcataaatttccttttccaatgaataaatttattaaaattgggtaatgaaatttagaaaatatattcaatttcaacattcagaatataaacaattttttgtcaatttaactttttgatttttttcacaaaattagaacatcagcagctgttggctaacccattttcagctgtgtttcaaggatatattctccatttttgctaaaattccattggtttgctctcactttgtttatttatcagtggcatttttgcactttggcaatcgaaagggcgcggcattgggtttgaatttgtcactgatcacacatattcttggcattttgtcctcagttttcgtctccgtccgtccatcggtcggtcggttcggctccttatcagtgcgcttatccattctgagcaatgttcacattcgcaatgtttattggcacccagcgctgctgttgcggagtccaacgccattgctgttgctgccgtttgacgctcttagg

SEQ ID NO: 68964 - DNA, 154 bp, Heterodera glycines; identical to SEQ ID NO: 62241
  Genomic contig location: Contig_ID=SeqID_8720; Location=777..930; Strand=-
  SCN-specific regions: Sequence locations=1-154

SEQ ID NO: 68965 - DNA, 129 bp, Heterodera glycines
  Genomic contig location: Contig_ID=SeqID_8721; Location=147..275; Strand=+
  SCN-specific regions: Sequence locations=1-79,101-129
tatggcacggaaagacttccggtttccgacatttttggggtcggaattccgacttccgaaatttttgatgaaaagtcggaaatttttaaaatttttatttcaaaaaactagtaagttttgtacaatttc

SEQ ID NO: 68966 - DNA, 577 bp, Heterodera glycines
  Genomic contig location: Contig_ID=SeqID_40713; Location=330..906; Strand=+
  SCN-specific regions: Sequence locations=1-541,573-577
  Gene Ontology: Mol. function=receptor signaling protein activity; Cellular component=membrane fraction; Biological process=oviposition
atggaggaattattgcgggggatgaatatgtacaaaatcggatttacagaacccaaggggacggtaaacggtgtgccgccaattaaaagatgtcgaccggacattaaggaatgtgcgagagttgtgatggagaccattcggaacggggaggagagcgagccgttcagcgacgaattggcagccgcaatgaagcggctgtgggcggacccggcactgaacacggccacttactcacgccgactcgaattccatcttcacgactcggccaaacagtgggaccaggcttatttgttagccaagactgactaacccattgcccaattcagcttcttagacagtttggatcggatcagcaacccctcctacaggccgtcccagcaggacatccttctgactcggatcaaaacgacgggaatcgtcgaaattcaatttctaatcaaaggcgttccgttcaggtggaccttcggcagagaagcggacaaataatgggaattgagtaatttttagagtttttgacgtcggcggacagcgatcggagaggaaaaaatggattcactgttttgaggatgtcaattcg

SEQ ID NO: 68967 - DNA, 931 bp, Heterodera glycines
  Genomic contig location: Contig_ID=SeqID_40714; Location=237..1167; Strand=-
  SCN-specific regions: Sequence locations=1-362,384-466,493-557,579 -616,638-714,737-931
tgttcaaaatgatgttgacaccgaattggacagattgatcgagttgggtgttctcaaaaaagttgactacagcagatgggccgcaccaattgtggcagtgcgcaaagcaaatggaaaagtgcgcatatgtttcgactttagcaccggactcaacgcggcactcgaaccacatcatcatccgctcccacggcctgagaaactttttgctcaattaaacggagcaaaaatattttcccaaattgattttaaggacgcttatttgcaaattagcgttgatgaacagtcgcgtcaacttttaggcgttaacactcacaagggactttatcaatgccaacgactggcattcggaatcaaaagtgcaccaggcatttttcaatggacaatggatcaattggcaagcggaattcctggcgttgtcggttatatggacgatttcatcattgcttcaagcacagtgaacgaacatttttcaacaatttttaaatttttcaagcgaattcaagaattcgggttccgaattcaaatggacaaatgcaaatttttagttaaggaaatcaaatttttgggtcaaattgtttcgtccgatggtatccgtcctgatcaaaacagaacacgagcactgcaggaaatgccaccaccgacggacatcacaacactccgatcattcctcggggcaatcaattactgtggaaagtacatcaaaaacatccatcaaatcagagcaccattggatgagttgctcaaacagggagtggaatggcaatggaatgaaaagcaccgcgaagctttcgatcaagcaaaagcaatccttttatccgatttagcattaacgcattatgacccgcatttgccaattattgtcacagctgacgccagcaacaaaggaatcggcgcaacaatttctcaccgttttccggacggaaaagaaaaa

SEQ ID NO: 68968 - DNA, 388 bp, Heterodera glycines
  Genomic contig location: Contig_ID=SeqID_40715; Location=497..884; Strand=-
  SCN-specific regions: Sequence locations=1-20,42-275,297-388
atgccaaaacaaaacgaaatcgttttaaaatattcctttctggacttgacttggtttcttgatatcgaagctgttttctacgctatttctaaaacggttataccaaacctcagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 68969 - DNA, 59 bp, Heterodera glycines
  Genomic contig location: Contig_ID=SeqID_40716; Location=124..182; Strand=-
  SCN-specific regions: Sequence locations=1-59
aacatttgccttctctagtctggctctactaaacactcacacgatatttgaaatgctaa

SEQ ID NO: 68970 - DNA, 59 bp, Heterodera glycines; identical to SEQ ID NO: 52421
  Genomic contig location: Contig_ID=SeqID_40716; Location=254..312; Strand=-
  SCN-specific regions: Sequence locations=1-59

SEQ ID NO: 68971 - DNA, 59 bp, Heterodera glycines; identical to SEQ ID NO: 52422
  Genomic contig location: Contig_ID=SeqID_40716; Location=384..442; Strand=-
  SCN-specific regions: Sequence locations=1-59

SEQ ID NO: 68972 - DNA, 59 bp, Heterodera glycines; identical to SEQ ID NO: 52421
  Genomic contig location: Contig_ID=SeqID_40716; Location=514..572; Strand=-
  SCN-specific regions: Sequence locations=1-59

SEQ ID NO: 68973 - DNA, 59 bp, Heterodera glycines; identical to SEQ ID NO: 52421
  Genomic contig location: Contig_ID=SeqID_40716; Location=644..702; Strand=-
  SCN-specific regions: Sequence locations=1-59

SEQ ID NO: 68974 - DNA, 59 bp, Heterodera glycines; identical to SEQ ID NO: 52421
  Genomic contig location: Contig_ID=SeqID_40716; Location=774..832; Strand=-
  SCN-specific regions: Sequence locations=1-59

SEQ ID NO: 68975 - DNA, 671 bp, Heterodera glycines
  misc_feature (20)..(21): n is a, c, g, or t
  misc_feature (33)..(33): n is a, c, g, or t
  Genomic contig location: Contig_ID=SeqID_40720; Location=299..969; Strand=-
  SCN-specific regions: Sequence locations=1-358,380-511,538-620,663-671
gccccgaaaacaaaaaaatnncgattttttcanagtgtctctgtttggggtactcaaacaattatgggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 68976 - DNA, 567 bp, Heterodera glycines
  Genomic contig location: Contig_ID=SeqID_1155; Location=497..1063; Strand=+
  SCN-specific regions: Sequence locations=1-211,247-293,374-567
atggaaattgaaaaagtgtccgaatttgcgctggagaaggtgggaagtgagcgattaagcaaagccatgaacatttggggattttcatggaaaataatggcagaaattagaacgaaagacgaaaacaatgagaaatggttgggctttttcctttacaactatggcactgaaaaaggtaaaaaaaaagccattttcataaatctgtcaggagaaaaaaataataatttcattaaaaatattaaattactctttttaagctgaattacatttaataaattcttttttttccagagatttttattttttactatcttatcatatttatttatgaaatttaatatttaattgaaaaatatgaaaaatacaaaaatatggaaatttaggtctaaatgatcacgattttggtatccatttcgatcgatagggatagacccgaattcgaatctaagagggcagagttggtagttgaagcttgttcctattttcaaatgcattttaaattcttttataattaaattgcccattgtcaaatttccacatcgaatcattgagaaaaatttaaaatta

SEQ ID NO: 68977 - DNA, 269 bp, Heterodera glycines
  Genomic contig location: Contig_ID=SeqID_1155; Location=2784..3052; Strand=+
  SCN-specific regions: Sequence locations=1-140,162-269
atgcaatttgtttttccacttgcaccgagcttcgaggcgttgctttcttctcccggctacgccatattcatcatcttcctttttttgattgcccgttttctgaaattgaccagtttcgatgaaaagccaaaaatcacgctgagaaagaacaaaaggagaaattcgtctcaaaaatgttcacatttaatggaggaaggaagtcaatgtgcgactggtccgtttgttgagttagctgaactttttgtgcaatgttcgattctgcaagaact

SEQ ID NO: 68978 - DNA, 927 bp, Heterodera glycines
  Genomic contig location: Contig_ID=SeqID_1155; Location=1215..2141; Strand=-
  SCN-specific regions: Sequence locations=1-363,416-571,594-693,716 -800,822-830,852-927
atgaaaaaactgggtttcctccttttgttggccataacttttccgacccggccccccctgctgtacttcgttcgtatggagaatcagcgcacagtttaccaattatctgagactcgagctcaacatcgagaccgagccttgaatccgagattcgcctttttcaaaattttttttattaacctaaataaaaaagtttttatagcgttgctgaaaaacccgaaaactttaaaaaatatttgttaaaaactgacaaaaatatcaagaaatttttgaaaaatacacccgtaagacaagagcatggtaacagcgcggatttgcaatcactcgcctaaactgggattctcaaaccaggaaacagagaggaaaaaataataattaaaattaagttaaacaagataatttttaaaaataatttcactcttattattattgggattttgggactcattagcccgtattttctcaattattagctgtaaaaaaaggaaattgattattttcacgataactaccccacttaaatacccatttgttcatctttgtttctacttttaaaacaagtatttatttttgtaaattgtctaaaaataaaagtagaattttcaatccaaaattcacaagtaaagacaaaaatattggcggtgtaaattcataaaaatgtgcctctcatgaaaaaaaagcaattttttcctatcataaaaaagatgcatgaaaagaatctgctactttgatcatttagataattgcctacgtaaatcgatttagagcaataagtagaaaatgaatttttgtaaaaatcgtaaaatttatattttttttttcagaaaaatccttttggctaacaacatattgttttttcgcaggggaaatttgagcgaggttagcgtatccaaagcgcccgtctgaagtcacgaagcagtcaataaa

SEQ ID NO: 68979 - DNA, 362 bp, Heterodera glycines
  Genomic contig location: Contig_ID=SeqID_1156; Location=1207..1568; Strand=-
  SCN-specific regions: Sequence locations=1-211,233-362
atgcaaatcgaaaggccattttttacggaaattgaaaaagtgtcggaatttgcgcaagaaatcttttggagtcaacgtataagcgaaactgtgcacatcaaaggattttcgtggaaaatattggcacaaattagaaagaatttgcttggcactgacaatgagaaatggatgggcttttaccttttgtgcgatgctccaaaagaaggtgcaaattaaaagctaattgataaaaaatcataattaattgccattaagccaagaattgttgcttcgaatgttcggcaacctttcgaattgtctcgcaaaagaaagatgtgccggatttcaaggatgaattcaatgactaattgttaaacaataaa

SEQ ID NO: 68980 - DNA, 1287 bp, Heterodera glycines
  Genomic contig location: Contig_ID=SeqID_1156; Location=1685..2971; Strand=-
  SCN-specific regions: Sequence locations=1-132,162-187,212-431,475 -649,681-739,761-981,1034-1127,1149-1287
atgttccgctttgattcaaagaatgcaaaatcagaaaatggtaaaaaatatttggaatattaatctattaaaattagggattaatgagagaccggatttttatgtatttccattttttcacatttatttcagtttaaaaattaatttaaataatttttttagcttagtttgaagcgtttaggaatgtattttattttcagttttaaacataccatttttttctatatttagatattttaatcatatttcagcaagttaaaattagcctctttttattaccttaattaattttcaattagccaccactgattatcctgtggaggtccccgatgttgaagcagcagcgttcaaagtgatgttgagcttcatttatacgggcgaattggctgaattgaacggagacaatgcaatggcagtactttacgccggtgaattttatttttttaaatttaatttattaattttttttaattagccaaaaagtacaatatccctggcttggtcgacgcatctttgcaagttcctgtttcatcactgcgcaatgttttcgtggcttatgttcaggccgaactttatgaattggaggtgggttggacagattgaaattgatgaaaatgcggacgatttgatcaaatcgaaggaatttttgcaaattcaccaaaaatttttgtgtgaaatttttggacgtgacgaattgaaaatccgtgaagaaatttcaatttggaacgctgtaattttactataaataagaaattatttctaattaatttgttatttctcattaataaaggcactccgttgggccgacgcgaagtgccgtcaaaattgcattgaacgctcggcaaagaatcgtcgtgccgttctcggtccggcactgttcaaaattcgctttccattgatcccaaatgaggaattttcgaagaaaattggtaaaaataaccaagccaaaatgtttgaattttttccgatgagcagctgccgattttataaaaaacgaatttattttattataattttttataagttttaaaatccagtttttcagttccatccgaagtgttatcagaagatgaagtgatcgacatttatcaattccatgcccttccaaattgtcatgggatatctgatggatttttcccaatgccatttccgactaatggacgaatttccgatcgaaaaaagggcagaattttgatggacattaaaaaaatgttggaatttgctcgagaggggattaagagcagtcggtacagcgaaaaaatatacataaatggataaataattaaa

SEQ ID NO: 68981 - DNA, 612 bp, Heterodera glycines
  Genomic contig location: Contig_ID=SeqID_1157; Location=625..1236; Strand=-
  SCN-specific regions: Sequence locations=1-55,86-141,172-440,484-612
atgttccgctttgattcaaagaatgcaaaatcagaaaatggtaaaaaatatttggaatattaatctattaaaattattaaaattagggattaatgagagaccggatttttatgtatttccattttttcacatttatttcagtttaaaaattaatttaaataattttttttagcttagtttgaagcgtttaggaatgtattttattttcagttttacacataccattttttctatatttagatattttaatcatatttcagcaagttaaaattagcctctttttattaccttaattaattttcaattagccaccactgattatcctgtggaagtccccgatgttgaagcagcagcgttcaaagtgatgttgagcttcatttatacgggcgaattggctgaattgaatggagacaatgaaatggcagtactttacgccggtgaattttatttttttaaatttaatttattaattttttttaattagccaaaaagtacaatatccctggcttggtcgacgcatctttgcaagttcctgtttcatcactgcgcaatgttttcgtggcttatgttcaggccgaactttatgaattggaggtgggttggacagagtga

SEQ ID NO: 68982 - DNA, 522 bp, Heterodera glycines
  Genomic contig location: Contig_ID=SeqID_1157; Location=1491..2012; Strand=+
  SCN-specific regions: Sequence locations=1-163,185-259,281-326,348 -428,451-522
atggtacgcatttcacgttatttaataattgatcacgacaatctgccggttcggccaccttctttggacgaaatcaatttacgttggatttacaagcagaattctgaggaaattctacaatttctagcttatcatggacttatcaaaaatcaaatggagtgcaagaagtgttttaacaaaatgtcattgacaaaaaagaccaacacaaaggatggttttttggtaatgcatatagggatgtcaaaaatatgtacaaaaattgatcaaaatatgtacataaatatgtaaaaaaaatccccaaatacccgatttttgtttgcaaacataaaaaagaaagtgtttttcctactatttagagcatggagaagccaggaaaaaaaatatgtatttacataaaattgacatccctattaattattagccccggctcaaaaaattgatcccaaatcaatgcaaatgttgtaaaaaaacaaaacattgtttttcaccaaaataagagaaattgttgtgtacataagttga

SEQ ID NO: 68983 - DNA, 1700 bp, Heterodera glycines
  Genomic contig location: Contig_ID=SeqID_1157; Location=2892..4591; Strand=+
  SCN-specific regions: Sequence locations=1-75,105-153,180-320,344 -487,519-929,992-1151,1190-1341,1385-1393,1416-1554,1576-1700
  Gene Ontology: Mol. function=protein binding
atgccaacaaaaacggacagcagcgacgatgagtcagatgaagaaaattcagcagcgggtgggtaaataactaaataatggttaaaaataaatttaaaaatgctatttttttagcattatttcccgccggtgcccccattaccgtcgtttgtgaaattttttaatatttaaaagatgcattacggaaattacggcactttttgacccccgtaatactaataacggatttcagtaatttaaattccagttacgcccacccctgctgatgttaagaaccattttgaaacatttatgattgtggatttctttaggacattcccaaaaaatatttttatttttttttgcctgatttttttaaatttacaaatatcatgattatcattttagcagaatcaccagggaataaatggatgaagctaatgttgagcacgggaaagtacgcggatgtgcactttttggtgggggacggagacgcaaaaatggtgagttttaaattgcctaattataatccttttaattgtgaaatcgcccccgacacttcggggaagagattagcgaagatcagggacggaagatgggtcaaaaatgggggttattgttagttaattaatttctttaaagttttaatccttttaagcgcgtgccagcccataagctcattttggaagaggcttccgacgtatttaaggcaatgttccgttttgatgccaaaaaggaaaaagcggagaatggtaaaaatatagtaactaaaataactaagatttaattgtcaattagactctgctaattgcccagctgatgtggagattcccgatgttgaagcagcagcattcaaagtgatgttgagcttcatttatgctggtgatttgagcgaattgaacggagacaatgcaatggcagtgctttacaccggtgaatttattttaaggaaattaaatatttataaattaaatgtttgaaattaaatttaatgagtaatatttttttattagccaaaaaatacatcatccctggcctggtcgaacgatctttgcaaattcccatctccgaattgcgcaatgttttctttgcgtatgcccaggctcgtcttttcgactttgaggtgggagataaataatttaatgataatgaatttaagatgatttaaatgcaataattatttatatatttatattttttataaattttaggactattgcaatgattgtttggattatattgatgggaatgcggacgctttgctcaaatcggatggatttttgcaaattgaccaaaaattgttatgcgaaattttgggacgccaattacaaatccatgaagaattttcaatttgggaagcagtaatttttttaatttaaaaaagttacaatttcattttaaataacttcctatttaattcgaatttattttcggcactccgttgggccgacgaaaagtgccgtgaaaatggcattgaatgttcagcagagaatcgccgtcaaatgcttggcccggcacttttcaaaattcgctttcctctcttctcacaagaggatttctcggagaaaattggtaaaaataagtcaaaatttcaaatgcattatttgatgactagggatgtcaaaaatatgtacaaaaattggtcaaaatatgcacataaatatgtaaaaaaaaaatcccgaaatatgtataaaaacccaaaatatgtaccaaatatttaa

SEQ ID NO: 68984 - DNA, 795 bp, Heterodera glycines
  Genomic contig location: Contig_ID=SeqID_1158; Location=816..1610; Strand=-
  SCN-specific regions: Sequence locations=1-216,253-375,411-494,556-773
atgaggtgggaaaaagtaacccaaatgcgtatgaatttttggacggtgggttaatgcgccgcatggtccaccgagcttttgctgaatttctttcattgatcaaagctctctgttagccgtactatttcttcgctgtatgccgtctttccaccgcactattttgttcccctttcccagtctggggctcttctcttagatttatataatattttcacttgctctgcttgtctgcctctctcacacattttcacaatcctcttctttgtctttcccacactatttcctccactttcactccctctccagatttattctcatgtaatatttcctttttcccaagcattctgccgcttaatttatcccccgtttgtgtactattccatcaattttcaatctctctcttttccttgcttgagggcagtgatcaaagaaaagacggaaatttttttttaaccgtcgtccatccatttaagaaaagggcgaaaatgcattaggaaaggggtgggggaataatttggctggaatggaatgcaaaataaaataaaattttggggttggcgagggctgtggaggaaaagcatcccccgggggaaaagcccccccccccccccctctaattgcaactgaagttgtcaacagcagcagacaacaagcaggaagcagttccgcatttgaacttgaaatatgtggataatttgcagaaatgaggtgggaaaaagtaacccaaatgcgtaggaatttttggacagtgggttaaagctaatatattactcaaaaaataattaaaataataaa

SEQ ID NO: 68985 - DNA, 360 bp, Heterodera glycines
  Genomic contig location: Contig_ID=SeqID_1159; Location=500..859; Strand=-
  SCN-specific regions: Sequence locations=1-66,89-106,137-360
atggaagcactgacaatgagaaatggttgggcttttaccttatgcgtgaacaagaaggtgcaaattaaatgctaattaatactaattataatgaatttccattaagataattatttttttaaattttaatatattacaatgtttaaggaactgatggatccaagcaaaggattttacaataaaagcgaggacaaagtgacattggccattgatccttaattactatgagttataagaattacgcgatttaagccataattttggggttggcgagggctgtggaggaaaagcatcccccgggggaaaagcccccccccccccccttaatgtgagaccaatgaattaagacctatcaataaa

SEQ ID NO: 68986 - DNA, 619 bp, Heterodera glycines
  Genomic contig location: Contig_ID=SeqID_1159; Location=1329..1947; Strand=-
  SCN-specific regions: Sequence locations=1-273,316-619
atgaccatgtttttgacaataaatcgaacaactggggatacaattacatttcaattgctgtgagtgacaattaaacattcccttaattgactaattattattaattaaggaattgatggacccaagcaaaggcttttataacagagaagaggacaaagtgacattggccattgatgtcacagtgaaagaagcaaaacggaggacgaaacataaatgcccaatatgatttggggaaaaatgccattgaatatcctccatcctatgatgaacctgtttttttatttattaatttttcttgattatactttcaaaactgctgatatgtgaattaattaattgtcggagctgttttagcagactctcatttttgagtaccgaatttcaatgataaacattttagtcataaacccaattcaaattttaccattttaggtcaatgtttacaatttttggacttggatttattgcattaattttgttaggatttacgtaaacatttttttaaacttttttttttaaattgaaaccattcctaattgactgatcattttttccttttatttaagcagaattttttgggaccagaaatttgggaaccgggaagtttgggcttattaaa

SEQ ID NO: 68987 - DNA, 2552 bp, Heterodera glycines
  Genomic contig location: Contig_ID=SeqID_8722; Location=345..2896; Strand=-
  SCN-specific regions: Sequence locations=1-5,27-109,134-506,529 -704,727-1038,1060-1261,1294-1521,1543-1890,1913-1952,2013-2552
atgggtggtcgacgaggcactcggctggatccaaccgcagatggtccttttggcacatggtgatgacggcattttgggagatttttatgaaatttggcattctcattatttttcttttattttattttattttttgtttagagagtgcaatcagctgcatttctccaatttgcctatcaaacacatcgtatgtttttttttaatttgtaatgaaaattccaattcttttcgttcaattaattcgaattcaataataagttcgaaactaaaaaccgacttccaggaaatttgttacctgctctgaagatggcactgtttgtctttgggattcaatcgatgggcgagtgattgacagtgtcaagtcgaacttcatacatcgaacaatcaagccttatgtacgagttacggctctacttgcaaatcggtgccttgtgaatttttgtaaaaaccaaagaaagggaggaccctttggttacgaagatttttttttgtaaaacaaatatcgaagtccaaaaatttgaattttctacttttggttctaattcgggttagggattatgaatggttaaaaccaacaacattagtgacaagttttcacgactaggcaatatctttcaagaaaaatttccaaaccaaaaggtccccccccctttaagtttttaataaaattcaaacaccaatttgcaagtaatatcggttttttcataaaaacacatttaaattaaaaactgtcatttcagacactgaaaaatggagcccaaaatgtgctgttttgcattggcgactatgccgatgtcattgttttgcatccctacgatctcaacgttctgttcacattgggctccaaaattgagcccgaatggaccgcttccattgccttggccactccgatgggttggccataaattttgcgaatttaaaaaaaggaataaaaaagattcgaattttaatttttttttcgccactcataaaaattattttttcagatgtcttggttggcacttcgctgtccggcattgtcaagctctggtccctgcacaatgttgaccccaaagactgtggggcgagtgtttcgtttgagtgcgagtcgaaagtgttggccactggggcggacggcgtgaaaagcatcgtttgttcgccgaaaaatcttcgcatgatgctgattgtgtgtggcaattcatggcaggtacacactgctgttgtggacagttttgggaaaatttggtcttaaatttatgacaattgtgccttttatctaaaatttggattggattttaattttcttgccacaaattgcgagttttcaaatctgatgcgaaaattcggaatggagcgaacttttcgaatttatgagccccgttttgttatcagataattgacccaagtactttggaccagctgattgtgtcggaatgtgccattgaggcgctggacggtgtcattgtcgacattgacaaagtggccattgcttttgccgactccacaattgtgttgttccaattgccacgaaagtagggaggctcttttagtaaaaataataattgaaaaatttgaaatttatgccaacattttttgcacacctttagaaaactttgtggcaggcaaattcgcgaaaaatttggcgaaaatccgaccaatgtgttcaacattgagcaggcatttgtttttgcactattaaaagggactctttcaacgccgttaaaggtaaatgtttttcataaattgatggaattttttcgttttcagccttcacttacgcccgtccaatttttcttcgatgagtcgcgaaacagtgacaaaaaagtggtggtcgcctaccgagttgatgagcagggcgcgatcagcatgtggcacattccgaacaacttggacttcttggtcaacgaattcattcgccatcggagaccaatcggtgagtgccatttgtgaccaagacaaggaaattacttttgcttttatttctcaatgtatgcttaaaaaatttttcaagaaaaattacatattttttgaaaactggcacaattttcttatcatatttcattaaaattttcaaaaaaattccccggcgggatcgaatttaccgtatttttttttgttgaaaaattgactcaaaatagcaaaatttatcattttttggcgtaaacatctacaaatttctgttttcgccctggtgctcattttgaaaaataacactggaaaaaaattttcgacccgaagagaaaaaaagagaacttctttgattttctccctccgaaattcctgatccacccataaatttactctcatgcttctctactcatttcgcccatttattcagtttatgagccgaccatcaaacaacacatttccgaggcgtgggctcgtctcgtgccgcctccgccgacattggtcgacactgaggtggacttattattgtacatcattaacatatatatgttgctatttgagtgtttcaggacgacgaacgaattgtaacggcgacaatttatgtgggcactcagggcaaactgttccatgggcgtgacgacggctcaataatggtttcgttttga

SEQ ID NO: 68988 - DNA, 264 bp, Heterodera glycines
  Genomic contig location: Contig_ID=SeqID_40723; Location=27..290; Strand=+
  SCN-specific regions: Sequence locations=1-27,51-121,250-264
atgggaccagtaaaatcgatgattacccaacaacagcagcaaaaccaagaagttcaagcagtacaacaacaacagcaaattttgatgggaaatgagatgaagatggacaacagcaaaaatggagaaacaagggaagaggagggaaatagcattggggaaggaggagagacggaagagaaagagaggaaaaggaaaaattcggcgcaaaaaggaggagagaatgaagctgaaaagagaaaagaacagcagcaaatcggcacttaa

SEQ ID NO: 68989 - DNA, 47 bp, Heterodera glycines
  Genomic contig location: Contig_ID=SeqID_40727; Location=280..326; Strand=+
  SCN-specific regions: Sequence locations=1-17,40-47
atgagaattcatgcgagattttctggaaagaagcttaatatggccta

SEQ ID NO: 68990 - DNA, 257 bp, Heterodera glycines
  Genomic contig location: Contig_ID=SeqID_40728; Location=730..986; Strand=+
  SCN-specific regions: Sequence locations=1-114,136-257
atgaaggaacgacagcagctgcaattgcagcaggaagacatggaagctgactggtacatgcgccaagcacgaggagacgaggtgggtggtgatcggatggcatgggacgttgaccaggatgcaattttatttatggacagtttgacgagactatcggccaccaagacttccggctgattcaagccgatccggggcttcattcgcaaaaccgcatcgcaatgaccagacttcagccgcagaagccagcagcgccatga

SEQ ID NO: 68991 - DNA, 785 bp, Heterodera glycines
  Genomic contig location: Contig_ID=SeqID_40731; Location=87..871; Strand=+
  SCN-specific regions: Sequence locations=1-150,343-696,719-785
atgattagaagaggtacagcagtgattagaagaggttcaacagtgattagaagtagtacaacagtgattagaagaggtacaacagtgattagaagagatacaacagtgattagaagtagtacaaatttgattagaaggggtacaacagtgattaattagtaaattcattaaattaaaatgaaaatattttttaacaaatttaatttaaaaaaatacatgaaattctatcaattaaaaaaataattaatttaaacttataaaatgtattcatcaaaaaaaaaattaatttaaatataattttttatttattaactcaacaaaatattttaaattaattaaaatcattgaaaataacgtaaaaatgcacagaaaaataatgttacaccgtccggactcgaactttgcccccccccccaaaaatgatgcctcagaatccccaatcacacagggattctgagatcttgacgatgtcaaaagtaaaatctgatcacgtattcgtgatcagcggcccaaataacgcctaaagacatgtttttggaagatttttggtgaaaattttttttcacttaaaaaccatgtgcacccccctttggtcccgaagcccaaaatcacttttatttttatatctttttttaaagaagtgataaaaataccaaataaattttataaaatagagcaagaaattgcggattttagtattattttacttttccaaaataacttttcagaatcgagttcagaatttttttctgaaaattcgaatttttccagaacttctggaataa

SEQ ID NO: 68992 - DNA, 1397 bp, Heterodera glycines
  Genomic contig location: Contig_ID=SeqID_8724; Location=100..1496; Strand=+
  SCN-specific regions: Sequence locations=1-478,502-836,858-1397
gaccgccaattgcgtcagttcgtctcccattggactgtcggtgatcccgaggatgtgtccgttgcatgtcaaattgcgggcattgatccctcctttggctttgcccgcgtgtgcgacgaaacatcggcacgacgcgtgttccaagaagcgatggtcagacggacagtgatggtgagcaaattgggggggggggagacaaaactgatcagtgtatgagtgatcagaaaaacaattgccgaccggatcgacacaatcattaattaatttaattagtcgaattattagcagagagataaaaatgataggctaatctgatggccatatgccatacaagatttcaaatattactctgccaagcattggatcatttataccgtactctttgttaccgtaccatccgcttataggggataatatgtgcatttgtaactgtccccaaaatatgaaaagcatttcgagccatttgtttgtttgccctcaacaataacaacaacaaccacctgctgctgctgatagaaggaacaaactccttccatcaaacatcttcagcagttttgggtgttgcatttcccccccccccctttccccgcctcactttccgtcattgtccccccgggggatgggtcatcatccttctcactctttgcttccccctcttctcatccccggctccttccccctctcgtctcccccttacttttctcgactcgcttccattgctctccattcattcgctccccgcggagtctcacttttctgcttttctgtcattgttcttccccggtcatccattcctcccttctcccccccccctttcctctctatttgctaataatctctcttttcctcccctttttcgtgtcttcgcatccaaaacaaaatccctttattccaccacctttcagcacaacaacaatgccaacatcgccagcatcgttcgggcgaagcggagagacggcgccgctgcgctttccccgcgcccgccgtccgcgccctctccgccgtccctcactgctgacaatgggcagcactttgctcaacaaatggtcgtggagatgcgcggccgttgcttcaatgccacgttggccgtccgagcccatctcagccgatgtccatggtgtccggatccaaatgtgcacattcacgtggacggatcagagggaagcgcccagcaggtgaggaacgggagaacgacgtgaagcagcagcagggtgatcaatgatcagttggagaaaaatcaatcgataagaagatgaggaaaagggatgatcagactgattaggcgtgatcaggaagatgaattagagagcacaaaattaagaaattatcagcagctgattcgaaaaccagagaagggagaggggcggataggtatactatcagtgatcaactgttag

SEQ ID NO: 68993 - DNA, 1380 bp, Heterodera glycines; identical to SEQ ID NO: 40733
  misc_feature (1297)..(1297): n is a, c, g, or t
  Genomic contig location: Contig_ID=SeqID_40733; Location=1..1380; Strand=+
  SCN-specific regions: Sequence locations=1-246,287-407,429-570,592 -700,722-854,880-953,983-1380
  Gene Ontology: Mol. function=oligosaccharyl transferase activity; Cellular component=membrane; Biological process=protein modification

SEQ ID NO: 68994 - DNA, 653 bp, Heterodera glycines
  Genomic contig location: Contig_ID=SeqID_40735; Location=1..653; Strand=+
  SCN-specific regions: Sequence locations=1-653
aaaaatcgattttttcaagtgtccgtttggggtactcaaacaattatggggagcaaaaatcccacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 68995 - DNA, 193 bp, Heterodera glycines
  Genomic contig location: Contig_ID=SeqID_40741; Location=461..653; Strand=-
  SCN-specific regions: Sequence locations=1-193
gtaggaaatttcccggcttacagtaccagtcttggttcaaaatccgggacacggtccctgtttttcgagttcctttaagtccctataagtcactatcccggcgtgttgataccgtgctgggtggtttcgtaagatccgcaattttagcgaatttttcgacaaaaatggcataattttgcttaattgcaataaa

SEQ ID NO: 68996 - DNA, 1731 bp, Heterodera glycines
  Genomic contig location: Contig_ID=SeqID_8725; Location=2615..4345; Strand=-
  SCN-specific regions: Sequence locations=1-186,208-397,419-1222,1244 -1247,1271-1561,1584-1731
acaattctttggcacatcggccgtgtcgcttcgtttatcaaagagaaattccccgtaacttttctcattttcattcactgttttctttgccatttccatttcaggttaccattttggcatggcatgacatgttggttggtaacattgtacattctcacatttaacaaaaaatccaatcagttttcctataaaatgcaattaaaaatggacgtgccttcccaatttgcgcagttttaaggtccaaatgacggagaaggaattggccgactaccaaatgaccgacaagttggaacccgtcctttggtcttatgccgaagacttggacatgtttttgcccttttcccattggatggcgttgaaaccgtttaggtatgccatgcctgggaaggaatgataaaaattaattacccactaatttggtgaggggtattttgaatcaggctttccatctttttcccaaaattcacaaccctaaccgatgttctgtttccttgagaaatgtctggggcgcgtcggcgttcaaaggcgcggacggtccgatgcgtttccactccaacccgatgcattatgtgcgcaaccacgagtcatgggtgaaccaaatgacacgcgtctacaaggagttcgaccgttttcaggtgcattcttcagtttcaaattggcatttttcatcataggcacatttaatcaaccaatttgtactatgattatttgactttctctttaggggctgatcatcaccggttggtccccgctacgaccatttggccattctctgtgaacttttccccgtcggaattcccgcgctttcgatgagtaagtttcggttcttttatgcgacttttgcgaatttgaaaaatatgctttttgttcatttttaaggcattgaaacaattgccatgggcagaccgctgaatgggaaatatgaaaaaacgagggaactgctgaagtgccaaccaccgagtgagcctggctacacgtccgggtgccaatttcccgggaagagggtcagttggcatggacaaacggacagacaaacactgtgccaaccaatttaaaattgggtttctccctttgtcagatatacgaactcatcaacgagtgtttctacgaactgcgccaatttcgcaaatatttcacctccgacttcgacctcaatggatgggtctccgcttttgctgaacgggaaacgttttcctcgcccttttacattgcggttggaacattttatgaaaactgaatctgagtccaaaataaaaaagttaaataggaaccacaattctttaccattgcaggaaattcagcaaatttagtttttttttcttaacacttaggttttcaaaaaagctaacactttcggcgcatttgcaattattgttgctaattttaagccttttccttccagaaagttctgccaaacattgacctttacttggcaattttggaacggatcgaacgtatgcaaaaataatcaatttgaatggccatttaattaggcttgtcggcttcctctttttaattaatttccctctttttgcttcagacgatcttcgcattgaatttcaaaagcattttttcactgaattggccgatgaatttgtgctcacttacatggcacctgaaatggcttccttacgcgccaaaaaagcggtggctcaaagcattttaaaggcaaaaacttttgcacggagaccttttgtcaaatttccaccgatgagcactaaagacaacgag

SEQ ID NO: 68997 - DNA, 501 bp, Heterodera glycines
  Genomic contig location: Contig_ID=SeqID_40750; Location=40..540; Strand=-
  SCN-specific regions: Sequence locations=1-173,195-501
atgcatgacttgttcaactcgttcatcattggccaactgtctgctgccaatggcactaatggttccatgtcccaaccatcagacccaatgacgcataatcaaaatcgactggtggaaacgaactttgccaagttcagcagggagacaaatcaagcaaataatcaccgtggcggcacctcaaaacaacaaacaaaatccatgtcgtcaaaatctgaggaaaaaataccgtggccctccactaatcagccgaacggtgtgccattggacatggacaaagtgcgactgttcagcaacgcaattgccttcattgccatggaatttgttgcttcttcttcggagagtcgggcggaactctacacgtgcaaatgcttatcggataatgagatggagaagaaaattttcggccccaacggcgccattctttcgcatttaaacgcgtcgtttttaaattcggcacaaaaaaagcgccaatttctgaaactgttgttttcgttcggctaa

SEQ ID NO: 68998 - DNA, 1712 bp, Heterodera glycines
  Genomic contig location: Contig_ID=SeqID_8727; Location=419..2130; Strand=-
  SCN-specific regions: Sequence locations=1-1380,1436-1712
  Gene Ontology: Mol. function=enoyl-CoA hydratase activity; Cellular component=mitochondrial membrane; Biological process=fatty acid beta- oxidation
gaatgcaaaacgagcaatatcgcccgtgaggctgcgatcaccgccggtttccctgattcggtgtgctttcgatttctaaatgtttttcgaatggtcacttggtccattttctgctttcagatcccttgcaatacggtcactctcgcgtgtatttcttccggcgtttcaattcaaaatattagcctaatgatttccactggctatttaaaggcgggcatcgctggaggagtcgagttactctctgactttccaattcgttacaacagaaaggtttgttccattatttggttcgcttacccattcgaagcccctttttaggttcgactttctctcatcgatttgcagaaggccaaaagttttggagagagatttaagcacctgaaaacagtcgcctccaattggttctctcccgagttgccggccgtaagcgaattcacaaccggcgaagtgatgggcaattccggggaccgattggctgccgctttttgtgtgtccagacggtgagggcttacatttaacaaataaagtaaacgatattgttcagagagcaggatgagttcgcaattcgatcccatactttagccgacaaagcttttagagagaacaaattgaaagacgtggtgagtacggaatcagggatggaacgagtaatagcccctccacccaacccgaaataaatttttttagcattttctgacacatggaaaaatgatgctcaaatttcaaaattcgccgttttaatcggctaattgtaaacaattagtcgcatttctcattgtcaggttccgatgtttgtcacctccgggaaacacaaagggacgacagttaacaaagacaacggaattcgtgtttctacgatggagcaaatggccaagctgaaagcagtaattaaaagaggaaatgggggggggttccttttgtaatttccaagggacttttttttaattgagtcattggatctctctgctacaaagctaaccatcacaaaaacaacaaaaatctccgaatttcaggccttcatcaaaccccacggaagtgtcactgctggcaactcctcctacctcaccgatggagcatcggcagctttgctcgcttctgaagaatttgcgcgtgagaagggctaccggccgaaagtgttcattcgtgagactttgttcgtcgcccaagaccccaaggatcagctgctgcttggccccgcctatgtgatcccgaagcttctcgataaagtgagttttggcaagcgattgattatgtgggaaatgtccctttaggtcggattgtcaatcaaagacatcgatgtgttcgaaatacacgaagcatttgctggccaagtattggccaatttgaaggcactcgattctgattggttctgtcaggtacaaacacttttctttatttcttttgcatcaacttttggtttaagaattatatgaaacgcaaagcaaaatttgggcttttgccattggaaaaagtgaatatgtggggtggctctctctcattgggccatcccttcggcgctaccggcgtccgattgttggcacacgcggcgaaccgactgcaggccgaaggtgcgtaaagccggacggggcgggggaagtttgaatatttcgttgattattttcttcaggggggcgtttcgcagtgatcgcggcgtgtgctgcaggcggacatggcatgggaatgttggtggaaaattacgagtcgaaacagaa

SEQ ID NO: 68999 - DNA, 1077 bp, Heterodera glycines
  Genomic contig location: Contig_ID=SeqID_8728; Location=7..1083; Strand=+
  SCN-specific regions: Sequence locations=1-877,899-1038,1060-1077
atgctgtgcaatttcgacaacttcaattgttcgtcctcgcggcacttttcgctcgcttctgttttacttcagcagcaaaaattcgctgctgtttcttcaccgcccaataaaaattggaatgctgtgcttatcgaagcgatgcgtttgaagtcaaccagcatcgtccaggatgatgcaatcactgaacatggccatgatgaccacgggcatggacaccacgcagtcaattatgggccgccgattacctatgactacactcctataccatctcaaccttataaggcttgtttatttgtttcaattttttgtaatataaaatcagaaaatatgttccagagttttttgggattgctgattctaaatcaaacatccattttgattaattctaagtcactgactgaccagattccgaagtaaaatcgaaattccaaaaaactagtctcgatgatataatctgtttgatttactttgaaaatgctcgagaaaaaattcttagtgacgaaacccggaatccaacatttggccctgagacaccctttgcatatgtatgatctataatattagatttgttgctgaaatttcctttttcatcgggactcagttgtccatccaccactcaaatgaccactggtcatcttctttcactcctagatggatttgtcttaccgaacccaaatgcgaaatttgagttttgacggacccgctgttcggaataggccaaaatggatgtctgattgatgatcatcaaccctgaaaactcggaaaaaggcggtgggggaggtgggcaaaccaaagtattaaccaacaaacaaatgatttgtcgttgcatttgttttgatttcgtacatttaataaattaaattgcagaaggtctataaggaactgaagcagaaattcatcacgtatttggcgatgagcttcgtctttttcatgttttgctgttacgttggctattccactgatgtgctgggacactccgcttggaaacttccgggcagctaccgtaacagaaaagcgattaacgcgcgtttggacgcggaggaagcgaaggcaaaggccggggaaggcgagcaatag

SEQ ID NO: 69000 - DNA, 222 bp, Heterodera glycines
  Genomic contig location: Contig_ID=SeqID_8729; Location=1067..1288; Strand=-
  SCN-specific regions: Sequence locations=1-222
atgtcccccttcctccgccgtttcctcctcctctacccatacgcctccccctccgtcccctgcccaccccaccatcgggatcaaatgtgtcgtgctctctcagttcaacgtgcagtcccttcacacttcgacgatgacaaatcgtttgcccatgcactgttatggtctaaagatttaccaaaagacaatttgcgtgcccaattaacaccaaaattgacctga

SEQ ID NO: 69001 - DNA, 94 bp, Heterodera glycines
  Genomic contig location: Contig_ID=SeqID_8729; Location=1123..1216; Strand=+
  SCN-specific regions: Sequence locations=1-94
accataacagtgcatgggcaaacgatttgtcatcgtcgaagtgtgaagggactgcacgttgaactgagagagcacgacacatttgatcccgatg

SEQ ID NO: 69002 - DNA, 431 bp, Heterodera glycines
  Genomic contig location: Contig_ID=SeqID_40752; Location=427..857; Strand=+
  SCN-specific regions: Sequence locations=1-82,118-156,209-319,342 -369,391-431
atgcttggtcttttcaggccgttggagacaacgactgcaactcaaagcacaacgacaaaggaagcgtcaattttggacagggtaattaagaaaaaataaatttaattgaaaatattacgctttgactgatttggccaagtaattatgaaaaagtccattaattaatttaattttttgacaatttaatataaatttaattttaaattaacttttgattttgtgctatttcagtttatgccaaaaattccgaatattttcaattcgtttgtcggcggacggacgacgatggccacaacaaccgctaccactcctccgacacttttcccatttctctcatttttcaccgaaaaacctactacgacaaaagcgttttgtttttaaattattaatagggctgggatttttatgtgctaaaaatcctgaaatatgta

SEQ ID NO: 69003 - DNA, 1180 bp, Heterodera glycines
  Genomic contig location: Contig_ID=SeqID_40753; Location=22..1201; Strand=+
  SCN-specific regions: Sequence locations=1-147,177-211,233-398,421 -723,745-1112,1135-1180
ggtggtcgcggacccatttttgcatactttgaccatccgacacgaggatggaaacacttacgaagttaatttgttggaagaacaagcagctgatcctgaagccgcggcctacatttcgtttgtcagggatggggaatttccagctgatttggatgagaaagaaaaagaattatttgctgtaggcactgccaattacaaattaatttcgggaattcttaattttgaggacaagggttcccccccaagaatttatgtcccaatttcattacgtgggctcattttcgaatcgtttcactcctctctattgggaggcggtcatttaaattacagaaaaacaattgccaaatgtaaaaaatatttttggcctaaaatgtactctgacgttttaacttgggtcaaactatgtgtcacttgccaattgagacacaatccaacacccgcgtaccgggaagagatgctcatggtgccagccaacacactttttgccaaagttgggctggacttggccggcccctttccagtcactcaaaaagggaataaacacattttaaatatcgtttgttggttcaccaaatacgtgatttctgtcccggtccccgacacaaaagcacaaacaattgcccacacttttcttaccaattgttacttaaaatacggtggttgtgttgaattaatcaccgataatgcttctgcctttacttccgaatttttcagagaattttgctccatgctttacattgacaaaaagtatgcctgtccacattggagtcaaggcaatgcgtcaactgaacgcacttttcggacatttcacaacatcttggccaaatacatttcgaagactcagcccgacttcgatgaatttttggatgctgctaatttttgctacaacacgtcagtgcatgcttcaacgggtgagactccattttttctaatgtttgggcgtgacccaattttctgtgttgatcagatcattgatccgaaagttcgtgatccgatagccatttcggaccgtaatgaatttaaacagaagctggtcgttgccataagacacgcgtggcacgctgcagctgatgaatatgcaaaagctcagcgaaaaatgaaggaacaatatgacagaaaggcaaggccacaacaaatcacaattggtgatcgagtgctgatcagaaactacgacggacgg

SEQ ID NO: 69004 - DNA, 1224 bp, Heterodera glycines
  Genomic contig location: Contig_ID=SeqID_40755; Location=152..1375; Strand=+
  SCN-specific regions: Sequence locations=1-746,768-962,984-1224
tcgaattggatgtttggaatgcaaaagggaaaaactgaaaccatacacttatcccgaggctcctaatctgccaaaggagcgagtcaacgagacacgaccctttaacaacaccggcattgactactttggtccactaaaagtgaagagaggactcgaaacggtgaaagtgtatgtcgcactttttacctgcctcgccatccgagcaatccacctggaagtggcagaagactattccgccgaagcctttctccgcgtgttccggagatttgccgcacgacgcggcgtaccgagagtcatcttgtccgaccaagggacaaatttcatcgctggagccaaggtcatcaaggaaaattggaccacagacttactcacactcgaagtgcaagaacagctggctcatcaaggaatcacatggaatttcaacacagcccatgcaccatggaaaggcggcacttgggaacgactgatcggcattactaaaaatgccttgaggaaaagcattggacgcagacttctcactttcgatgaattcggcacgctcgtcgttgaaatcgaagcaattgtgaaccatcgtccgttgacttttgagtcagaccgcgaaccagacccggtactcagaccggtcaattttctgatcccgtacggatcaacggaaaccaattttccgtcaatggcaacggatccggaagatccagaatatacgccgaatcccaacaagctgaaaacgatgcttcagaaggctgattcaagactgaacagcttttgggaaatttggagatccgactatctcctttcactgcgtgaacgtgcaaaccaacggttaaacaacgaacgacaaactcctaacgaaggagacattgtgcttgtggaagaagaagcaaatccgcgatcagtctggagcttggcccgggtccttaaagtccaaataggacgggataacaaatcccgttctgcattaatttcccacaagggaaaagaaaaatggagagctgtaaatcagctctacaatctggaaattcaacccgaatttccagaaatccactccaccgctttcgtcatgagcaacttggacaacgacatcgacagcgtctctctcgccggcagcgaagatgaaatgccgcagccgaaaaataaattccgcattccgaaacgcaaacgggcatttcttcgaccaatcccgcagcagcacagtcctcttcaaggaccgcgtcgcaaaagaaggga

SEQ ID NO: 69005 - DNA, 102 bp, Heterodera glycines
  Genomic contig location: Contig_ID=SeqID_40756; Location=46..147; Strand=-
  SCN-specific regions: Sequence locations=1-102
atttatcaaaaaaagagatagccatttttctgggatagagtataaatttaaaaattccctcaaaaataaaaaggtcgattgcgcaccgccctccctatcatg

SEQ ID NO: 69006 - DNA, 247 bp, Heterodera glycines
  Genomic contig location: Contig_ID=SeqID_40761; Location=144..390; Strand=-
  SCN-specific regions: Sequence locations=1-134,159-218,240-247
gtcagggcaaaattcaagaatgatgatggggaaaagcccataaaaatggcgattttggcgtgatcagaaaaaacttatattgatttgtctgattttgcatttagactccgtccgatcgatcgctcctcggcatatccttcccctcccctcccccaccaaataatcccctcaattcatactcattcgcatttaatattattttgtatgctaaggttaccaaattacgtaaattaaatatttagtttca

SEQ ID NO: 69007 - DNA, 977 bp, Heterodera glycines
  Genomic contig location: Contig_ID=SeqID_8730; Location=1488..2464; Strand=-
  SCN-specific regions: Sequence locations=1-841,863-910,934-977
attatgtaagtaaaatcagagatttatggcaataaaagcattcattcctttttcagggtacatcgatcactccgtcatcgctttcttcgcttaaatcaccaaattttcgacaaaagaggcatcaattatattttgtgtattccatcaccacacaacacggatggccagcggatttgggacattattgttcgtgaaatttggcccattttttcgacaaacattcgctgtttgggctttaccggtggtgatcatttggaccatttgcgtcgtctcacttcgccgacaattctcactgatctcaaccaattgaattcaatccattcatatggtctgttgcccgaggcaattgatgatgattttaatggaacaaatgcaacgatttctgctggccaaattctgtacaaatggttgcacattccgagaaaagatggccaacccaagcgattgcgttgcgatgattacaacacacaagcgaacactgattggatcaacaatttcaaggaggtgtggccatactttcgacaaatcagtgcttttgtttccaaattgtttagcattttcgccgtgccaatgccatttcttccgtcagttacgaaattcatttttctgttcgtgtgccgtcaatgcaaatggtgccgtttgaattggtaaacgaatggacaaaggaaaagctgacattggccaaagcaaagggatggaacaaccgatggataatgaaacgatgcaaaattattggggagaccgcggcggttcaacagcagaagaaagaggaaaattgggacaacaattgggacaatgtgttcatttggctttacatttgcaataatagcattgggtgagcaattaaaaaaggcatttaattttgtttaaataattcaaattgcgcttaattaaggcaattgtctccgccaccagaagaagtggaagaagaagcggcacaaaacatcacaaaggggccgtcttctgacaatgaatga

SEQ ID NO: 69008 - DNA, 347 bp, Heterodera glycines
  Genomic contig location: Contig_ID=SeqID_8731; Location=68..414; Strand=-
  SCN-specific regions: Sequence locations=1-126,149-222,244-347
atgtcggcacacgcggagctgatcgattcgaagatattacgacaggatttggtccatttgtctccggtgtgtccacaaggatttttctgtcagtttagtgccatccataagacgtctcatgtaagctatttatttgttttataaaatattctacaaaatacatattctcgaagacttttttagcatttctttaattttcgtatatattacttttgaatttttcattaaatttatttttgtttgagggagacagcggttcaccattgttacgcgaaattgggggcagtttgtatgcaattggaattgtacggggccatgagtcgaagaaaagtaagagcggaaattga

SEQ ID NO: 69009 - DNA, 322 bp, Heterodera glycines
  Genomic contig location: Contig_ID=SeqID_8731; Location=507..828; Strand=-
  SCN-specific regions: Sequence locations=1-162,206-322
atgcacgattttgtgttgccagtcaaagcatccgagatgcaagtgaccgttgggagcaaagacataacaaaagggactgttcacgaggtggcacggataaaacgacacgaattctacagactgacttcatcagcaaatgacattactttattagaagtacagttttaaatttttaaaaattaatgaatttaaatgaattttatttgtttagctaaaagatgttttggaatgtggcccacaaataacagaatttgtcttccaaataaataaccacggagtggaacgacagcaacaatcatcggctggggaaagacaaaactaa

SEQ ID NO: 69010 - DNA, 1518 bp, Heterodera glycines
  misc_feature (876)..(876): n is a, c, g, or t
  Genomic contig location: Contig_ID=SeqID_8732; Location=269..1786; Strand=+
  SCN-specific regions: Sequence locations=1-608,630-710,737-1233,1272 -1278,1300-1388,1420-1518
atgtgccgaatcggaatcgtaatcgtaatcggaatcgcaattaatcggattttgggccataatcggaatcggataatcgtaatcggatttgccttgaaatccgattattacacccctaagaattgcggtgggggtcggtttagtctggccggtttagtctggccggtttagtctggccggtttagtcagagggtcgttttagtcagagggtcgttttagtctggcaagctgtttttgtcctacattgatccaattctgatttgtttctcgaaaattctttaaaattaacaccataacagatttatcaatgtgttaacaacaaaaaaataacaaaacattgaaaaatgaatacgggcatatttcataatttcgagaaataccaacgagaaaattgaagatattatcgggattagcattggcatggtaattttgatcattttggtgagcagggttaatgttgttgatggtattgtaaccctgtaagagtcgaagaattcgtatcaacggcacgatattttcgcgtttttaggagggacttcaccagcgatgcatcgtgcgatgtctgcatcaattgacttttctcatatcgaattgtgttgatgaagcggaaaacagttggataaacaagcaaaagcccgttgaatgaaaaaacgaaaaaaattagggtttactttgcctgaagctataaaaaggcggtgccaaactgaaggtttcgctttgtttttattttctaattgggatattcatttatattgtagctaaacatagatattttaagtttttccttgtttataattgacaaaaaaaacattttaagagttatgggcaaaaacagcttgccagactaaaaccgaccctctgactaaactggccagnactaaaacggcccagactaaaaaccgccagactaaactgacccagtccgtgcaagaccatcacctcatgccatgttcaacctaaatcaaatatatattaatcatttaaagaagataaagccgcaattggtaaattatcaaggtaaatggtcaattaattagttataaattactctaaaagttgggcccagcttaattccgcatggatcattgctaactatgtaaggcgcttttcgtgagtcggttgccgcatctaattattatttataacagactcacattcttcacacctataagcaccaacaaaataagcactgacaaaaagaaattcttcgtgaacattaatgaaacaaaaatctataattattattatttttataaatcatttttttaaatcccatatacaaatttattcaaaaaagatggatattaagacatgcaatttgttaggttaaaaaaatttacgaattgaataattacacttttgattgactcttgaatctgcgatggtatttgctttaattttccttttttgcccttgacctaaaaacaattagtttgatctgacaaattatgaatgactgctaaactaatatcaattccgagatacttccaaataattaattcatatttgaaattatta

SEQ ID NO: 69011 - DNA, 682 bp, Heterodera glycines
  Genomic contig location: Contig_ID=SeqID_8733; Location=272..953; Strand=+
  SCN-specific regions: Sequence locations=1-169,192-682
ttggatttgcaacgacgtttggatggacattttccccagttttgaccgtcctcaactcggcctcaaattggcacttctttcgccacgtttcaatgcgttggtggacaaacatttcaatggcaaaagcgaattggcaatttggagacgaatcgaaattcgtcgcaaggacaaaggaccagaaacgaagctgtctgtacaaattggtgacaaattggtggaatttccattgcccgaccgtccgttgcccagcaaaatccgttttaagcaccttcagattgagtaattcggaatcagagatttatggcaataaaagcattcatcccatttttaggtacattgatcactccgtcatcgcttttcttcgttcaaatcatcaaattttcgacaaaagaggcaccaatttatatttgtggattccatcaccacacaacacgaatggccaactaatttgggatgtttttgttcgtgaaatttggccaattttttcgacaaacattcgccacttgggctttaacgatggtgatcatttggacaatttgcttcgtcgcacttcgccgacaattctcactgatctcaaccaattgaattcaatctattcacatcgtctgtcgcccgctgcgattggtgatggttttgatgggccaaattcaacaatttctgctggccaagttctgtcaaaatg

SEQ ID NO: 69012 - DNA, 843 bp, Heterodera glycines
  Genomic contig location: Contig_ID=SeqID_40768; Location=171..1013; Strand=+
  SCN-specific regions: Sequence locations=1-314,347-530,552-741,767 -773,817-843
  Gene Ontology: Biological process=myoblast fusion
atgcgaagcccgcaatggtcaggtgctcagttggatttatccgattcgcacgggcgaccggcggcgatgcatggcatcgaagctgggcattcctcgaccgtggcacttctgcttgagcgcggaagtgcgctttttgcacgcgactcgcacggaaacacgatgctgcacttattgggacgacatccgaacaaatgtctaatctatcgactgtcggaagacggactgtcgctggaggacaaaaacaaggaaggtcggtggaacaaggcaggggacgagggcacgccaaacaaatcttggcacgctcaatgagccgtgaaatggccaagaaaacaaaagtaaagcgtaaggcaagcagactaacaacccatatcaatggccagaaatcagcatgttcatgacaactcgaatatcttttcagaccttcgcccgatcgaagtggcaattcgtgctggccaactcgtcgcagtcgacacatttcttcgccgtggcgcccgtctccgctcgctgacttggcaaattgcgctgagttcccatccccctctggtgctggtactgctccggaaactgctcgacgacgcgcaaattctattgcggcgcaaacgaaccgcagaagcgcaacatcgactcagttacgcactgcaaaagtgcgacgaactgctcgaaaaggctgaagcagaagacaacgaagcattgagacggatggggccgcaactgcgacgcgtcaaagtgggagaaggaaacgaaatttttaaaaaacaaatggaaaagtggacgagagagagagagagaggggaggatgagggagaagagagagaggaacggaatgggacagggataggataa

SEQ ID NO: 69013 - DNA, 519 bp, Heterodera glycines
  Genomic contig location: Contig_ID=SeqID_40769; Location=290..808; Strand=+
  SCN-specific regions: Sequence locations=1-171,230-314,342-371,393-519
atggagcgcatggaggagcagcaaatcggacggacattccattttgacgcgagcacagagtggtggaatttggtaagaatatttgttgaaaataatagaaatgcaactacgttccccccccccctcacatttttaaaattttcaaacaatttccaagaaaaaatcagaacctttttataagaaattttattaaaattactgaaaattttttgttttttttcaaaattttcccaaaaaaatcgctgagaaattttaaaaaatttcaattattacaaaaaaatgtctagcaataagtttttttagtgaattctaacaataaatattaaaatttaaaaaaaattcagggagcgggaaacgtgctgcttccaaagtaattaaccccaattttaaatacttttttcacagtatgtgcaaaatttgaccgtgcccatgatggacgacatttgtcacaaagtgttggattccatcgcaccagcgaacggagaggacgcgccaatggcaaacggaacaaaaaattga

SEQ ID NO: 69014 - DNA, 323 bp, Heterodera glycines
  Genomic contig location: Contig_ID=SeqID_40770; Location=263..585; Strand=-
  SCN-specific regions: Sequence locations=1-88,113-246,280-323
atttataagcatttgaagggttctcagcagtttccctgcaaaatttggtgagcttctgatcagtctagaacgttgggtgatcaaatgcaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaa

SEQ ID NO: 69015 - DNA, 951 bp, Heterodera glycines
  Genomic contig location: Contig_ID=SeqID_40770; Location=684..1634; Strand=-
  SCN-specific regions: Sequence locations=1-149,171-951
ttttaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttataaggagtccgaatccttcgggaatagcttcgatatacctctactttatttttaccttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaattt

SEQ ID NO: 69016 - DNA, 468 bp, Heterodera glycines
  Genomic contig location: Contig_ID=SeqID_8735; Location=46..513; Strand=+
  SCN-specific regions: Sequence locations=1-468
  Gene Ontology: Mol. function=monooxygenase activity; Cellular component=extracellular space; Biological process=leukotriene metabolism
atgttcctggcagtgccggtggtcgagcggcaactgcaaaatgatttggcggtcaatggaaaagtttggccacgcggggcattggccgttgtggcgccgattctgattcaccacaatgagcaagtaaaagcacagaagctcaaaatgaatataggtacaaacatatccatccaggtgtaccccaaccattggcactttgaccctgacaatttcctacccgagaaaatggccaaacggaatgccttcgattacattccgttcagttggggcccacggaattgcattggtaattattggataatttaaaatgaattatcattagcaaagattaaaggccagaaatttgcaatgctgcagctaaagattgtcttggcacaccttttctgccattttcatcaaaagaaggtgcgaaattattacgaacgatgaaaagcgtttggatttattgatggatgagaagatcgaata

SEQ ID NO: 69017 - DNA, 654 bp, Heterodera glycines
  Genomic contig location: Contig_ID=SeqID_8735; Location=1904..2557; Strand=-
  SCN-specific regions: Sequence locations=1-191,213-440,533-654
atgataccaagtatgcttaatttagatgcttctggaaaaagttatggcgttgatcaaaaattgatcatttttatggtgatcaattttcaaccaagtataactttctatatacaaatcgtagaaccactattccaataacaattcggtagcaaattttgtgctcttgccagtgggcttgcccattttctctagaaaaaatttcccaaccccctagggattttgaaaatttccccgattttcagtgtattttgggtgtcccgttcactacaaaggagtgatctgatcaagttgatgtaagagacttttttgatcagcaccaaaagttgtgcaagcatgaattatttcaagtatttaaatgaactataagatagtttttcaggtttgagtcaagacttttttggggcactgtatttctctcgtaaaactgtaacttgtttgggaaatattaaataatatattgaaattataattatggtcagaaaaataattaatagattacaataattatattattaattaattaaattaatttcttccgtactgaaataacgccacccctctgaaagtctctcactgatatttttgtcacttcgtcctagcaccagaaaacccaacaaattcaattggtctttactgttgaatattggaaataaa

SEQ ID NO: 69018 - DNA, 577 bp, Heterodera glycines
  Genomic contig location: Contig_ID=SeqID_40774; Location=512..1088; Strand=+
  SCN-specific regions: Sequence locations=1-84,106-131,154-188,217 -354,470-540,562-577
atggcatttttcacaatttttctctccatcggaattatttttctcgcgaatattatctcacgagtaagccaatccggttattaattgtttatttatcataattcattatttttcaggcttttccatgcgataataaagtagtttatgtaccaggagaaagatgctgtcatggcacagataacttcaagtaatatttttaattttttaaaaattaaacaaggttaattaacatcgtaaatgtcccaaggcattgaccccgagagtggggatcgagcccggtgactttactaggtagagacgtggttggtcgcgattcctaaaaagtgcaaaaatgaatcatttgatctttgtgtgatttttaaacaattaactattaaattaagcaaaatttaacaaattttgaaaaaaaaaattctaattaatatattgttaatctatatttaaattgtcatttttataaattttattagcaatttaaatgcaagttttatatagtcttcaaatttgagctaaggtcctatttaattcatttcgcaaatcgaaaaacaaaattccaaaattaatcaaatgacaaaaa

SEQ ID NO: 69019 - DNA, 814 bp, Heterodera glycines
  Genomic contig location: Contig_ID=SeqID_40775; Location=153..966; Strand=+
  SCN-specific regions: Sequence locations=1-221,243-814
atggcacgatgtgtcacgtcgctcgcgtttctcccaattggagacttgacccctggaatcattgctctggacatggctcttcccgacgaacttactcccgtccttgactggtaaattgacaatctcacaaattgtttactatttactgttctttatttattaggttcatcatgaactacacgggtcgtcttaagaatgatggaagccgaacgcgcccgcgatttgacccaaacacttggagcgtttacactcgaacaatgcaaggcgatgaccggacgaataaccattcagaagccgcgaacagacgcctgcagtgctcatttgcctgttcacatccatcgatttggcgtttcattgaccttctgcgaaaggatcaaaagttgtcggatgatgacttcgcgaagtgttcaactggacaagaaccaccgcaaaaggcaaagaaatatcgcgaagcagaccgccgaattctcacgatggttcaaaattatttgccacttaacaacggagacaccaacattttcccaattcatcagcctttcaatcatcattttatcattacctttttgatcggaatttctcgaaattatgaaatgagaccgtgatttgaaacagataaaatgtttgttaattttcttgcttgttttaattaagtgtttatttatattcatagtttgatatgaaaatagcctaaatacgtgaatagggaactggccatagggaaacggtcatagggaaacggcccatagggaaacggtcatagggaaatggtcatagggaaacgaacccaacccactcccgattacaaaaaaaaaga

SEQ ID NO: 69020 - DNA, 671 bp, Heterodera glycines
  Genomic contig location: Contig_ID=SeqID_40776; Location=189..859; Strand=+
  SCN-specific regions: Sequence locations=1-2,361-394
  Gene Ontology: Mol. function=DNA binding; Cellular component=nucleus; Biological process=regulation of transcription, DNA-dependent
atgaggaacagaaagtggaagagaaagtggaagaggaacagaaagtggaagagaaacagaaagtggaagaggaacagaaagcgcaagagaagaagaggaacagaaagtggaagagaaacagaaagtggaagagaaagagtaagaggaacagaaagtggaagagaaagtgtaagaggaacagaaagtggaagagaaagtggaagtggaagaggaacagaaagaggaagagaaagtggaagaggaacagaaagtggaagagaaagtgaaagaggaacagaaagtggaagaggaacagaaagtggaagagaaagagaaagaggaacagaaagcggaagagaaatcggaagagaagaagaggaacagaaagtggaagagaaagtggaagacgaacagaaagtggaagaggaacagaaagtggaagacgaacagaaagtggaagaggaacagaaagtggaagaggaacagaaagcggaagagaaagtggaagaggaacagaaagtggaagaggaacagaaagcggaagagaaacagaagtggaagaggaacagaaagtgcaagagaagaagaggaacagaaagtggaagagaaacagaaagtggaagaggaacagaaagcgcaagagaagaagaggaacagaaagtggaagagaaacagaaagaggaagagaaaga

SEQ ID NO: 69021 - DNA, 479 bp, Heterodera glycines
  Genomic contig location: Contig_ID=SeqID_40779; Location=240..718; Strand=-
  SCN-specific regions: Sequence locations=1-16,40-75,112-216,238-479
atgagcaccacagacaatcaacaacaacagcaacaaaccgttattgaactcactccagaggaagtggtcgaaatcaaaaattaattcattaaaaaaataaaatgaaaatttgaggagccttttggaaaattgggcggtcaaagtgccaaaaatggggggaacgaagtgacgagaaaacgtagaagcaggtagaaatgatgtagcacacacattatgaattaaatatttaaattaattgttgcagcgccaatgccaacgacggcgatgccaatgaaatgagagaaggcgcaatgtctgagtcatcgtcactcaaatcgaatgttagccaaagtaaaatgaggaaaatggttgaggacccgcttaacgaaatccgaagcggacttatggaagcgatgaacgctaatgatggggacgggtcggaggtggcggacagcggacgaacatccgcagagacattggcaggggaaggaccccaaaag

SEQ ID NO: 69022 - DNA, 358 bp, Heterodera glycines
  Genomic contig location: Contig_ID=SeqID_8736; Location=533..890; Strand=-
  SCN-specific regions: Sequence locations=1-358
ttcacccgggcggttgggtgcccaaaattgggattcgtcaaatctacaaggtactcactcgtcagtccatcgtttagcttttttcggagaaaaattcatgaaaaataacaaatccccccattttagcgtgaatatcccaaatttctgcgctccttcagcaaatatgtgctggacaaagcgaacggtacggcattggcacttccgttgtgaatggacaaatgattttgatggcattgtgtaaacagtcaaattatgccaacccgagaaaaagtactgaattccatttcaaatttctgtgccttctttatctcgcttattcgttttcattttatattgcttttgatgtaaaataattttt

SEQ ID NO: 69023 - DNA, 1571 bp, Heterodera glycines
  Genomic contig location: Contig_ID=SeqID_8736; Location=3301..4871; Strand=+
  SCN-specific regions: Sequence locations=1-136,158-474,497-561,584 -903,935-1571
catttgtggagcttagagtcgataggaattcgggacccattggattctaacgatgatgaattagcttccgacctttttcgagactcagttaaatttaaggagggaagatatgaggttggatggccctggcgcccagggggtaaaattaaactgtccaacaactttttcctggcctactcgcggttgtcaggcctatcccaaaaattgcgttccaattcggagtttcgggaaaagtaccaagcaaccataatggagcaatttaaaaaggggataattgagcctgcagttcgtacgggtggcaacgagcattttattccccaccatgccgtcgttacccccaaaaaattgcgcatcgtttacgatgcctcggcgcatgagaaaggaaaagcatcactaaatgaaatgcttattcccgggcccaacttagtcccggaattggcgggcgttttactccgttttcggtcctccgctttccctgtcctgggggacatccaaaaagcctttttggccgtcggtcttagggatgaagaccgagaggtggccaaattcctctggctaaaggatccttccctgcccttaacccatgaaaatttagttgtttaccggttcaagcgcatagcgttcggtgtcaattcttcacccttcctcctggcttccgttcttcagcatcacttaaccttgaatggggaccccctggggatgaaacggaatttctatgttgacaatctgcttctttgtagtgaaacagctaccgaagcagccaaagccgtccacattgcacgccaagtgatgacaagggcagggatgcacctccacgaatttgtggcagccgacccaacaattttgagtgacctccccgccgaagaagttttggtgggcgatgtacaaagagttttggggctttgttggaatttggcacaggaaaaaatattttttgaatttcctgccaagagcaattttccgaccacccgacggggagtattgagcaccatcgcctctttgtttgatcccctgggattgtgcagcccttgtctcgtcaaggcaaaaatgttttttcagtcactctgggattcagccaaggggtgggattagtcaatcggaccaaaattagagaagaattgggttgccattatttctgagtgggactgccccccagtaacgtttgctcggtataccccgtgtggccaggccagccttcagctccatgtattttctgatgctggtcccaattcatttgcctccgcagtttacctgcgctcagcgcttaacggctccgttcgggtctcgctacttttcgccaagtcgcgactgagacccaaaaagttcaaaaacgatgggttcaccataccccggctggaattactgggacttattacggcaattcgtgccaaaaattttgtcgtttctaatttggatttttcgttcgaaaacatttatttttgggcggattctcagatagtcttatcctggttggccagcacggcctctcagcccattttcatcgccaatcgattggctgaaataagaaaggaaaagggcgccttttttaagttcgtgaggtctacggataa

SEQ ID NO: 69024 - DNA, 93 bp, Heterodera glycines
  Genomic contig location: Contig_ID=SeqID_8736; Location=2027..2119; Strand=-
  SCN-specific regions: Sequence locations=1-93
acgtccaagggcccccttcctccatttccttatcatagagttgagctttgatttccgtgggcaacttttcctttatggccacggtcagaaatg

SEQ ID NO: 69025 - DNA, 617 bp, Heterodera glycines
  Genomic contig location: Contig_ID=SeqID_40783; Location=85..701; Strand=-
  SCN-specific regions: Sequence locations=1-192,214-353,434-581,603-617
attaaaatcggtgcgggagcaggtcatgggccgtattttgcgggacccagaaaggcaattccgaattgtttggtgaaattgcgggactatcgacaggaatctgatccgacttttttaccgacccgcggcaactcttatacaaagttagctgatgagaaaataggcattttgcctaaattcatcccattcttatgtatttataacattttcagtatccgaactcgcctcttttttgtcgtcctgcccaaccaaaaagtgcacatcccgcatcaacacccgtgcacagcaaacgcttcatccgatccgacaatttgtcaacgtccgacattttgaattatgtatttacagtatactttaaaaaagttaaattaatttttatttaaatactgtataacaaaattaattaattaattttattttgaaaatttaatatgtgataatactagggttgagcggtaccggtaccggtaccggtaccggtaccgaccggtaattaccggtttttttggtgccggtaccgccggtaaaaatttgcactggtaagaatgggggtctgggtgagaaaagagtagggaatggtgaagaaggagaaattttttgagaaaaaaaaaattaaa

SEQ ID NO: 69026 - DNA, 352 bp, Heterodera glycines
  Genomic contig location: Contig_ID=SeqID_40785; Location=148..499; Strand=+
  SCN-specific regions: Sequence locations=1-40,70-125,208-214,237 -241,272-352
ggaatcgaaggtgttgtaagcttttttcctttttcacttgtaaatttatttaaattttcaatttttttagctttttttcgaaaatttttttgtctttttttcggcaggcactgcctctgacaatgttttttatttatttagaaaaataattttttttttcttgttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctgtcctttcgcttacgaccatagca

SEQ ID NO: 69027 - DNA, 324 bp, Heterodera glycines
  Genomic contig location: Contig_ID=SeqID_40785; Location=979..1302; Strand=+
  SCN-specific regions: Sequence locations=1-37,70-125,208-214,237 -249,272-324
ggaatcgaaggtgttgtaagcttttttcctttttcacttttaaatttatttaaattttcaatttttttagcttttttcgaaatattttttgtcttttttttcggcaggcactgcctctgacaatgttttttatttatttagaaaaataaatttttttttcttgttgatttattttaattatatttcatccttaaattttttaataaacattttcaaactttcaccttattaatttaaggcgaagtttgccttttttaataaattctcttgtgaaaaggcaatggagataggctcttttaaatatgcctatttaaattactttaa

SEQ ID NO: 69028 - DNA, 542 bp, Heterodera glycines
  Genomic contig location: Contig_ID=SeqID_40787; Location=78..619; Strand=+
  SCN-specific regions: Sequence locations=1-142,164-542
atgccacttgagatggaaaaagcggcctcaaaagttgccgaatgtttgggaagcattgaactgcgcgagccacgcgtgaatgtgtgagttgtactccttctgttttagatttcaatgtgtaaaaaaatagattgctattcttttcttttcggttttcctttaattttttttcttgcctaatcgttgcccctcacggtgttttcttttttagctactcaaatttcaccggcaaatgccacacacgtcgtttgacacaaatgcgcacggacattgctcggcaggtgaacaaccccgtcaagtgggagcagatcatgcagattctgttcaacaaaacaaagtgagttccccccccccccccccggattaacaatgaattttgtgactcttttcaggacgaagaattcccttcgtattttgaggttggccccggccgcgaattgggcacaattttgcaccaaattggcaaaaaagcttcaagaacatatgtgaactatcccgcctaatttgttatttttctgttgttacattggctatttgagaaa

SEQ ID NO: 69029 - DNA, 145 bp, Heterodera glycines
  Genomic contig location: Contig_ID=SeqID_40788; Location=25..169; Strand=+
  SCN-specific regions: Sequence locations=1-145
atggaccaacgattggacgacccggtaattaaatgagatgtatgaatcggaattccaccctggggacttgttctaaactctcgtttttcagcaagcattggaagaaaacggaagggataatttctttaatattttattgcattaa

SEQ ID NO: 69030 - DNA, 267 bp, Heterodera glycines
  Genomic contig location: Contig_ID=SeqID_40788; Location=545..811; Strand=+
  SCN-specific regions: Sequence locations=1-82,113-173,195-267
atgtggacaaatttgttccttggctcaagtgacgacgatggttacgtcgttgacggttttttagcaaattggattacagtaaacttttgtatttatttatttattgcaaatatcagattacaatttaatttttcttaataaggccgaaatgttgaatttaacattttaaattgtttatcagtcaaatggagacagagttcagcgtaatctcggcattgatggagaattgctggcagaggacgagtttgttaattcatgaaccaaaaa

SEQ ID NO: 69031 - DNA, 2191 bp, Heterodera glycines
  Genomic contig location: Contig_ID=SeqID_8738; Location=1243..3433; Strand=+
  SCN-specific regions: Sequence locations=1-612,649-1071,1093 -1662,1686-1918,1940-1987,2012-2191
atggcgacagaagaccttaaaaacggaaatttaagcactaaaacaaagtccgaaatggcttacccatcagcgaatgagcgcaatgaagtgatcagtccagccattgctgttgtacaaataacgcaacaccatttgtgcacgactcatagggttgaaaatgccttcaatgcttgtataatcgcgagttgcaattccttgagcctcgtaaagctggcatttcctgtagcgtccatacgaactgacagtacgaccgacaaaaggacctaaaagaaaatggaatataataaaagatggcattttgtgaatgccgtgcctgcgatgatttcatacgttttgtaggtatttgttttacaatgaaagcagaaaaacatcacttgaagcgcagtgtgcttgcgctctaaaaatgaatacataataggttaatttcttcacgatgctttgctacccatttgcataacgcaaattgccaaaagtgcgggaatcgccgaagcaagtaagcgaagaaatggcattgtcaatgtgggaccaagaagcatggaacacaaacgaatgtataacaaaataaaagaaagcggagggcaaatgacatgcctaatgtgtataatgtgtcagatgaaaatgctgcatatttaaatgtaatttaacgtaaaaacataatattgagcaataaccaatgggttgcaattgtccgaaacaatctaatttaattatttgttgaaaagcttatccctctacgaatgtgaaaaaaatcagtttatttcaagtacattcagcagagaatcggttaaaaacccaattttttcgaatttagtgtccaaagtttttgactatgtttgaattagggataggagtccgaaattgatcgggatggatgctgaatctgtgatcagtaataatttttgtgaattgcgcaaatgacgaaaatttacgggctttcagttcgggaaaaaagcgcaaggataaatgaattgtattagtggaaaacattcccttttatgcggcgtttccaaattatagcgttaagaattttttctttttccttcctttttcattatatatatatacctattggctgtttcatcctaattgctgtcagtttcacgaaactcataatcattttacacttcttccctatttctgtttgacttcacttaattgcttctacatttgtttgttttcgctgctttttggtcctacattgacgctttcaattggtttttcagccaacaagtacggcattaatcggttggccagtccatgtttgaaaattcctattccgaagctgcgcaatgttttcctggcatttgcccggctcgcctttttgactttaaggtgacaaaaataagaattattattttttcttttgttttatttcaacgtttatataattttaagattttgccaacaaatccctgcgttttatttggcaaaatgcgtccccattgttcgaatctgaggaattcttacaaattgatcagaatttgcttggtgaaatactcggtcttgatcagttggtgatcaacagtgaatttgcgatttggcaagttgtaattttaaattaacatctattatttaattggtttgtttcttttgcgttaggcactccgttgggccgacgaaaaatgccgtcaaaatgccatcgaatgttccgcggagaatcggcgtgctgcgcttggcccggcacttttcaaaattcgcttccctctgatcccatcagatgcatttgtggagcaaatcggtagataatcagacgtcgtttatcaagcatattttctcttttttgcagttccttctggcgttcagttgatgagtttgtcggtgtttatcaattcaattgccatccgaatttccgtggtgtgcccggattttacactttgaattttcaactcaaattcgaattttcgactggaacgtcgccggggaaaaaattggaaattttgatcatttataagcaggttttcactgaaaattagccaatttatatgtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatccctggtacatatgtgggtggctggacatttcgacaatgaccgtttcgccaatttaaatata

SEQ ID NO: 69032 - DNA, 408 bp, Heterodera glycines
  Genomic contig location: Contig_ID=SeqID_40792; Location=98..505; Strand=+
  SCN-specific regions: Sequence locations=1-178,209-221,244-286,308-408
aaaagaatggcaacaaaattatgccgaaatttgtgagaaaattggagttagccattcagcaattagaaaatggagaaaacaatttggaatgagtaaatctttaacggagaaagaaaaaatggagaaaatgaaaatttattggcaaataaaaggagaaatgccgaaaatgagtgacaaggaaattggaaaaatgatgaaaattactagtagaacaattgcatattggaagaagcaatttggagaaggaatagtggatgaataaaaaacggaagaatctaagaaaatggaaaaatttgccgtaaaattttttccgaattgtaaaacctgagtattcattatttgttttttattgcgtaattttttttttttttatcaattcgtgatttaaattttcaaatctgtcataaa

SEQ ID NO: 69033 - DNA, 1316 bp, Heterodera glycines
  Genomic contig location: Contig_ID=SeqID_40793; Location=131..1446; Strand=-
  SCN-specific regions: Sequence locations=1-148,170-289,346-356,379 -590,612-811,833-908,931-1047,1123-1150,1172-1196,1232-1282,1311-1316
atggtcaacaaaatgggagtagctgcaaacaaaagcaacctgatcatgcagccacttgagtaagttttattgaaaattcaaatccttcaatatttcttataaaattatttgagcataattagtgtggggtttaaaacgattttgtgtttttaatattttggcaaaagatattcaatagccaataaattttctcgaagcctttatatttataaaattctgtacatttttacaaaattggcaaaaaaaaattattggtgacaataatataaatggcaattaacgaacttagttaaatttttatttcatttgtttttaaaaaataatttaatttattaataaaatttactgctcaactcattaatttttttttaatttaatgcaatattttaagttttgcaagttaattagggggcaatttcaattatttctgcaattaatattatttttaaatgacatgtttgtttgttttttttcatttagatacaaatacgagaatgtgcacatggaaatcatgcacagctgcgccggaggagaaccaaaaaaagtgcatttttttgataattatacaaatatttgtttttctctgaaacataaatatttcaaaaataaattgtaccctttttagggatcaaatccctaatatatttttagcaattctttaattaatttcctgaaattataaatttttactcttttctttattttcctgtgactgtttttcgagtttttgggcacttattttcggcattttcgctcttaattcaaaaatttcaatcaaaattttattgttttgagaaatttcattacattaataaaaataattggaaataaagtccaccaactgaattatttgtccaaattttaattggtttcttttgatcatttatttttacgaaaaatctttgaacaaaaaaaattttaaaaatttatgtttcctcccgtttcagatcagcatccatattccgaccatcgacaaatttgagaaaaatatgatgatcaatgaccacgtcatgcaggtaaatttggtggtactttaattagttatggttttatataatattaatttatttaaaaatatatttatttgttttattgcctaaatttttaatttaaaataattatggaagagacccgaccgatcctaattggtcttctggtttattaaaagatttgccgaaaataaagctaatttgcacataaatttttaaatattaattaattaatttaatttcttttcaattttccgtaaagtttccgctttctcaatttatttctgtaatatttttcagaaaaaatatgaagaatttttaggatga

SEQ ID NO: 69034 - DNA, 59 bp, Heterodera glycines; identical to SEQ ID NO: 52422
  Genomic contig location: Contig_ID=SeqID_40796; Location=153..211; Strand=-
  SCN-specific regions: Sequence locations=1-59

SEQ ID NO: 69035 - DNA, 59 bp, Heterodera glycines; identical to SEQ ID NO: 52421
  Genomic contig location: Contig_ID=SeqID_40796; Location=283..341; Strand=-
  SCN-specific regions: Sequence locations=1-59

SEQ ID NO: 69036 - DNA, 59 bp, Heterodera glycines; identical to SEQ ID NO: 52422
  Genomic contig location: Contig_ID=SeqID_40796; Location=413..471; Strand=-
  SCN-specific regions: Sequence locations=1-59

SEQ ID NO: 69037 - DNA, 59 bp, Heterodera glycines; identical to SEQ ID NO: 52421
  Genomic contig location: Contig_ID=SeqID_40796; Location=543..601; Strand=-
  SCN-specific regions: Sequence locations=1-59

SEQ ID NO: 69038 - DNA, 59 bp, Heterodera glycines; identical to SEQ ID NO: 52421
  Genomic contig location: Contig_ID=SeqID_40796; Location=673..731; Strand=-
  SCN-specific regions: Sequence locations=1-59

SEQ ID NO: 69039 - DNA, 59 bp, Heterodera glycines; identical to SEQ ID NO: 52421
  Genomic contig location: Contig_ID=SeqID_40796; Location=803..861; Strand=-
  SCN-specific regions: Sequence locations=1-59

SEQ ID NO: 69040 - DNA, 741 bp, Heterodera glycines
  Genomic contig location: Contig_ID=SeqID_40800; Location=321..1061; Strand=-
  SCN-specific regions: Sequence locations=1-61,83-164,190-439,461 -542,568-741
gctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggtta

SEQ ID NO: 69041 - DNA, 593 bp, Heterodera glycines
  Genomic contig location: Contig_ID=SeqID_40801; Location=130..722; Strand=+
  SCN-specific regions: Sequence locations=1-544,566-593
atgacgcaacgcgtaaatgaacttaaactagaggaaggacaagcaacggttgggcatggaagaggcgaatgggcaaagcaattggtggaggagaggaagacaaaagcggaacaaatgcaacaacggaatggtgagaaagaggaaagagtcgggacaggggatacatgcaatctgctgattgggggtcacaatacgctcgaggtacggcccaacccaaacaatatgctaggcgagatagcattggttacaatatgattatgattcaaatatgcaatagtaggggggggggagagatcgacccgcttccatcgaacgaagtccaagggggggggggtaatggttgctttcaataaaaatttgacaaaattcagagtacggaaacagcgaaggtagtgggctcaattgcacatcggcgaatgccatgcgaattcccttgtcatcggttttcgagggtatttcaacggaaggtcaaaaaattgacaacgaagaaaaggaacgaacaaatgaagaggaaacaaagaaacggaaaaaaggacaagaaattgttgaggaaagaaaaggcgaaaaacagcaacataatgtggaaaaggaaa

SEQ ID NO: 69042 - DNA, 4037 bp, Heterodera glycines
  Genomic contig location: Contig_ID=SeqID_8739; Location=715..4751; Strand=+
  SCN-specific regions: Sequence locations=1-102,124-339,361-939,983 -1172,1203-1377,1399-1501,1523-1640,1662-2144,2176-2293,2315 -2327,2364-2389,2411-2428,2451-2720,2771-3150,3172-3374,3396 -3446,3468-3543,3576-3587,...
  SCN-specific regions: Sequence locations=...3624-3690,3714-3721,3743 -3785,3816-3916,3938-4037
  Gene Ontology: Mol. function=polypeptide N -acetylgalactosaminyltransferase activity; Cellular component =integral to membrane; Biological process=O-linked glycosylation
atggagcacaccaagcagccgttggacgagtacatggcacagttcaaaaatgtttgtatattgggggggggggtgaaaaaatttgcaaaaaaaaaaaaaatcaaccccctctgccggggtggtcctgctggattcaggacgaaactttttttggtcgagtcgaaatttcgggttccggaaaaaaatttccaggccctacagaaaagaaaattcaaaaaaattaaaaaatttcaagtgaaaatcggctaaatttttgtttgtctcattgtcaggttcgcgtgctgcggctcgaaaaacgcgagggactcattcgggcgcggttgcgtggcgccgcggtggccaaaggccaagtgatcacctacctggactcacattgcgagtgcatggaaggtaagcgccatttttggggccatggacatgccagggatttaccaggattagcgcggtcatggttatggtattgagccaggacagcggaccctgtccaacattttcccaaggtttcgatcccttggcaaaatataggaaaattggcctcgtgcctatgttttcaagccatggacttgcttggattttccaaaaaattgcttacctccccctccatctataaaaatcaggaaattccaggttggattgaaccgttgttggaccgaatacacaaaaacgcgtccactgtcgtctgtccagtgatcgatgtgattgacgacaacacatttgagtaccattcgtccaaggcgttcttcaccaatgttggcggtacataaaaaatgtttttttttcaatttttggccctcaaaatttttaatttttcccttaaaaaatttccataaatttttgtttgtttttttcgttatgtcactcactactaatcaactgacaactccggggttcctttcttacagagataacttcagttttcgtcctttttttatctttacgattttttttttttacaattttaataatgagaaaaattatttttcaaccttttttattcctttttttaatgcggctttcttgttgtgttaacatttaatcgcattttttgctgtgtgttttaggctttgactggtcactgcagttcaattggcatccaattcctgaacgggatcgcaagaatcggcgccacattgacccggtgccatcgccgaccatggtctctaaccgagagctataaatttaaaaaaaaactaaaattattaccaattgttgtaaattgtgtgacaatttgccctggcttaactgagaacagtttgcagcttttttgtgttccttaggtattaattttacatgcttacttaacaaatttaattgccagtttcgtctataacactaagcacgtgggcgtaaaattttctaaaaaaaacctgcccaaacgggccaacccgaaaaatttttcacaaaaaaaaactcaaattaatttcgttcacaaagcccaaatcatgggacagtcctgcccttctttaaaaaaaaaattaaaatctcgaggcctaaacagcagatatttttaaatttttaattacaggccggcggtctgttctccattgaccgcgcgtacttcgaaaagttgggcacctacgacccgggcttcgacatttggggcggcgagaacttggagctgtctttcaaggtcatctcacaacacaacaaaccaataaaaatggcttttttcagatttggatgtgcggtggacgccttgaaattgtgccttggtcagcaaatgtcgaaaatttttaggaaaaaattataattttcagcgaatttttggacaattcttgaaaaaaacttactaatttgtcataaaattttgaaaaaatcgctaggaaattttacgaatgataaatctgagaaacaatgaatttttccgcgcctactaaaaattgcctaaagtaggaaaaatccgaaatgctaattaataatttataacaatgttttaatttagttcccatgttggccacattttccgcaagcgaagtccgtacaaatggcggacgggcgtaaatgtgctgaaacgcaactccattcggttggccgaagtgtggctggacgactacaagaagtactactacgagaggatcaacgaccaactggcacgttttttgaggcacaaaaaaatcataaatttttccattttatagggtcggggaagaaattttagaaattaaatataattttgctttttagaccgcttttttgcgatttgtaatcaaatttagtccaaaaatgccaaattttgagaaaatttacgagaaaaagggattttccgggaccagcggagaaaattttgcaaatttgagtgcaatataaatgtgcatcggttttatgccaattttttaataaattttaatttttgaaaattttttcagggcgattttggtgacatcaattcgcgaagggagctcagagaggtaaatgttgtttgcttttcattttataaaattttaaaaattcgatttttcagtcaaaatgaaaattggatgattaaaaaatgaaaatgcatacgaaatttaaattggacgcaaaaatgtttctgaattcatacacttgtgttgtttaaaaaagaggtaaaatcaccgattttaaatatgtaaataggtcccacagtaacgaggggttgaacctgggtaacctttgtgggtaaatccaacacacagaccaccgggacagaaatttaaatttttgaattttcgtttgaaataacccgcgtttttgccaaactgatttttttttaattgtaaatcattaaatttactaaaatttctttttttaagcgactccaatgcaaatccttcaaatggtatttgaacaacattttcccggagctgttcatccctggcgatgctgtagcgaagggcgaggtgagtcgcaatcctaaaaaaatgtgttttaaagcgtccgatttttccgaaatttacgctattttttgggcaagcctataaaaacatcaatttaaacccatccttatagaaatgcaaattccaaaaaaaaactcgaacattttcatctcttcctcttgaaaattcgggtaaattttccacggctttgcttatttttttgttaaaattttcacaaatttgacccaatatcctccaaatttgtttttgtttaaattttattgtaattacggtcttgctttcaggttaatgtactttttaagaaaattggaaaattcggactcttaaaaacaaaatttttataaataatacacgcaaatttgcttatgcttcaaccgctttttggaaatgaaaaactgtctttatctttatataatcgcaaaaaaaaattcgaataattttgatactaaaaaattccatcattaatttgtcaattaatttcaacgttatgtgagatgccaaaactttgttgatcctcctattatttttgttttcctggttctgtcggcttcaaattgcgctttctgtcgcccggtctagacatttttaagtcaaaatttagaaatttcatgtcctttttcttttctttttttctgtgaatgtttttattgctttttctctttcgatgtttccttgccattctgttggatttttaatttcaaaattataaaaagaaaatttggactttttgggtttttttaatttgtttataaaaataatgaaaaaataggtttccaaggcttttcagggtcactgttcacgaatctctgatttttttttgagttccagcggcacgaaaataaaatttaaaaaaaaattcgtcggtctttttccaaattttaattattttcaatccaaaaaatggaaaaaaattttttagggattcctactttcattcattcattcattcgttcgttcatttgtcagattgccaatggtgcgatggtgaagcatcaacggttgtgtctagactgtgcgatcaaaaagcgtgataaattgaagccggttggactgtggccatgccatggacagggtgggaaccaggtgaagttttggcatttccatggcgcccccgccttgcagattcgcaatgggtttgtgccgcgggacggctcgggcaccgcgtcctgtgtggacagcgcg

SEQ ID NO: 69043 - DNA, 858 bp, Heterodera glycines
  Genomic contig location: Contig_ID=SeqID_40804; Location=122..979; Strand=-
  SCN-specific regions: Sequence locations=1-9,31-379,401-606,629 -815,837-858
  Gene Ontology: Mol. function=transcription factor activity; Cellular component=secretory vesicle; Biological process=transcription from Pol II promoter
atgtcgaacagtttctttgtgtttttgcccagcaatgtgtcggattatccggacaatcagcccaacaaatttcgtgtccggctcccaaagcctttgcattttaacggctcgtgggtgtgcggactgcacagtatcagttacccctactcatggtcaaccattggcacattggatgcgcagtggattgacattcacttcaccgaccgcagagcgaccgatgaggacagacagcgggtgatccgagtaccggtacctaaggcatcgcatagcagggttgaacagctcagagactttttggcggtaacattgcgaaatcgcagcggagcaaaactgttgccaacaccccgtgaggtggaagcgaacaggaaccgaacaaagcttcttgattctccaccaccactgaaaagagagaaaagagatgtgtcatcaccgccagtgtttgacgcgagtggaaaacgcctccaggactctcctcctttgtataatataaatgaagacgaacgacttgaggagtcaccgcctccttttgaagaaacaaaaatttcggcggcaccaccaccgcctgtcacaagccccgttaagccaacaacaacagtcaaaacgcccgctgctccagctgcagcaccttccgcaactgcaaaaccagcaacgcagtctacagtaacaaaacaggcaccccaatcgccaaaaccaacagcaaagcctactaccgccacccctgttaagtcaacaaccgcccctccgccaactgtaaagacaacaacagcccctccgccaactgtaaaggcaacaacagctcctccgccaactgtaaaggcaacaacagcccctccgccaactgtaaagacaacaactgag

SEQ ID NO: 69044 - DNA, 228 bp, Heterodera glycines; identical to SEQ ID NO: 65316
  Genomic contig location: Contig_ID=SeqID_40805; Location=411..638; Strand=-
  SCN-specific regions: Sequence locations=1-228

SEQ ID NO: 69045 - DNA, 228 bp, Heterodera glycines
  Genomic contig location: Contig_ID=SeqID_40805; Location=1044..1271; Strand=-
  SCN-specific regions: Sequence locations=1-228
aatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtaaattgcgcaccgccctccctatcatg

SEQ ID NO: 69046 - DNA, 218 bp, Heterodera glycines
  Genomic contig location: Contig_ID=SeqID_40808; Location=313..530; Strand=-
  SCN-specific regions: Sequence locations=1-218
atgaggggggcgaaggcccccctcgaggccgcgaagcggccgagtgagtaccatgggcgcaggaaaattattaaggaggagggttcatttttattgatttttgcaaaattaattcataaattttttttcagaaactgctctgaacgcgatccaaaatttatttacaagttgaataaggcactctgactcttatattatcaaaaaaggagatgaataaa

SEQ ID NO: 69047 - DNA, 358 bp, Heterodera glycines
  Genomic contig location: Contig_ID=SeqID_40811; Location=82..439; Strand=-
  SCN-specific regions: Sequence locations=1-358
gtgaacacacatccggtatacgactgcgcgtacactgacgaacgcgtaaagcctgggcactgctactattatcgggtggtcgctgtgaacgaggccgggctagataaaccgtccgatcagtcggagttggcatgggccaagcccaaatttgaagcgtcccgcttcgaattggacgacattaacggcaaagaagtgattgattgattgacaatgaattgaaacgggaaaatctctttccctccctactcggcccaaaaaaaaatttttttttcatacatacaattagcatttttcaaaaaaatctctattttgcaaatttcaaaaaaacgtctataaacttttatgataaattattaaa

SEQ ID NO: 69048 - DNA, 2532 bp, Heterodera glycines
  Genomic contig location: Contig_ID=SeqID_8740; Location=1749..4280; Strand=+
  SCN-specific regions: Sequence locations=22-136,174-178,200-260,297 -315,338-535,562-669,691-691,713-819,845-888,910-1024,1048-1194,1216 -1542,1572-1671,1693-1701,1741-1820,1842-1984,2006-2111,2142-2532
atggttgatgaattaatatctagtacaaagattgacacaaacaaaaactcttatggaattgaggatttaatcgtaattcaaaattattttgatactaaattcccgaatagattcttaattgtggctttttctaaggtaaaataaataaattaattttttaatgaatttttttaggaacatgggttaaaaccaatttttaaaggacaaggccatagagaacatttgatatgcgtctttaacgaaaacggacattgggatggtaaaaaaaattatttttaaaataatcaaaaattttaggtttaaaaagcatcaaacaattttttaatgttaaatataagtattgtgtttattgtgaacaaactttccaaagcacaactaaacattcaattaaatgcatcataaaatgcagccgatgtggatcgtggggtaaaatattcaaattaaattcatctatttgaaaatttaggaaatgagtttccgtgtaaaaatagtctaatgaaaccagaagaatgtaataaatgcaaccgtctgttttataataaaaaatgttttcaattacacttggcccgtgcatgcaaattatataataggtgtattaaatgtgacaaagaatatcagaccgatcacacccatgtttgcggtaaagttgcccgaaatttatgtactttaatgttattcaggtgaaaaaatatgcaaagtatgcaaaactaaacatacgaagacggaaagttgttatatcagaaagattaaagtaccaaataaattgccgaaatatagaattatatgctatgatgtagaatgcagcgtaagtaattgacgataaattttaaaaattttatatttagacagataataggattaaagaaggaaaatattttggattttatgagcataaaattaattttatttctgcaagatacacgtgcagcatgtgtgaaggagtaaacattaattgccaaatatgcgggccaaaagggaaccgacataaaaaatggtgtacaaatgaaacccaaaaacctatgattgaatttttaaaatgggtattgtcattcaaacaatttaacacctattgttatgcgcattatgcaggtaaaagcaaaaaaactatgcgttttaatctataattttaagggagatatgatgcccatttcgttttaaaagaactaacaaatttgggatatgcaccacaacttattatttctgatttaaaaatttatcagattaaaattgataaaatttatttcagagatttttggctactttcacaaataaaattagcagatttgcctaaaacttttggcatgaattgtgcacctaaattatattttccttataaatataattctgaaaagaattatggtatgtttgcaacaaaaaaactctaaatttagaaaaatataaagaatttttataggtaaaattctcccaaatttgccaaacatcgctgattattatccagaaaaatttaataatattgagttcgaaaaatttaataagtggtattcagaaaattatacaaccccctttttattaggtatcatgttattaattttttattaattttaaatttagaagaacagttggaaatttattgtggtcaggacactgagattttactccaagctgtcttgcatatgcgaaggatttttttggaaatcacaacagataatgaatcacctaatggttttgatattataaaggtataataattttaaaaaaattaaaaattattatttattaggatgtgactaccatcgctggagctgcgatgcgtatatttagggctaaatttttaaaagaattacatttgccgatagtccctgaaaatgggtttgaaaaacgtgatactcaaagtgtgatagcgactaagtattttgaatggtttatgtataaaaatgccgtcaaaggtcggcatgctggaaatgggggagaaattgaaattagcggtactttgaagcatgctatgaaaataaaaaatatatttagggtttaaagtagattttatatgtgctaaattaaaaacaatcatagagttccaggtaggcaatgaaccctctctattctttttaacaaaaattttagggatgcgcatttcacggtcgttatttcggaaaaattttttttataaaatataaattttaggttgcccaaaatgctttaaatcattccatgtttgtcccaatggaaatacggctgaggaaaattttttgaagacgggaaacagaatgcaaaagttaagaaaagttgcattagaatataaattaaaagtcgaagaagtttgggtaattttttcttctatttttttatagaatttattttaaggaatgtgagattaaaataaaattgaaccctaaaaataaatcttatgataaagaaatgaagaatttttttgacaattgccctgattaaggtattaaaaatatattaaacttttactagaaaaatttagggccaattgacccccgtcaagctttttccggtggccgaacgcaggctttttgtttatattcggaaatagatgaaaaaagtgaa

SEQ ID NO: 69049 - DNA, 1975 bp, Heterodera glycines
  Genomic contig location: Contig_ID=SeqID_8741; Location=240..2214; Strand=+
  SCN-specific regions: Sequence locations=1-352,375-381,403-517,540 -806,831-1110,1133-1168,1191-1249,1279-1322,1350-1711,1735-1741,1763 -1975
atgcaaaagttaagaaaagttgcattagaatataaattaaaagtcgaagaagtttgggtaattttttcttctatttttttatacaatttattttaaggaatgtgagattaaaataaaattgaaccctaaaaataaatcttatgataaagaaatgaaaaatttttttgacaattgccctgataaaggtattaaaaaatatattaaacttttactagaaaaatttagggccaattgacccccgtcaagctttttccggtggccgaacgcaggctttttgtttatattcggaaatagattaaaaaagtgaaataaatatcgcagatatcatatcactttatcccgcagtatgaaataaattttttaaagaaagaaaacgattttaggttaattattttactccctaccccgttaaaacgccaaaaataatcatcccaaaatcacacgacgttttgtgggcactcccggacgatataccatataacggtaaaaaaaagaagtaattaatagtaaaatgaactttttaaaattatttaggtattctaaaagtaagaattatcccaaaaaaagatttatcacttcctctgcttccttattatacggtcagaaataattaaacaacaataatttttaataacaattaaggattcaattttattttttactaattgtgcaaaatgttgtaaacaagcaaagccaaattttacttttgcaaagaatgtaagaaaatgcaaacatactgatgaagagcgcagtttatatggggtttatacgagcattgaattaaaaaaaggttaaaagaaaggtagttaaaaaaaattatttttattttagcattagaactcggatatgtgatcgataaattttaccggtaaatccctgaagaattattaactattaaaataatcttagagcttatcactttgaagaatttgattccgacctatttaaaggatatgtacgaaaatttctcaagataaaggtaaacagacagacctattttcatattaaaaaataaaatataggtcgaggcatccggttggccttctaatctccataataatgagcaaaaaaaatcattttatacaagaatacaaacgtatttttgatattgaaattaatcctgataatatgtatttgaacccaggattaaggttcatcgcaaaattggtaaataatttgaaattttctttaaaaaaaacgaaataatttagctattgaattctttgtggggtaaattcgggtgagcatcatttaattattattataagatttttttaagaatgagaaataaattgtcaaaaaataaaataatcaataaaccgtcggaattttttgaaatgttttatgatcataaaatagaaatgtcaaagcctataataatgaacaatgacacaataagagtaatatacagagagaaagatggttatattaaagaacatagtgtatcaaatattatcatcgcattatggtaaacaaatcggtattataaagtaataaatttattaaggactacttcgcaagcaagaattcatctttatgggtggttgcaacaagttactaatgataaacaaaataagctactatattctgataccggttaaaaaaaactaagttcaacttaaagtgttatttttttagatagtgtcatttacaaacatcccatgggcaaaactcctatagaatttggcgaattccttgggtaatttcaagcatttttttaaatataattttttagtcaaatgtcacatgaaaatgctggaaatagtgtattagaatttgtatcaggtggcagtaagcaatattcaattaagtataggaatgacaagaatggtcaaatatggtataaaacgaaaattcgcggtaaaatatgttatgttttcttgtttaattgtgctttctttagggataacttttaataagaagaaccaaattgatcatgatgaatttaaaaacatgattataaattatgaaaata

SEQ ID NO: 69050 - DNA, 93 bp, Heterodera glycines
  Genomic contig location: Contig_ID=SeqID_8741; Location=2736..2828; Strand=+
  SCN-specific regions: Sequence locations=1-93
atgccgtcgaattttattaagtatcagagttttttgagtggaaataaaaatgaagtattgacaattaaagaattgattgattgccgtttaaaa

SEQ ID NO: 69051 - DNA, 564 bp, Heterodera glycines
  Genomic contig location: Contig_ID=SeqID_40813; Location=88..651; Strand=-
  SCN-specific regions: Sequence locations=1-192,216-493,523-564
atgacacaagaaaagctgaattataacaacaccatgctgcttctgctgggccttttgttcgtcgtgattggccaatgtttggccgaaaatttgcctacaattgtggccaagaaaaattttgatgccaccattgaagcggaaaagctgtctgcagcaattagggaaatgaatacggtaggtaaaaaaagaaaattaatttttgaaattttgttttagagtaatatcattgcgattatctgttccatcaacaacaaccaggtatgatagtgtgaagtagagcccggcgcagaacgggatcctgcgtggggattttgcgggattccagtctataatcccctatttttggaaattgcgggattcaaactaaatcccctattattggaaattgcgggatttcgcgtgattggtcccacgagagtctgtaccgcaaaattaaagtaccaatcccccgctgagggataagaaaatttgaaacttccagatcctcgtgtgaagcttaatttcaaactttatttatgaaattaaaccacccttcacaaatggccacacaaaaatttcaataaa

SEQ ID NO: 69052 - DNA, 982 bp, Heterodera glycines
  misc_feature (256)..(256): n is a, c, g, or t
  Genomic contig location: Contig_ID=SeqID_40817; Location=10..991; Strand=-
  SCN-specific regions: Sequence locations=1-11,40-62,205-664,686 -773,819-953,979-982
atgaaactttgcttattattcttttcaattgtatttttaattattaaaattgaaattggagcagaaaaggaaaaagcggaacaaaaaacatttgaagaaatatttggagaaaaatgggaagaaaaagaaaatgaacagaaaaaaagagaaattattcaaaaatactatcaaattaaagaaaggatcaaacaaaaaggaagaaaatattcatcaaaagaatggaataaaattgaattgaaaatcgcaaaaaaattgngcacaaaacgacataaaatttataaatggatcaaagaattaggaatatacaaatggcacaacaaatcaaaaacggatgtacaaaaaattgaaattgtgcaaaaatttaatgcaatgaaaaatgaatataaacaaaatggaagaaaatattcgacaaaagaatggaagagaaattatgccgaaattgggaagaaaattggagtaagttatgtaacaattcaaaaatggaagaaacaatttggaatgggtgaaggaatgacggagaaagaaaaaatggacaaaatgaaaatgtattggaaaatgaaaagagaaaacccaaaaatgagtgacgagaaaatttcaaaaatattgaaaattaatcaacggaccattttcaaatggaggaaacaatttgaagaagaattaaatgaggattaaaaaacattgaggagataaaatttcttttcatttattctttttttcacgataaataacatttattttctttttacatttttaggaaaaaaatttatttcgcgaatttttataatttttatttatcttaaaaattattttaaaaaatagatttctattagagcccggtagaacaggatcttgtcatgatttgcattcactcaactttttgcttcgctcctaatccaaggccttgtcttcatatttgttttttaatccctatattgtatagccttacatatttttgatttttcttaagataattaagattaaa

SEQ ID NO: 69053 - DNA, 864 bp, Heterodera glycines
  Genomic contig location: Contig_ID=SeqID_40819; Location=79..942; Strand=-
  SCN-specific regions: Sequence locations=1-110,137-243,265-307,330 -415,501-639,738-864
atggcaaaaggcgaagggagaacggacgcagtggaggaggacgaattggcgaaggggaagacaaagatgcatccgaaatgggcggccggaagaagtgaagcggatgaaggggaggaagatgaagcagaggatgaagcgggtgaggatgaagcgggcgacgatacgcgtattcggatgagcgcatcgtttcccttcgccccattgagattccattcgtcgatcacatgaaaagcaccgactcgaactgtccacagtgaacaccttcaaccgatcaattgtgccatgaatgatcagcctatgcttttgctttgcttttgccattcaactgactttttcgcggacagttcagtccgggaccgcacaattccgtcgatcggatcaatctcgaattgcatttggtgctgttgcgttgtcccttttgctacttcctcatcgtctgctgctctctcgtcttcctcctctctgttcccctccttttcctccatttttctctcttcttcacagtattcctccacgattttgtagcgaattgttccgccgcctccgtccccaatttgtccctcttccgtttgatcggcattcactttcacttcccaaaaaagtgatttgttctcagaaattcggacaaattggacgggcggagagaggagaagagaagcggaagagaacggggaagaaaaatggacgaataaagtgaggaggacggaagcggaagaaagggaaggggacgagacgagcacggagagtgcgaaactccgatcagaatcagcagcaacggaggaaacggaggaagcggaggaagggaggcgatcggagggagggagacgaagcagacggacgaagccgaagccagacatagtatga

SEQ ID NO: 69054 - DNA, 274 bp, Heterodera glycines
  Genomic contig location: Contig_ID=SeqID_40821; Location=438..711; Strand=+
  SCN-specific regions: Sequence locations=1-274
atgtgtgggaagaaagaaatgattgatcgacagaacccaattgacattttgataagcgatggcgaatacggcgacgtaattgttgattattttggtttgtaactttctttaaatgttagaattctcttgttttctcgtattattacattattcagactttgcgctttcgaatgataccaaaaagatagggtttgttcgaacatggaaaaagttattgtataaaaacccgggattgtcaattgattggactcataaaggtcgattggatagatag

SEQ ID NO: 69055 - DNA, 768 bp, Heterodera glycines
  Genomic contig location: Contig_ID=SeqID_10; Location=328..1095; Strand=+
  SCN-specific regions: Sequence locations=1-37,60-245,267-726
atgaaaagcgatgaaaaaagaagacaaaaacgaatggacaacaacaataataacaatggggtacggtgagaatgaaatccggcaacaagcaaaacgaataagaagcgaagagagatggccaaccgcgaggcacgggacatttgtagagctattatatttttttgagtagagcgggaccgggaattttgggcttaaccgggaccgggaccttttcgggttgaaaaaccgggaatttttggctgggaaaaccgggaaaaaacccgggactggtcccggtcaaaaccgggacctcggtactcagttttactcagttgtccgtgttttggtcccggtcccgctctactctaatatttttcatactgtgctttctttgagaattgccttatgtgtgccatatatgcctaaccatatgtttgcagcactgattctaatcatatctttttcatctgcgactttgtatttgatgatattctttttccacgaatgtcgctatgctttttccaattctgaaccgattttgccgctgtaagtgatcataagactgaattctgtgcgaattgttgttgctgtatttgttgttgaacaaaagcatgcataaaaatgtttttcttgcattctaaactcagttgagcctgatgaaatgggtccattcagtctgaggcatatttttctggccatatcttttttttacgtgataagccgaagtgacataagtatgaataatcgtaatatttaaaatttatttatttgaattttatttgataaata

SEQ ID NO: 69056 - DNA, 771 bp, Heterodera glycines
  Genomic contig location: Contig_ID=SeqID_11; Location=1202..1972; Strand=+
  SCN-specific regions: Sequence locations=1-85,115-171,217-539,571 -647,678-725,747-771
atgcccccaagcgaaaatctttttaatatctcgttaaatgttaatgatctggaagcgcggccgctgcctgagccccaacaacccgaacagcaacaacaaccgcaacaacaacaagcagaattattgattcagattggggatgttgaggatgcattgcttctcaacgttcatgagggagaagaaagaggagaggaagcagaacaagaagaggaagaacataatgttgagcaaattgaagaattgatgcgtttacatgccgagtatgtagcgcaaattttcaatgaaattgctgatgatgaaataaacaatgaatgatttttttgaataatcgataatgatgaaaaaatttccaatgtgtggcaggataaaaaactatggattgatctttgagttttcagcagggtaatcaattgtattgatcacgggcgtcgctttggcaatataaattgctgttccctagtcccgtttgtccagttatttcatttttgttaaatatccaatgcgtcaaaaatcttctccccgaaaaattgtcaatcccgacaacaacaacaacaacaacaacaacaacaatgttgcttctagttattctgaccgcctaaaaaagtttgcaaatgacgaagtaaagaaagcgctcattgagatcgaagaagagagaaacaagaagaagcaaaaacaacgccaagaaaagcaataatgtggcaaaaaatccttactaatgattattgtttttcacattgatcatttttcaatatctttcatatttctaaatca

SEQ ID NO: 69057 - DNA, 3286 bp, Heterodera glycines
  Genomic contig location: Contig_ID=SeqID_11; Location=2578..5863; Strand=+
  SCN-specific regions: Sequence locations=1-714,740-873,934-2715,2740 -3286
atgtttcatgacctacaagaaggtcaatgtgtgttcaatgattacgtggcacgtcaacgtttccacgggccagaagcaagtcatttgttgcgaagagccggaatcgacgtgaataaatacatgtacactttggaagacgttggacggctacaacaatgggttgatgaacattacggagaagggcagattcgtctaacagtttttgagaaggaacaacagtaccggattgttttcaaaggtagtgatttgtaatggaaaaaaaacttttctaaaaaaaggagactctggtagggctgcaagatttaacttgtgtttattgctggagaacgcgcactttcattatgttggacgtattgagcaactgtttcgttgtgcaggctattgtgttgattgtgaacggagagtgactcgaaagtaccatccgcaagaatgtaaagttgtttgtcgactctgcctacgtttcggcgttgattatccttgtcaacaacaacaatttcctgatggatcaaacagcaaacgtcagtgtttgcaatgtcaattcgtttttcctaatttggattgttataactaccatttgttaaatcgcgcacctgcaaccttggatggacgaagtggacgacgattcagcccaatctgtgaatggagacgtatttgtcggatatgtggtggtatcatttatgccactttcgagcacatatgtctgcgaggaattcgacaacagcaacaacaacaacaacaatgcctacagtgctggggagaacatggtcaagcggagccctgctttattcaaccgttggacgagtttcgagcaccaagaaggtccaaccagcagctacaacaacaacaacacgaacaacgccaagaacgaacgattgaaaatgatgttgatgctgatgaagatgaagacgacagtgaatgtgatgatagtgaagaaaacaaccggggccctattaatggtcggcgttctcgtaaactcaaaccgataagatattgtttctttgatgccgaaacctctcaagaccaaccattgcaacttcgaacccaagttgctcaaaagcatgttccacttcttatcattgcggaagtgatttgcgagcgttgcattgctgccggaattacggttcacgctggcgttggacagaaagcgaatggttgtgtctgtggcacgccaacggggcctagaggacgacagtggtgcagccccccgtttcgcaacgcgcccggcgacaacaccgaaatgcctatccatattacatacaaccagcggcgccttttcttccactgttttgatgacgcaaccaaaaatcccgtggatcagttacttgacttcctaatctcaacggggccccggaaatcgcacacgatttgtctgtcgcacaatggcgggaaatacgatatgcaccttgtattggaggcactccatcaacggaatttaccacccaaacggatctgcacaacgggcctgaagatttactcaatgacgctcaaaggcaatcttcaacggcaagtaaccttcaaagacacgctcaattttttcttctgtgaactcgatgctcttccgaggaccttcagtttgccaaacaacattgcaacgtcgaagccattctttccatatttgtacattcgtcatcaaaatttgaatgttcgcctgcaagggctacccggtattgaattttatcagcccgatcacatgaagacggctaaacgtgaacaattcttgcgatggtatgcagttgaacgcaccgccgccaaatttcagctcagagaacaactgataacctattgtgcaaacgatgtggcaattctacgcgagagcgtgctgaagtttcgcgaattaatcatggaaaatacgagaggattggacccatttgtaattgcgtcaacgggtgctggtttggcgttggccacgtttcgacgttgttttcttgctcgcaacaagcttgtcaacacacctgagggcggatatttacgcggaagacgagcatcagcagaatctgcacgatacattcgcatgtatgagttgatgaatcctggtgtgcatgtccagtctgcacagtggagcgtgggagaagcgcacgttgatgacactggttaccgattggatggcctccatgttcgttcgcctccacagcgaaatgtggcgatagagtacatgggttgttattaccatggtaattgcgtagtgaggggccgagttaagctttaaaatttatcaggttgccccaaatgctatccaaacgaacgtcagcgccatttggctggtggaaggactgctgaagagctgtatgagcagacacagcggcgtttatgggagttggagcacacgcatgggcttgaactccatgttatatggggttgtgagttgaagaaaaatttgcgcacaaatccgatgcttcggcaactatacaatgatgcgtttgtccctcgcccgctggatccacgtgaagatgccctacgtggaggtcgcacagagccatttacactgcagcacgtttgcacccaaaacgaggaaatcattctcatcgacattgtaagtggatggtacattatgcttttttaagatgtattacgttttgaggtgagcctttacccctatgtgatgaaagcatttgagtttccggttggaaatccacatgtaataacgcgagaggttctcttatgtcctccaacggccccgttaccctggcaaaattcaaattgcaacacttttcgcggacttttgtttgtttgtgttttaccaccaaatccggatgttcgccctctacgaattcctctgcttccgtaccggaccaatgatggacgactgacttttcctctctgtgcacgatgcgctgattttcgccaacagcgcccatgcacacacacggaccgtttacgctcatggaactcagcgtatgctgtttttttctttaaagtctatgccaaaaaattcaggtatactcatgtcgaattgaacaaagcactcgaacttggatacacagtcacggatctatttgaagtaatctaatcaaatgaagatatatttcatcaaaaaaaaataggtttggcattatgatgcttgggatggtgaaatgtttcgtggatacatgaacacatttgtcggtatgaaagttcaagcgagtgggtggcctgcgggctgtgaaaatgagcaacaacgggctgagtacattgttgatttcgaacgtgtcgaaggttttcggcttgcgcgtgaaaagataggaaataatcccggtctgaggatggtcgctgtgagttgaattgctcaaatttatttttgaatcaatca

SEQ ID NO: 69058 - DNA, 777 bp, Heterodera glycines
  Genomic contig location: Contig_ID=SeqID_11; Location=7001..7777; Strand=-
  SCN-specific regions: Sequence locations=1-226,253-288,310-521,552 -567,589-777
atgcttttttcgttttttctattccaattttattctgttgtctgctcaatagcgtcaaagagaagtcctgaaccatggggggataccctgaaatcgattgacgacaatgccagagatttcaaatggcctgaccgacacgaaaagggtacatgggcagcagtcgccgcaaccggggaaggctccagggctaaagctgaaaccggtgtcaatcgagaggaaggcagtggtatggaggaggaggaggacagccatattgtaagagcggaagcgttgagtgaacgtgaaggcggtgttgcagttgctgcagccaacaaagggcaaacccaaaagacgagtgatgatgataatgattatcatgatggcgcgcaccagcaagtcgtcgtaatggcacgtggaggtgaagacgcccgtgcaaaagctgaagcaagcggaggtccaagaagtgtcgttgaaacacgaattagtgataaccaacgagggggagaaagattagctttgggttcggccattattcatagacaaggaagaagaagaggaggaggaggaggaggtcgaaacagaaaccgtcagagaggcaaagaagaacaagggcgaggacgaagacctattgccaacgataaatttcacccccgccccccgcaatatatggagctaaacaatcgtcagaaaggaaatgagcaagtcacactcaacaacaatgtgcacacaatgagccctgtcagttacccatatttgttgaggaaacaagttggaagagaatgtttttgtacctgctga

SEQ ID NO: 69059 - DNA, 766 bp, Heterodera glycines
  Genomic contig location: Contig_ID=SeqID_11; Location=8514..9279; Strand=-
  SCN-specific regions: Sequence locations=1-48,71-131,166-391,413-766
atggcaactgattggattcacaatgcctaccctgaatatgaacagtctggaggaggaggaggaggaggagaggaaaacaacgagtcgaacgacgctgccattgctgatggcatcaactggctaagagtcattgacgaggaggatgaagaggagcagaacaaaagacgcaatggaaacacaatgaaaagcgatgaggaggcagcggcgccggaagtggtgaatgcttttctgttactatatagatttttttaagacaaacaactccaattcgacatccaataaatgtcactgtgggcgcagcgggccatacagccagcagcaacaacagcatgaagcgcaagaaattgaaatgccattgattgagcatttgtgtgagcgctacaagtgctcagccaaggaacttcaagtgttattgcaaaatttgaagacacgccgccagatactacaatatatgcgtttcaatgtacgcctgcgtacaaactatctcagaccggccatccgcaactttgtcgtacaatgtagtgatttgtcgactctttcagcaactgatgcttttgcaatgcgtggttatttgggaattacggtttgtttgctcatgcatttggtggctgtataaatagaaaaattaaaggtgcgaatctattattacgttaaacacggactccgcctacggcacccaaaccttccatgtgtagtgcgtttgggtggaggtgaacattacgacctgttcccgctcgagtgtttgaatgttgtgaagcagaattga

SEQ ID NO: 69060 - DNA, 725 bp, Heterodera glycines
  Genomic contig location: Contig_ID=SeqID_11; Location=9573..10297; Strand=+
  SCN-specific regions: Sequence locations=1-481,508-725
atgggttcgattggaggggtgccagtgaacacccatgcaggggctcccggtgaagaaatagtaaagcaaaaggctcgggatgttggaggaaaattgttaatggtattggatgatctaatgattggaattggccaaaattttttggacacaattttcacacgaggctcacacaattggggggtcagcgttgttttggtgactcagcacatgttcacgaaggagttgcgtatcgccaggaataattcgcactacctagtgttaatgcgtaatccagcaggagctttacaggtacgtaccttagccacccaattattccctggacgtgctgagcattttatggaggcatacagggacgcgactgggaaacagtttggctatcttgttgttgatatgcatccagaaagtgaggatttgttacgactgaaaaccaatatatacggagaaaatatgggcggagcatccacaatttatgtggcaaaatgagaaagggcagcagcagcagctcaaataacagtggcgttcctatacaaataggcccgctaatacacaaaaatattgattttctaagcaaatttaacgcaaaaacacgtgcttttcagacacaacgacgaatgttacagggggcgacaaacgaacaattattatgttttgttgagatatgtctgaacatattgaaaggaaaacttccaataaggcgaaagtcgcatttgcgtaaattgggcgca

SEQ ID NO: 69061 - DNA, 3926 bp, Heterodera glycines
  Genomic contig location: Contig_ID=SeqID_11; Location=10520..14445; Strand=+
  SCN-specific regions: Sequence locations=1-436,480-524,546-715,737 -953,975-2030,2053-2127,2149-2358,2380-3042,3066-3926
atgcgtatgttcctcgtccctgaggatttgtttaattcagtgataaattcttcaaaggcaccggcagatggaacagcacttggtcttgtccgccagcgtctgcaccaaattgagcgaaacagaaatatggatgagaatgaacgcttagcgaactatcaccaagagtttaaaagactgaacaaaattgtacgagaacaagaggaacgtccaatggatgtccgattacaaaacataaatgaaattatgagcgccattcctccccctccttcacctaatctatctgggcctctacagacttttcatcctcctcaaaacacgggaaccaaaacaaaatcggtagcatctactaagccgtttaggatcgtaaataaaaggaaaagcataaaagagaagttgttgagaaaaaaagcaaaaaaaagttattttaatactaaaaatggtgatgagaatgaagatgatgatgatggtgaagatgatgaatggggacgtaattcagcagaaaaagaggatcaaacgatgcgacaacaacaacaaacatcatcatcagcctttccttataaattaaggtcgggttccgccgctgagggtgaagaaccacaaaaaggcactaaaaaaagcaaaaacgcaccgaaccaaaaactcgtcgcaatattagagcatattaaaaagaatgcggaagccctaggtgttactgcggatgggaagattttgagaagggtttcaaccagtgaggtagggtcacaaacaccgtcaacatacaaaacaagtaatattgaacaaattgtgtcctatctattgaaccagaacatcagcacgggtatcgctcgctttaaaaattttccagttggattaaaagattttttggatagagcataccaggatgattatcttaaaacaaatttggtttccgacagaccttatcagtttgggagtggagttgggagtttaattggtttcaaagagaataaaaagtgtgaaaaggggataaagagttttgtcaattttaagccatcattatggtattagaaaaaaagaagcgaaccattttggaccacctttacaaagatataaattcgccggtcagctatacaagcatggttccattgttgaatgaggcgcggaaaacaaacagttcgatcaagcgcagggatgtggaagaatatttggctgaacagcccagctacactctgcatcgtcaagctattagacgattcaaacgtttgcctacgcttgcttcgggtttgcataccgattggcaagccgatcttgcagtttttgaccgtttagccccacaaaataaggggttccgttatttgttggtttgtgttgatactctgagcagacagttgtttgttgagccagtaaaaagtaaaaaaagtgaggacatggttcatgcatttgataggctgtttgcccattccaaatatattccatggaagttggtaacggaccaaggcctcgagttcaccgccaaacgcatgcaaacatatttcgattcaaagaatgtcaagcatttttgcatgtacacgtccccacaatttcatgctggtatagcagaaagagcaaatcgaacaattaaggaacgattatttcgttattttacggcgcgtcaaacccaacgatggttggatgtcatccaggatattgtgaatggaattaaccattcatacaattcatcaattcaaatgcgcccagttgacgttacatttcggaatgcggacacgctaagagagaaattagccaatgaggcagctatgagtagaccaaaacgtctgcctcgtttccatgtaggggatctggttcgcattgaaaaacataaacatgtgttccagaagggttatgttggccgttttacgagcgaaatattcaaggttgacagtgcggatgaaggccgttcacctgtcacataccgaatcagagatgcggataatgaactgatcaaaggtcgtttttatgcttcggatctatgtcgcgtccgcaaaaacacccaccaggatggtgaaaaattatatgacattgagaaagtgttgaggaaaaagaaaaaggatggggtagagtatgcatatgtgaagtggaaaggttataacaaacagcataacagctggattccaatcagttcaatcacccataaaaatatataaatatatagggaaaaatgataaatcaaaaaacaaatgtccaccatttcgtcaaattctttttatgttgttgttccctcgaacacgaacgttgaagggaaccggacgaactctttccgtgtgcgactaccacgaaaaatacaatttaattcggaatgggatgtgggcctagctaccataatataccctcactcatggccatcattgggcaccactgaagaccagtttatagagcttgaatggaaaaccggaaatgtggtgaccatcccagtcccatcatcaaacattatacgcccctatgagttgagcaaaagtttgtacagccttttggatattagtagtgagcatttgtctaaccaggttcacgatgctcagcaaagctacaaaagagcaatgaacgcggcgcgaaaacatgcacagagagagtatttgaacatgaaaagtgatcttgatagagctaggccgaaaaggagcaaaattagcgctggtgatgacgctatcccattgttgacttcacttctggtcgctgtcgatacaattgcagatgcactcatatacaatgaagacgggacggcaaactctatgctaactgctgacgcattgcttgatcgagagaagcgtgcagcaaccagcaatgtcccactgcgaagagacagtgatagcgatgaggaatatcaaaaaaaattggataactattttatgaaaatacgagacactgatgatcttcagctttatcgagagttagttgccaagcatttggagctggagttgaacaaattgactaaagatcagctctcgctcaacaactcaatcaaggaccttggaatggatgcttggattcaggcctacaggaaagtgagcagcgtattacaattcatttttgacgttcaacaaaataggttcacattgtcaatcaataccaaatttattaaacgagttaagctttcggaacaattggcctacattcttggttttgctccccaaaccgagttcaagcgaagtaaaaatccagcaaaatttatgccagatatgagtgggggagtttccacacttcatgtttacgtccccgacctaattgtgccaatgatgattggaaacgttatagcacctataatgcgcattacaacaatacgtggtaatccggatgaaatggttgaggaacaattttattcaatacaatatcaccgtgtgttgcaaaaagaaatttctgaaattttggtagaaattaggacttcaagcggtgcgcttatgccttttcagtatggaacgtgtacattaacacttcattttcgaaagtcatcatatttttgattgcgaaaaaatatgaacactgtggagcttaataaaattctgacaagaaacccggccactaggtatgcctatcgtggctgctttccagcggataaaattatgttcagtccacgctcaagtttattgccacagtgttttgtggctaacattgataccagtgatatgattggaactcattgggtagcattctattgtgaccggattggtcgtatcgagtattacgattctagtggtgtttggccaccgatcagtgagcatataagtaattttttatcaaaattcccatcagttcgctacaaccgggtccccctgcaatcaccatacgctcgctcttgtggtaaacatgttatttttttcctacaccatcggtgtcttcagtgctcatttgatgaaattgttcaacaattatggctcgcaaagcaatcacctgacactattgttaacacctttgcacgagaaaagatctttagaatataa

SEQ ID NO: 69062 - DNA, 661 bp, Heterodera glycines
  Genomic contig location: Contig_ID=SeqID_12; Location=1675..2335; Strand=+
  SCN-specific regions: Sequence locations=1-578,619-661
atgacttcactctacgcttgcggaggacttcactatacgcggcggaggatttcactctacacttgcggaggacttcactctacgcttgcggaggacttcactctacgcttgcggaggacttcactctacgcggcggaagacttcactctacgcggcggaggacttcattctacgcgacggaggacttcactctacgcgacggaggacttcactctacgcggcggaggacttcactctacgcggcggaggacttcactctacgcggcggaggacttcactctacgcggcggaggacttcactctacgcggcggaggacttcactctacgcttgcggaggacttcactctacacttgcggaggacttcactctacgcttgcggaggacttcactctacgcggcggaggactttgtcttcactctacgccagcggaggtacttctctctctctctctctcgacgcggcggaggactttcactctacgcctgcggaggtgtatcagcgtgcccggggattgaacttccactgacaaagtcattatccaatacactacacgggccgctgacaaattgcaatgcaaataatatttcaacataatttattataaaaaataattttccccgtttttttaaatgaaatgggcaccaatttcacaatatga

SEQ ID NO: 69063 - DNA, 1484 bp, Heterodera glycines
  Genomic contig location: Contig_ID=SeqID_13; Location=124..1607; Strand=-
  SCN-specific regions: Sequence locations=1-306,334-385,508-598,624 -813,870-911,940-1002,1032-1114,1140-1175,1197-1297,1330-1484
atgccagctcagctgcaaccagtttcggttcagcaggctatgccagctcagcttcaaccagtttcggttcagcaggctatgccagctcagctgcaaccagtttcggttcagcaggctatgccagctcagctgcaaccagtttcggtccagcaggctatgccagctcagctgcaaccagtttcggtccagcaaacgatgccaacacagctgcaacccgtttcggttcagcaggagcaaccaacacagcagcaagcgacggtgtggcaaaacacaatgcctattctgttgaatcacacattgccggttcagcagcagcagcagcaccagcagcagatggtgttgtagtagaatgttgtggcaacttgtacaaaggcaactcttacacaaaaaaaaatttaatttaatttttttcttaaagtataattttcagtttttttattttcttaaaaaagattattttccaatttcaaaattttttttttaaaaagacattttttaaaaaaatttgtatggtatttgatcactgagaattgccgatgtactagcctttgtacgaattgagtacccccccccccctccccagcaaactgtgccaaatcaacagcagcaacagcaaattcagctacagccaccggttcagcccgctgtccagcagcaaactttgccaatgaatgtacaaatgccaacggcacaatttgagtcatttttggttcaaatgccacaagcaccgccacctgtgcttcaaacacaacagggccaaccggctcagcaaccggatgatatgtttaggctaattggagaaaatgtattatcaataatattaataataataataataataataataataataataataataataataaaggaagaagctgctccgggcatactttcgacttctggtcgaagtggtggtggtggtggtggtggtggtgggggcgtcaatgggcttgatccatcaatggtacaggggaccagtcaacaaattgtacaaaacagattttaaacaaataattaaaaaataaaaacaattagctgacgcgacgacccaccccatgtccaaacattctgcgtggcaatggtactaggaatggtggacgttccggaggttgaggaggaggaggaggaagaggagggcagggagggcaaggaaggccaaatgtggtgaattgataattttttaagtaaattttaatgattctgtgaaagtaaattgaataaatttctcatgttaaaaaagggaattcattagaaaatgtttgtttttttttgagatgggtaatcgtcatcttgcacgatctcctcctccaccaccgccgccgccagggctaacgcgcaccgaattaacccaaatatttcccgttgttgaagttgatgaggcgatagctgaagaaatttgcactatttgccaagaacatcttgtggccacctctttggaagccacagtcactccgtgtgggcactatttccattttgactga

SEQ ID NO: 69064 - DNA, 701 bp, Heterodera glycines
  Genomic contig location: Contig_ID=SeqID_103; Location=362..1062; Strand=+
  SCN-specific regions: Sequence locations=1-155,179-193,218-701
atggatttaattctcgccactgattggatgaataacgcttacccggaaatggaacaggacaaggctaacatgtcaccaaaggaagaccctagttggattagtctcattgatgaagaggaaaagcgggagcctatagctattgtgcaaatcgatgaggaagaggagaaacaaagaaaaagtttgtcttttagtgttatttttttttaattaaaatttagatcctcccggaaattgcgactgtcgagagaagcgtcgttgctttattccgcttgttgaccacttgtgcaagaaatttgagtgttccgcccacgagttacacgtactcttcaaagacttggggaagcgtcgcgccatcgttgaacacctacgctcttctcaattgtgcacctcccacctgcgtccatcgatacggaatttcccagttcgctgcaacgatctctccattttggatgctcactcagtccctgcataccgtggttacctcggaatcacggtgtttattctttttattttttttatttctcaaaatattttaggttcgaatgcactattacatcaaacacggtattcgattgcgtcattcaaatttgccttgtgttgttgaatttggcggtggagatcataagactttcttcccattagaagctttgaatattgttatttagatgttttctgtatcaaattgtactgttgtttttaaa

SEQ ID NO: 69065 - DNA, 972 bp, Heterodera glycines
  Genomic contig location: Contig_ID=SeqID_103; Location=1585..2556; Strand=-
  SCN-specific regions: Sequence locations=1-459,481-946,968-972
atggcacagcgcgtgggtttcacgcagataaagtacacgcgcactccagcggaattccatcaactcttggacgatccaacattagacaaactggactttgtccacgtctccgagcatatggaccgagttgttgtcaggaagcgtcccgagtttgcaaaggcacccctcacaaactgtcttccagtcgcaatatacgtcacatcgtacgcgagacttcatctctattcatacatggaaaaagtgattgcactggaaggggctgagcttctttattgtggtttgcgaatacaatagaaaaaaaaatgttagataattttagacactgactcaatctactacgtgaacaagatgggtgggcggtgtgttccggaaggcgaggcacttggacaaatgaagcgtgagcatgttgatcgtcgaattgtggaatttgtagctggtggtccaaaaaattatggaattcggcacacagcacgagacggaactgatgagcgggccaacctaaaaatacgaagcttcagattatcgtacgccactcaacaattactgaattttgaagcaatgaaggatctgacactggctacatataacattgacggacctatgtcagtttttttttttaattttcacaactaataattttaaattttagtgatgacgtcatcgacaacgatgatctctacgtgtacggaggaggtggagcccatcgttgcatccgagtaactttcccgcaaattgaccgaaatgtccgttctgacgtatacacctgcgaggcccacaaagactacagacctttctacgccaagggccgtgttcgaccgggaatgcaaacacgaccatttggatatgtggaggatgtatcacatccaccaatacaacctacggctgaacgaagaaagagaacattgattgaccctgacccaactcgaccgggttattctggatggttttgaaaatttattatcaatgaataaa

SEQ ID NO: 69066 - DNA, 2152 bp, Heterodera glycines
  Genomic contig location: Contig_ID=SeqID_103; Location=3616..5767; Strand=-
  SCN-specific regions: Sequence locations=1-749,796-846,907-1788,1810 -2152
atgtacacactggaggatgttgcgcaactccaacaatatatcaataatgagaatggggtaggacaaattcgccttgtaatcttcgaaaaggagcaagaataccgtattgtcttcaagggagaggggtaatatttttttgtttatctaaattaaaaaaaaacatttgaagaactgcagcgcaattcaatttatgtatcctgctagaacgaggacacttcaactatattggacgaattgcacagctcttcaaggttcctggatactgcattgactgtgaacggagagcagacgcgcgttaccatgcgattggttgcaaggcggcatgtcgtctttgttttcgattcgggggtggatacccgtgtcaacgagaacgggttttaatttgagcttatttttttcagttataaaatttttttagttgtctgatggtcagatcagttcacgaaaatgtaccgaatgtggtttcattttcccaaatgacaactgttatgaatatcatttggcgaatgatgcccctgctccaattgatgggcgcggacatagacaacggcgttcactttgtcaatggcgacgtttttgtcccacatgcggtcgtgttgcctattttggaatccatcaatgcccctcgatacgtcgtgctattgggccagttgattgctttcgttgcaaaggtccacatatgttggatgaaccttgctacatccaaccgattggtgttgcaccacctttaccaatgcttggtcctgttcacaacaacgacgacaacaacaacaacaacaacaacaacaacaacaatgaggatgaaaatgatattgatttcataatcaacaatctgggaggagaaggtgatgaagatgaagatgatgttgaaaacggggatgatattaatgatgatgatgatgatgagcgagatgaactgctaccacttcgtctttgcttcttcgatgccgaaacatcccaggagcgcccactacagctcaacaaccaagtcgcccataaacatgtacctttgctaatagttgctgaattcatttgtgaaccttgcattcgagctggaatcaacatcaacgatgggcaaggtcagcgcgcacccggttgcgtttgcctatgtggaagagtgagaggtcaacagatgcgtcaatggatgtcaccaccttttgtaaatgctcctggggataatactcctcagccggaaggagctcctgtattcaacaaccgtcgtttattttttcattcttttgataacgaagcttctgaccccgtagaccaatttctcgactttcttatccatcatggatcaagaaaagcacacaccatttgtatcgctcataacggaggaaaatacgactttcatctggtactcgaagcactacatcgtcggagttacccaccaaaacgtttgtgcaccagcggtctaaaaatctattcaatgaagcttcgtggcatgaatcagcggcgaataacttttaaagactccatcaattacttcttttgtgaattggatgcactcgtaaaaagttttgatctgccacaacatctcgcaactgtgaaaccattctttccatatttgtacattaaacgacaacatctacatcaacgactcgatgggcttccgcctatcgaattctactcaccaaacacgatgaaagctgataaacgggaaaaatttcttcgatggcattgtaataacaatggtgatgctcgtttccaactccgtgagcagctgatcatgtactgcataaatgatgttgccattcttcgagaatccgtgttgcgctttcgaaaactcatcggagaacacactcagggcctcgatccctttttggtgtcttcaacagctgctggtctggctttatcaacgctccgacgttgttttctaccgttcaaccgtttggttcactcacctgagggaggatacctccgtggacgacgagcttccgccgaatcccgccgatacatccggttcttcgagcttgaaaaccctggagcccaagtgcagtgcgcggattggtctgtgggagaggccaacattgaagacacaggctatcgtgtggacggcctctggcgacgagagcctccgcttcgtccactggccatcgagtggatgggttgctactatcatggtgttttatcgtcttaattttcaaataaa

SEQ ID NO: 69067 - DNA, 551 bp, Heterodera glycines
  Genomic contig location: Contig_ID=SeqID_103; Location=5870..6420; Strand=-
  SCN-specific regions: Sequence locations=1-368,408-551
atgagaaacacactgagaaacacgagaggggaagtgtgtgaaatcaggttcttgcctttggaggacaatgagcgtcccgaccttgtgatggagatcctcattcaacaccttctcgaccgtgtcttagaggggcacccgagtccaatcctagttggactgcagctccaaccgccggggtttgatcgaccctacgtgatccgacttcggccacctgaacaaaacaacgcggcagcacttgctgcagctatcgaaagactcaatgagcaatcggccgctggaatagacttgctttctggaacgaccgtcaccaaagttctcgctgtgtggcctttggaatccgttcgtgtcgatgctcagcgagggggttgataaaaaaaaaatttaaaattttgataaaataaaatataggtgcgtgcgatttggataacgaacatcacttatcacacaacgtgcagtcaatagttcgtgttgtgaaccccaacgatcgttactgcctcgcgcgtgctgttcttcttggactttgtgatcgtgagacacaaatgccaaattga

SEQ ID NO: 69068 - DNA, 746 bp, Heterodera glycines
  Genomic contig location: Contig_ID=SeqID_1160; Location=277..1022; Strand=-
  SCN-specific regions: Sequence locations=1-45,67-636,677-746
atgcccgagacggacgtggagcgcatttcacgcttattcgtcgaccatgtaatttttcaaaaatttaatcttttaagcacaaaacgcccactgtcagggatcacacatactggcgctaattttttttgaacaaatcaaatataccctaccgaattgtttttccaaaaatgaaataggccctgcacttagaaaatcaagtttttctagcgcaaattttatcatgagttatagctttttaaattttcgggggggggggggggtgtgacggcctctggggagaaaccaaccccggccatgataaaagtggctgaacttgtccagtttgttgtccatcaaactccacggttttgactatgcttcaattaactcgctcccgtgctttttcattatattttcctcccattttccaggtcattcaatttctcgaccccatcacgaagctgggtgccctgcgcgagaagtaccggctccattttgtcatcaccaacgaacagttggcccttctccgggactttggcgactaccttcgttagactgaaattgacggactgctcgctgtcgtcccccccccccttcccttaaatgtgcatagtattatcccatgtttgaccgttttattcgtacttctctgatcagctttgtatatgcactaattttttgtttgtcctctgataattactttttttgtatgtctttccatgatttaatccctccttaaatgcttcttgtgcgttcatttaaataaa

SEQ ID NO: 69069 - DNA, 543 bp, Heterodera glycines
  Genomic contig location: Contig_ID=SeqID_1161; Location=1550..2092; Strand=-
  SCN-specific regions: Sequence locations=1-485,535-543
atgaaacggtctacgagaaatgcgtcaaaaagagaaaataaaaaatcccgaagttcggattcgctaagacaagaaaaacaccaagaaaaaagtcaaaattgtatcaaaaaaatagatgaatatacaactagtagtaaaaagtttcaactattaaggtcaaaatcaaaatttgtcgttcaaaatatagaccaatgtgataatcccactaaggagttagaagaatgtataaaatcgtcaattaatgaagctatcgaagatgctaagagaactttgggtggcgcggataaagccggagtagttatttcttcagaaatgttagatcaaggagacataattgtgccgataacacctattagctcaaatgtggcagacgcggtcttcaatcaatttatcaaagtagaacaaagtgtagtaagaaaaagtcttaacatttatggaacaccttttgtcattactgtaacagttcttaacattaatggattaagaaaaaaaaataaagaataaattattttttttttttaatttataaaaaatgtgaataaa

SEQ ID NO: 69070 - DNA, 3194 bp, Heterodera glycines
  Genomic contig location: Contig_ID=SeqID_1161; Location=5657..8850; Strand=+
  SCN-specific regions: Sequence locations=23-1693,1715-1779,1801 -2189,2211-2229,2252-2344,2368-2874,2897-3194
ctctaccacaacaacaaccactttgacggcatcaaaaccctgtccaaattcttcaataaacgttactattgcctctcttgtgaaagcgtctacgagcgcaaatctcaacattcaatgaattgctcttcactctgccatggatgtagggaggttggcgtcgactacccatgcgagccacaacagggatacttcaaaaaatgtttgcactgcaacaactatttctataacaacgactgctatgaacgccacctccacaaggatttgtgcaccaaatttcagcgttgcgaagattgtggggtaatttataatgttaaggttcacggaaatgtaggccaccaatgcggagaaaggttttgtcgtctatgtaagcagtttcatttaaaagaggaagatggcgagaacccctgcaaaagctgcttcatccaacccctaaaaccccataaacttaaaccatacaggatcatcgcatacgattttgaggcgacacaggataaaaaagtaggtaataaattcgaacacgaggtaaactttgcagcggctaccgttatttgcaccgaatgtatcaacaacgacaactggaacaaatctctacaaggaaatccctgcaaaatttgtggcccctaccgcacaatcaccttttcacccttcgactacacggagacaacagtcgaccaaaaaattgtcacacaacaaccactaagtgaattcgtccagtggcttcttttcgaccacaacaaaaagtttcccacggttgcctttgcacattttgggggccgctacgacatgacgatgatcatcaaggaggttttagcgcaaggaattcacaacccggacatcatcaaacaaggaaatcgtctctacgagctgaaaatcaaggacaatgaacattgcccactcacataatgcccatcaaactatctggcctcatcaaatcttttgggcttcatataaaagataaacaacattttccacacatgttcaacaaatcatcaaactatgacaacattctctcccatcttcctccacgtgaagaatactgtcctgatcaaatgaaaatccccgatcaacagaaatttgacaaatggtacaataataattacaaccaaccttttaaccttaaggaaaaactccctgaatattgttgcaatgacgtacaaatactcacccacgccctcgtcgaattacgccgggaattcaaacaactgacacaacggaacggaaaacacgggggaatcgacattctttggcaagccatgaccattgccagcgcttgcgtcaagaactttgcactcaatcatttgaagcccaactcgctcgccatcgtcccggagaaaggctatacaccacaacagaaccaaagtgcactggctatcaaatacctcgactggtactcccacatcaacaatgtcaacattcaaactgcacactcccgctatggtgaatatgtctttaaacgtgagggtcaggtgtatcaagtggatggttatataaaagggactaatgggaagagggataaaattattgaggtaaatgggtgtctgtggcacgggtgtgaggagtgttttgaggacttggacgaagagacgaagatgccgaacggaaagacgctaggacaattaagagagaggggagtaaggaagcacgagattcttcgccggtacgtcgacttggaggttatttgggaacacgaaatcaatgagcagctgaagaaggacaagcaaatgagggagtttttcgacaactggaaggaccactcaccaatcaaaatcagagacgcttttcatggaggacggactggaccaatgaagctactccacacagctaagccgggacaaaaaatcagctacaaggacttcaccagcctttatccgtggaccaactttacgaccgactatcccctcagccacccaaaaattatcagctttagattaaatgagcaaactgtcaactggcgagctccttccgacaacccctacaaaggccttctcaaagtcttgcttctacctccaaacaacaacattaacgtcaccgttatgcccataaaatttgatgagcgactcctctttccactctgtgaaaagtgcgccaaacacatcaccaatgaacacccgaatggcctcaaagacgacaactacagctgcccacacttcaatcccaatgaccgtgcctttgtctctacctgcactcaccttgaattgaatgctgccttggaggtcggctacaccgtcagaaaactcttccatgtcctgcaatacgaccaatggagcgacaacatcttcaaatcttacgttagcgaaatgatggccctgaaaatccacgcaaccgggttcccgtcgtggtgcgagagcgaagaggagaagaaggaatacattgaggagaaccgtcagcgatttggaattttgttagacaacgaaaagatgaaggctgaaccggggaagcggtacatcgccaagctttgtctcaactcactctggggccgcttctcgatgcgaaatctactctcaaaagcaataatcaacaatgacccttgcgtcctccgccaatacactgacgacaagaaaatcgaattagtggacttggaaatgatcgacgacgacaacgacgtattcatgctcacctacaaaccaaaagaggagtttgtcgacgaaaataaatactccaatgtcgtcatctccctcttcacgacatctgcagctcgcctctacctctatgaagtgttaaaaaaagttgccgacacccccgactgcgaaattctctactttgacacggacagcatcatctacgttcaccccgaggaaaacgacccactaccaacaggaaagggacaccttggagaactaacagacgaaaaccccgaccacaatatcttggagttcattagtgctggctgcaagaattatgggatgaagctgcaacgcaaggacaccggtgaaatagaacacgatttgaaaataagagggttcacccttgatgcacaaactgttcaaaaaattcattacgatactgttaaggaccaaatcttacgctatggctccgaagacccccctgaccctatcattgtaacttacccccattttattcgccctaatctaatccaaggcaaagtgtatactcattccctcacaaaacattatcaacccatattcacaaaaggtattattaatgattcattccaagtcctcgaatttggttat

SEQ ID NO: 69071 - DNA, 408 bp, Heterodera glycines
  Genomic contig location: Contig_ID=SeqID_1161; Location=9350..9757; Strand=+
  SCN-specific regions: Sequence locations=1-408
atgtcttctacttcttcaaagaagactctccaatctgtagtggagcaagtaattcaacaagacgcagaaataaaaagcagtgagaaaccactaaaacagaatgagttggaaaagagtgaacggaaatcaacccacaccgtatataacttgcttgaccacaaacgatccttttggaaattggcccgaccaaagtttgcagtgatcaactttctctgcccagggtgtcgtcgaatcaactataaacacaaggaccagttcaagttgatgggagaagatgagttccactttacccaagtgatgtgtcccggttgcgtaaagtacaatatgatgcagactgatatctataacaaacacacaaagaacccccactaattgtatttaagattaaattttaacattatataatta

SEQ ID NO: 69072 - DNA, 995 bp, Heterodera glycines
  Genomic contig location: Contig_ID=SeqID_1162; Location=619..1613; Strand=-
  SCN-specific regions: Sequence locations=1-353,384-995
atgctctggacattgatgagcatgacgacggatcaaccgaatttgaaattgtctcgctcaccttgtacgataaaagcccgtgcacaatttgccgtgagactcggctatggtaccacattgggtaccgcgccgagcatcgccaaattcgcacccactggggcgtcaacctttatcttaaagatgaaggttgcatagcacacgtaaagattgaatggtcaaaaaaaaataatttgttttattccaggccgggtttagcctaggtcggcttctgacctttgtcagcatttacgccaacgaaaacgggcaactcaatgttcaaaaggccagaagagtgtaagaaaccgtgtctatcagcacaaatttgtttgttttttgtaaatttagcgtttttgcgagggccggcgagcaagactttgcccttcaaggccttatcgacgggcaatgtgtgccgttggtaacataattttaataagtgtagcaaaaaaaacaaaatgcattcgctttaaggagcgtctcgcggatgtcccgccggcaccagctgctgtcccaccggctgccgccattgccccgccagccgttgtcctaccggcacccgccgaagtccctccggcagacgtggagatcgaattggacattgacggcgaacaattgacaaacttcccggcacaacaacacccgcaacaattgttcccggcacaacaacaacaaccgcagcaattgttcccggcacaacaccaacaacaactgctgctgccgcctcggccgctgatttcgcagattgtcgaccgtgccgttagcgtgctccaaatgcattttcacaacatgtctcctctgcggcccgcttttccgccatttttcatcaactcgccgtttcctcggcttcagggcgccttggaactccctcctcttcaattcggtcagcagcagaaccaacatgcatttgcaccggcactccaaattgccccggtcgacgatgccccgacgcctcaaccgtt

SEQ ID NO: 69073 - DNA, 2547 bp, Heterodera glycines
  Genomic contig location: Contig_ID=SeqID_8742; Location=766..3312; Strand=+
  SCN-specific regions: Sequence locations=1-830,858-959,982-1209,1231 -1341,1365-1559,1653-2547
atgcagcagaaccgccgaccttcgaattcattttggccgagacgaagcacagggtgagtacggtatacttacctgtaaaaatgatattttctgtcctttttttgcagtgccaacaattgtccacaatgttccattgaaggtacaaaagggacaaaaaagtgtgccaatcactgcagatcatctccaagctacggtaacggtcactgtgtcccacttcctacggtaattgtgcttgaaactgttcagcacccttcaaaaatgccgagtgaactccattttatggtatggcaacaacagggcggcgcacttcaaaagggactgaacacgaccatggacactttcacgcaaaaggaattggaccacggctttgtccgctttgaaattgacgaggcgaagggcgtgccggtaagtcaaagaattgctttttgccagggccaaaatcaacatcgacttttataggacacgaaaatgggcttccattttctgttaaacgacggtcgccatcaattggaccccgaatttttcttgttgcaatttgacgaaatattgccaagcaaaaaagaggacggcacaatgccaactcagtcgacattgagcagtacaccgacaattcatttgcctgtgccaagtgtcgcaattgggccaaaaattgaacgaaacgccaaactcggcactgcgccgggtgtccctgcggtgatcggtcctaatttgctgaaggcgaccggcggagggaaaataccggtcgaaaaagtcattttccacctgacaaagcagccaatgcacggccgactggtgaatggctttccgagaactgctcgggactgttgtccgcttctgttcagctgctcaacggctccctggggcggttggagcggttcagtcaggcggacatcgacgcgggtcggctgacgtacgtggcgaggccggacattggcgcgtggagccaacgcgacaatttccaatttaaagtggaggaggaggcggaaaacggcatcggaaggaatgcggggacgagcggagaggggacaacggcacaacgattcagaattgagagcagctactcaaacttggccgaaggggcgccaatcgacgcactgataccccggggaataatcaccgttagcagaggtaatgggatggccaaatgggagagacaatggcaattgtggccaagggaggagggatttggacgaaaggggagaccatgccaagggagagattttgattatgattctgttggtcaaatcgtagtccagaaatggctattgagtttagccaacccccggcacaattcgttgccctccgttccgttttatcactccgcccctatttatttatgtcaattattttttttatttaaatttccaatttttcttttcggtggttccgttgcactgaactcctcccatttgaatctgaccaaactgtccgccgttattgaggacgaaattttcataaagctttttcgcgcgcccgcctttggatggttggagagaattgacgaagcattggcaattgaaagcggcggaggaacgaattttggcggattagcaaacggagagaatgcgggagaagaagaggaggaggaagaggagaagcaaaatggggacaaagtgagaaaagggagttggtggagaggaaaaggaaaaggaaattcaaaatgaaaacggaaaatttaaaaaaatggaaaattaaaatcaaatgggaaaaatttaaaaatggaaaacggaaaattaaaaacggaaagagttcaaattgccctaggccatctttccccagtggcgttcgcccctttcggccgaacaatttgcctctggccactttttggtgttccaccaaaacggaacgacaacaaatgtagcagcagcagcagaaaaagcgggaaatgaagacgcatttacgctggttgtgtacagcggaagggagccaaaccaaagactgaaattggggatgaaagtgcgaataacggacgaaggcactgatcagttgaaggtaaaatagaaaaggcactgatcagttaagaataactgtaaaaagctctgattatttgagggtaaacgataaaaagcactgataagttgaagagtaggcgagcattgatcaggtaatagaggcactgatcactggtcagttaagggttagctagctataaaagggccgatttgtggtgatcaaccgaatattaaaattcaaaattggaaggaaaactcggcctaaattctctgtccatctgtccccagtttatttctaacatttcactctcgataattaattccgtattcattcagatcgactcttttgtgccccacttgcgtttgctgtccggtggttcggtccccttttatcctgccgattttcacgcgttccatccgtcgttgggtccctcccaaattgtctatcgaattgaccaattgcccaacactctccgccttagtctgaacaatttcagtgagtcatatttatccaaaatattcaaatcaaatcaacacatttggacactttcgaaggtttgccgctgttccgacaattcactcaattggacattga

SEQ ID NO: 69074 - DNA, 1316 bp, Heterodera glycines
  Genomic contig location: Contig_ID=SeqID_40823; Location=136..1451; Strand=-
  SCN-specific regions: Sequence locations=1-748,770-942,966-1286,1308 -1316
  Gene Ontology: Mol. function=organic anion transporter activity; Cellular component=integral to plasma membrane; Biological process =transport
tgtcgttacctcggttgcgtagccaacagatggctaagcgtcagattggagttcatcggaaactgtatcgttttgttcgctgcgctttttgctgccatcactcgtgggtcgacaagtgccggcatcctcggactctccgtctcttattcgctaaatgtattgtgacatttttccaattcgatggttcatttccatttttcagatcacttttgcgcttaatttcgccgttcggcagattagcaaacttgaaacgagcattgtttctgtggagcgagttaaagaatacgcggatgtcatccccgaagccaaatggaaaatcccaggccgagaaccgcccgttgggtggccaaaccatggcgaaattcacttcgtaatgaatttttactgtaaaatgtttgatttgacagttttgcaggatcactactcgactcggtaccgttctgggttggatttggtgctgtacgacattcacgctaccatccgaccagcagaacgtgtcggcatcgttggacgtactggggcaggtcctttgtcggtgttcttttcgtttttaatttgacaaatttaggcaaaagttcgctgactttggcactgtttcgaatggttgagcctacgggtggtcgtattttcattgatggcgtcgacattactcagttggggctgcatgacctccgctcgcgtctgaccataattccgcaggcattcgttgactcacaattagtgattattcgccctctgtttattttaggatcccggcctcttctccggtaccctccgttttaatttggaccctttcaaccatcacacggatgccgaagtttgggaagcgcttgaaaattcgcacttaagtgaatttgtcagcaatttgcctgcaaaattaatgtattcgataagtgagggcggagagaacattaggtaaactttgacaaatatgacatttgcttcattttttattaatttttaatctttcccttagcatcggccaacgccaattgctgtgtttggcacgggctttgctgcatccgagtcgcattttggtgttggacgaggcaactgcttcagtggacatggctacggacggtaaaaacattcattcgtcgttcggcatttgctattttgaacatttcttccctctgtttcagctcttatccaggacacaatacggcagaagttcaacaactgcaccatttttacaattgctcaccgtctcgcgaccattatggactacgaccgcgtgatcgttttgcacagagggcgaatccaggaattcgacacacctcaaaatttgctggcccttccaaattcaatcttcgcga

SEQ ID NO: 69075 - DNA, 56 bp, Heterodera glycines; identical to SEQ ID NO: 52733
  Genomic contig location: Contig_ID=SeqID_40824; Location=826..881; Strand=+
  SCN-specific regions: Sequence locations=1-56

SEQ ID NO: 69076 - DNA, 250 bp, Heterodera glycines
  Genomic contig location: Contig_ID=SeqID_40825; Location=752..1001; Strand=-
  SCN-specific regions: Sequence locations=1-250
ccataaatctgggcgcatcggttcggggggactgccccgaaaacaaaaaaatcgatttttcaagtgtccgtttgggtactcaacaaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaaca

SEQ ID NO: 69077 - DNA, 468 bp, Heterodera glycines
  Genomic contig location: Contig_ID=SeqID_40829; Location=90..557; Strand=+
  SCN-specific regions: Sequence locations=1-468
gtttcaaatatcgtaagattgtttgataaggccagacaagagaaggcaactgttggtaccaagtttgcagtaaaaaaatgacaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaa

SEQ ID NO: 69078 - DNA, 346 bp, Heterodera glycines
  Genomic contig location: Contig_ID=SeqID_40830; Location=435..780; Strand=+
  SCN-specific regions: Sequence locations=1-62,85-201,223-320,342-346
atgtggttgacagaatttctggaaggttacggtattcccaaggggattcttggtcatgtcatagtttagatcttatctttaaatgggacgttatagttttaggcaaaataaaattttgttctaggaaatataaatcataatgtggttgacagaatttctggaaggttacggtattcccaaggggattcttggtcatgtcatagtttagatcttatctttaaaaatgggcgggattttcatgtgtagtaaatatttccgctttaccaaaaatgtcaacaaccaaaacaacgaccaaaatcttgatgacttactactcaattaatacaaaaagaattttaaaaattaa

SEQ ID NO: 69079 - DNA, 347 bp, Heterodera glycines
  misc_feature (7)..(7): n is a, c, g, or t
  Genomic contig location: Contig_ID=SeqID_8744; Location=2157..2503; Strand=-
  SCN-specific regions: Sequence locations=1-21,57-347
atggacnatcttttgggttagaaaaataaaaaattgaatttttataaatattttaagaattcaaatacactttggactcggacttttctgctgattttgataatttgtttccatttgtttctctgaaggaatttacagacgaaattgaggcaaactttgggcccaatttcaaatttgaacgttccgctctttctgttgaggaataataatgatcagttgttaccattttgataaactaatgacttttttccattttgtttccgttttttaaattttttattcaattaacacttaaacatgttctcattttcttgttaatttccgctaattgaaattgaccaaataaa

SEQ ID NO: 69080 - DNA, 117 bp, Heterodera glycines
  Genomic contig location: Contig_ID=SeqID_40834; Location=1035..1151; Strand=-
  SCN-specific regions: Sequence locations=1-117
atgctgtttgcgggtgttaattgttctaccaatattcgttttgcaacattgtgtgtggaagtgtcgccctgtgtgcataatgatgcagggaacgaaggaagtcctctagttatgaag

SEQ ID NO: 69081 - DNA, 496 bp, Heterodera glycines
  Genomic contig location: Contig_ID=SeqID_40835; Location=242..737; Strand=+
  SCN-specific regions: Sequence locations=1-103,125-496
atgtatgttaaaagtatcaggtaaactagaaaagtaccgaaatttttgcggaaattatttcttttatgactccaaaataagtgtattaatattgaacgctcttaaaatgttcgaaatcccttgaactttttctatcggttcatgcattttttgcttaaggaattcgattttcgcttgctccttttaggtatttgtatagaatggtcaatttttttaattacctctcttttgggttcgttttttacaatttttctttttgtatattatcgtatcaaaattacagtgcaattcgtgtgctgctggaaaagtcgcccagcttgctgcatgaacgggacccgacaaacggaaacacggtaaaaacgaaatcgcaaaaaaaaaaaaatttcaggttgccttaaaaattttgatttttttttcggtcccattttggcattcttcatttaaaccaatttattcttcaactgtgtgcttttttgaccaaaattatttgatttag

SEQ ID NO: 69082 - DNA, 743 bp, Heterodera glycines
  Genomic contig location: Contig_ID=SeqID_40836; Location=607..1349; Strand=-
  SCN-specific regions: Sequence locations=1-433,455-586,613-702,725-743
agaattaaagtataggctatagggaagtattgcggtcgtcaaaggtctccccataaatctgggcgcatcggagcgggccttctgccccgaaaacaaaaaaatcgattttttcaagggtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatcgggaagctattcccgaaggattcggtctccccataaatctgggcgcatcggttcagggggactgccccgaaaaccccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaa

SEQ ID NO: 69083 - DNA, 567 bp, Heterodera glycines
  misc_feature (567)..(567): n is a, c, g, or t
  Genomic contig location: Contig_ID=SeqID_40837; Location=191..757; Strand=-
  SCN-specific regions: Sequence locations=1-567
gatttacgaaatttcattccaaatcgttcacgcaaacatcgcgtgctgtggtctagcggtttcggcacgcataaatcggcgtcatcttgatggcatcaatccggaagacctcaagctgggctcacttgtgacggtggttgttgccaacattccacaggactcacttgtatcaatgggatacattctgcctgattcttctccgttcaaactgggaacggaaagaagagccgaaacacctgaatttttcggtgcagttgcgtgcattcgtcctcatctgttggagtggccaaatctgaatgcaaacatgacgcccaaggtttatccatgctccgcggagcttactaaacatcatgttgtggcgatggagcatgttgttggagcagctctccagattgagatggagcgagaggttgacatgatgattgaagcacgctttgaaggaagggctcggaagttcgatggtgctgattgtctgattgtcttgggttcgagatcgaagaaagaagtgaatgagttggccaaggtctgggagccggagtcccaagtgaaggtcttcaaagaaattgn

SEQ ID NO: 69084 - DNA, 982 bp, Heterodera glycines
  Genomic contig location: Contig_ID=SeqID_40838; Location=190..1171; Strand=+
  SCN-specific regions: Sequence locations=1-355,378-982
atgcacgcgttttgcgctcgagctatttatcatcgggcttgtcaatccaaagcgaaacaacaaagatggtgttttgaacgaataaagggcataggttattttgaagaagagtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataatcttcacgattcaaaccaattttcgttgctctaattaaccgcgataaaaacatccgaatcaattaaatagcttctgagatattaaggtttatcataaaatttcatttaaaaataaaccctcaattattggtatgaacgctactttccaaacatgcacgcgttttgcgctcgagctatttatcatcgggcttgtcaatccaaagcgaaacaacaaagatgctgttttgaacgaataaagggcatactttattttgaagaagtgtccaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaatccaaagcgaaacaacaaagatggtgttttgaacgaataaagggcataggttattttgaaaaagtgcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataatcttcgcgattcaaaccaattttcgttgctctaattaacctcgatagaaacattcgaatcaa

SEQ ID NO: 69085 - DNA, 737 bp, Heterodera glycines
  Genomic contig location: Contig_ID=SeqID_40839; Location=89..825; Strand=+
  SCN-specific regions: Sequence locations=1-89,111-160,184-282,304 -679,701-737
gccgaaatctctgtggtgaccagtggcagtagcaccagaaaagaaaacgcggaggaggtggaaaaggaggacaatgatttgcgaattttgcatcaaaaaagcaaggagaaagcacttgtgacggaaggaacggaaaacaatgttcgacaattttctacccaattaaaatttaaaaaaaaaattgccccaaaggcgtctcctgtcgtcgtggtcagctctcccgcttcaacgccgcaatcgcccatcaacaacaacaacaacaatgtactcactcattaacttaaattgttttacaaattgttcctcacattcaggcatcatcgcatgccatcgccggcatgccaattccaactattccatcatcgccatcaacagcagtcattaaaaaaccgctcatacagaatcatcagcaacatacgtcaccgcccccgcttatggccattactgtgccgccgccttcgcttcatgtgcctccaccgtcgttggcgttgactgcggtgccaccgcctccgctcatcatgccgtcgcagttggcgatggccgccaccaccacaaatgcctccgttgctggcggtgctgctgccatccaaaaacatggcggcccacaacagcaacaaatgcacacgcattcaccaacggcggcggcggttgatcggccaattggtagcggaattctacacagaattcaatgtgaaccaagtagtgtgtgtgatcgtcgatcacttcgtattaattag

SEQ ID NO: 69086 - DNA, 265 bp, Heterodera glycines
  Genomic contig location: Contig_ID=SeqID_8745; Location=615..879; Strand=-
  SCN-specific regions: Sequence locations=1-265
ggaatatgcgctagcgacttttttggatgtgcgattcaaggacaaagtgctgactgaaaattccgcaacttttcgcgctcgagtcactgtctggatcaaaaatgagttgaaggaatgggaaattgataatgacctcgatggactacaacaaaatgaatttgttcgtcctgttatgtcgccccaacccgaaaatccgccggctaaacgacgaatgtcattttttgaacgtctgaaacacattacaggcgcaaacacagtgaacagg

SEQ ID NO: 69087 - DNA, 1135 bp, Heterodera glycines
  Genomic contig location: Contig_ID=SeqID_8746; Location=129..1263; Strand=-
  SCN-specific regions: Sequence locations=31-46,136-136,267-287,310 -342,371-371,399-623,645-1135
atgagttctatatggcaaattggtctatttaaaaaaaacgtccaagactacagcaatttgtctcgagtgtcaagcaaatgaaaagcctaaatttgaatacacgcttgccaaaggatcacttaaaagtttgcaagtccatcttcacgccattcacgaaaactccgaatttgctgaaaagctgaatgctgttgaatcgaaagccgaaaaggacaaacaaaaacaaaagacaatctcagactttcagtcatccaccggaccgactctttcactgtaattcaaccattttctttaaatatttaatttttatttcagctcaactctcctttgataagaaaattcttcattttttggtgacaaaaaacatttccttcggcgctgtggatgaccaaacatttcattctttgtttccccatcaaaaagtgaagagcgaatggttttataggtaattttcaattaaacgaaacttaatttttaaactctaagaaaaactgccttgccgattgtttaccaacgtgtcagacaaaaattaatgatgaattaaaagaatgcgcatttattactctgacgtctgattgttggagcggaagcacttgcaaccttttgtggtacaatttacgtttttctttttaattatgattggtttaattacagcttaaccgcgcactcaatttcaaaatggaagtcgttatcacgtgttttggcaatcacggaattttcggaatcacacacagggaaaaacatcgcactcaaaattgaggatttactgctcaaatggggcattcctaaggaatgtgttcatataatcatgtcagattcggcagcaaatatgaaaagggtgataaatttatttatttttctttccatttgtttttatttgcaggctttcgtcgagagggatgaaaatgaaaatcgcattttgccaatcccgaacgggccttgcgctgctcatttattgaatttggctgtacaggaggcgttcaagagagatgaatcaatcagcagtttattggccaaaactcgtcatattgttggccgtttcaaacacagtaacactgccttcagcgaattgaaaaaaattcaaaaattactcgatgccccttctcatactcttttgcaggttaaagttaaatactaa

SEQ ID NO: 69088 - DNA, 1289 bp, Heterodera glycines
  Genomic contig location: Contig_ID=SeqID_8746; Location=2330..3618; Strand=+
  SCN-specific regions: Sequence locations=1-297,319-647,676-904,926 -1131,1153-1175,1197-1210,1286-1289
atgcgaagtgaacaattaaaatccggtaattatattgaatttgccaattccaaggacacttcgcgggacatgcaacattctgatcgcaatggaaagtgccttcgcactgattctcgacctcggcttttatgccagctttttcgtccttttgtccggcaggacattcgtccgttacgagtactgcttctgggccctgctgttgccggctgtgttcggcgacatggcccaacttacgatggtgttgaccggcgtggaccgactttgttgtgtgatgttcccaatttggtaaaattattaaatttgaaaatggtaatttatttgtccgttttttttattaaggtacaaaaaacggaatgccaagtgctatttggcattcgtttggacacttctctgctgctacgccacctatcagttcataatcgattacatcgactatcagaacagcaaggatttgtaaggatcactcgtttaaatgaatttggcctttttcgattagcatggtctcctgttccaccaacgaaatgggaaacggcggcatgggaagtctaatgagagtcaacggactgacactgagcggcactctgatggctgtgtattcgctgtgttggttcattgtgttcagaatcagtgccgtctcagaaagtgacaaaaattattaatattttaaatatttaacaaattgctcagatgtaaactcggacaatcgcacactgatcaaatccctcgggtttatcatctctctcaatttggcatgcgttttcataaagtgcggcgtcaatttgcttttccaaactgttttccaagtgaatgtgttcaccaaatcggctttttccattgctttttccttcctcaccataactgtgtacagtgcaaatgcgccggttctgttcgttgtcaggtggtcatttaattaattaaatttaatgccaattaattagcaatttgtaccgtgatcactttatccgacacttcccgtggctttcgaaattggttcgaagcaatgaaaaagtttcttcaatttgtacttcgaccacaacaatcattgtccagccgaagaatggcaccccaaacggtgccaatcgcttttacaatgaaaaattggcatctgattgaactcaaaaaagcgactcaaattttttgattgattttgtaaaaatgatttaaatagtttgtttttctgatcaatataaagctgtttatttggtggatctttatttaaatattttacatattattttgtttttattcattttatgtaaatttgggtaaatattttttattttttgaga

SEQ ID NO: 69089 - DNA, 54 bp, Heterodera glycines; identical to SEQ ID NO: 53113
  Genomic contig location: Contig_ID=SeqID_40842; Location=200..253; Strand=-
  SCN-specific regions: Sequence locations=1-54

SEQ ID NO: 69090 - DNA, 573 bp, Heterodera glycines
  Genomic contig location: Contig_ID=SeqID_40844; Location=37..609; Strand=-
  SCN-specific regions: Sequence locations=1-233,257-549,571-573
atgaatttagaccgagtatttgtgaatgatagaagtaatgataatgaacagaatttggaatatgcatatgtttttgataatgattatgaagtagttgagagcagttatgatatattggaagagcataattatagtaaacggtcaagaatggatgttgttggtggcgaaagccaggtatctctgaattcagatattggtattgctggaccgtcacgtatgagtgatagtcaatttgaagaaaggagaagaactgagtatttgaaaagaaagagagaacgtgagagaatgagaagagaaaacgaatcacaaaaccagagagttttgcgtttagaacagatgcgagatagaaataatagtcaacgaacggaagaaaatgcaaatgaacgtcgtttgcgtttagaacagatgagaaatagaaataatagtcaaagatcggaagagaatgcatatgagagacagttacgtctagaacagcaaagaattagacagagagtgattagacaaggtgaaattaatgtttatgcagcagggtcttatgtgaatgctcatgaacatggacttggtcttatgaat

SEQ ID NO: 69091 - DNA, 438 bp, Heterodera glycines
  Genomic contig location: Contig_ID=SeqID_40848; Location=136..573; Strand=-
  SCN-specific regions: Sequence locations=1-438
aaaatggtgtaagtaaaaatcgtaattactctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcttccattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgc

SEQ ID NO: 69092 - DNA, 270 bp, Heterodera glycines
  Genomic contig location: Contig_ID=SeqID_40848; Location=677..946; Strand=-
  SCN-specific regions: Sequence locations=1-270
tatacatcccattatgaacgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagcttctcaaaca

SEQ ID NO: 69093 - DNA, 361 bp, Heterodera glycines
  Genomic contig location: Contig_ID=SeqID_40849; Location=202..562; Strand=-
  SCN-specific regions: Sequence locations=1-103,125-237,261-275,297-361
atgtatgttaaaagtatcaggtaaacttgaaaagtaccgaaatttttgcggaaattatttcttttatgactccaaaataagtctattaatattgaacgctcttaaaatgttcgaaatcccttgaactatttctatcgtttcatgcattttttgcttaagtaattcgattttcgcttgctccttttaggtatattgtatagaatggtcaatttttttaattacctctcttttgggttcgttttttacaattttcctttttgtatattatcgtatcaaaattcaaaattacagtgcaattcgtgtgctgctggaaaagtcgcccagcttgctgcatgaacgggacccgacaaacggaaacacg

SEQ ID NO: 69094 - DNA, 892 bp, Heterodera glycines
  Genomic contig location: Contig_ID=SeqID_8747; Location=360..1251; Strand=+
  SCN-specific regions: Sequence locations=1-89,111-172,195-475,502 -559,581-606,644-661,683-804,833-836,870-892
atgccaattatttttaattttcattttctattattcaattggatacattttttagcagaggaaaagcagcagaaggaaagtgttggtcaacagaacaaaaacaccgaacagaaattggatggaaaatatgccgtggtggacaaaaacaatgttttgggtgggcacaattggcaaattatttaaaattaaaaattggcgttataaaaaaatgcattttttgagaggggacaaaaccctcgtattatatcgggattttatacatatttggtacatatttcggacttttttcttacatattttcattttttttacatatttgaggattttttacggaaatttttggaaattctcaaaaaaaaatccaaaaatttcggcaaatttttcatttttttacatagctattctgagaatttttgaaaatttttagaaatttcttgtgaaaaaattaaaaaatctttttttaaatgtacccctccaaaaataatttttcaaatgttaaaaggtgattttaaacattttggtcatttttatggcattttgtgcctatttaacactttatgaaaaatgtacatattttttacagccctaattataaatatttaggtgttaaaaaattaatttttctttttaaaatgtatttattgctaatttagttgctttagtgacgtcatcgggcgaccattcgccgtcggcggttgtctcagcgaaagttgcaaaggtgggaaggaaaccttaattatttcacaaatgccatttaatttcaggaagtgcctaattcgcagcaacaaaatgattgggatgccaaagtttgccacaaagacatcgaaatcattggggaaaagcaattgacgatcaattgcaagggcaacagatttggtatttaatataaaaa

SEQ ID NO: 69095 - DNA, 706 bp, Heterodera glycines
  Genomic contig location: Contig_ID=SeqID_8747; Location=1357..2062; Strand=+
  SCN-specific regions: Sequence locations=1-49,79-125,152-381,424-706
atgaaagtgttcaaattggaaaggtgttcattttgatgatttcttagcgttttatttataattttgaatttattttaacagttttgctgcgattggattcgccacgaaggaagtgccattggacgggtcaattggtcaaattttgaacagttacgggtaccgaagcgatggctcatttggctgtaatggcatcaatcggccgtgcaaaatgccaatgtcattatttggttcgtcattttcccccgtggcaatgcaatcggcggacgtggaaatggcatacaaatcatcggagttttccactggtgacgtggtcggatgtggcattttcttggatactcgactgatcttcttgacgaagaatggccaacgaatgggtgggccaattaaaatgaaaaaacaaattaattaaaattttatttttaagattattcctcttttttcattcaaactcccgccaattctctcaattctctgtttccgtgcgtttctttgtgggtgggcgacaaaatcgaggcgaactttgggccaaatttcaaattcaatttggcgactctctgaagaaagcaaaaagaatggaagaaggagaaattcatctaattgctgtcatttttactttatttatgtttattttttaaattctttttttcaattttcattttggctttataatactaattactattttatttgctattaatttcgttta

SEQ ID NO: 69096 - DNA, 153 bp, Heterodera glycines
  Genomic contig location: Contig_ID=SeqID_8747; Location=2448..2600; Strand=+
  SCN-specific regions: Sequence locations=1-67,89-90,131-153
atggaattggtattgaaaatcaccaaactggagcttaaaaatgtgagtgttatttaaagtgtcattttttgaaaattaaatgggaattgctaattaattttgaaaaaaaataaattttttaatattaaatgattttagaagggactccaataa

SEQ ID NO: 69097 - DNA, 594 bp, Heterodera glycines
  Genomic contig location: Contig_ID=SeqID_8747; Location=2738..3331; Strand=-
  SCN-specific regions: Sequence locations=1-262,287-594
atggtgatcagttggacaattttcttcttcgcacttcgccgacaattctcactgatctcaatcagttgaattcaatcgattcatatggtctgttgcccgaggcaattgcgattggtgacgatttggcacacaccgagaaaagatggccaacccaagcgattgtgttgcacacttttgaacgacaagtgtacttcgattgggtcaacaatttcaagaaggtatggtcccatatttttttgcatattactgattttgactacttctatttttattttccaaattatttagcaatttctccgtgccaatgccatttcttccgtcagttaccaaattcattttactgttcatgcgccatcaattgtgacatttgaattggtgaacgaatggacaaaggaaaagctgacattggccaaagcaaaggaattggacaaccgatggataatgcagcgatgcaaaattggggaggccgtgacggttcagcagcagaagaacgatgaaaattgggataacaattgtaacaatgtgttctttttgcttttagtggcactaattgcatcgggatcttcggaaaaatccttaacaaaaatgcaataa

SEQ ID NO: 69098 - DNA, 723 bp, Heterodera glycines
  Genomic contig location: Contig_ID=SeqID_40852; Location=61..783; Strand=+
  SCN-specific regions: Sequence locations=1-459,485-723
agaaaattaagcaaaaaggaagaaaatactcaacaaaagaatggaataaaattgaaagaaaaatagcgaagaaattggggacaaatcgaacgaaaatttataaatggatcaaagaattaggacttcaacaacaaatacagaaaagttacaattcaaaaagtgatgaagaaaaaatagaaattgtgcaaaaatttattgaactgacaaaagaatataagcaaaaaagaaaatattcgccaaaagaatggaaacaaaattatgccgaaatttgtaaggaaattggagttagccatttcataattaacaaatggaagaaacaatttggcattcgatatatgagaataacggagaaagaaaaaatggaaaaaatgaaaatttattcgcaaataaaaagagaaaatccaaaaatgagtgataatgcaattgcgaaaactgtgaacacttctcatcagaatatttttaattggaagaagcaatttggagaagaaatgtttcagagaacaacagaagaagaagcgtgaagtgccttgtgcttgcttttcaatttgaaaatatttttttggatatctttttcaattttagtttcagtatttactgaattagtaaccccctagcttctaattcagtaaaaacggtatttgggctgggattttttatgccataaaaatgaccttttttggcattttatattttctttaccattattttaattgaatttaatta

SEQ ID NO: 69099 - DNA, 469 bp, Heterodera glycines
  Genomic contig location: Contig_ID=SeqID_40853; Location=198..666; Strand=+
  SCN-specific regions: Sequence locations=1-469
gtttcaaatatcgtaagattgtttgatagggccagacaagagaaggcaactgttggtaccaagtttgcggtaaaaaaatgaaaaaaaagagatagccattttttggtcaagaattttttttgtttgcgtttcaaatatcgtaagattgtttgatagggccagacaagagaaggcaactgttggtaccaagtttgcagtaaaaaaatgacaaaaaagagatagccattttttggtcaagaattttttttgtttgcgtttcaaatatcgtaagattgtttgatagggccagacaagaaaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaa

SEQ ID NO: 69100 - DNA, 75 bp, Heterodera glycines; identical to SEQ ID NO: 54636
  Genomic contig location: Contig_ID=SeqID_40855; Location=684..758; Strand=-
  SCN-specific regions: Sequence locations=1-75

SEQ ID NO: 69101 - DNA, 940 bp, Heterodera glycines
  misc_feature (33)..(33): n is a, c, g, or t
  misc_feature (55)..(55): n is a, c, g, or t
  Genomic contig location: Contig_ID=SeqID_40856; Location=232..1171; Strand=-
  SCN-specific regions: Sequence locations=1-299,321-527,557-598,636-940
gcattttcaaatgcttcttcacgagtgacttcngtcattatcttgacgcttcgtnccactttggttggctcgtttttgccatttgaactgatcaacgaagcgactggcgaacaattggcactggaacaatatgacacagatgaattgagctcctccgttgtccaattggatgggtttgggaaaattgggaaaatgagtggaaagaattgtgtgctgctcgaccgaaacggatggacatttggatcagagacggcggatttgacgaggggtgaacaacaatttaattaaaatgatcaatgcttttttacaggagcaaaaaagttatgatcaaaaatgctcgaaaagcatggttttttgggattctcaggccattaaccttttttggaagttaacaaaatttttaatggttttttgtctaatgtcccagcatctttgaaattgacaggattgtgtggcactaaaaatcaaggattgttaattggttggactcataaaatgccattggaaccataaaaattgaatgagcttaaaatacaatttaaatctttatttttcagtcttctcgacaccgctactcccgggtcaagtggtcagcaacaatgaagcagcagaaatgaattaattaattaattgatggttgattgatgcgttttatgtggcccaaatgatggttgctggcactatgccattccaacaatattgtattgtgtatagttagttagctaatttatttgtattgtagttgacctttgcttgcttaccgtaaattcgtccatttccattgtattttatgtgtatgtacatttaattaattcattgtgaataatcgttgataaaaatggctaatgataaaactgacatgaaattcacgacttaaaaaaaatggatttcatccatattttggtgatactgaataattggtgtcccggtgaaaaataaa

SEQ ID NO: 69102 - DNA, 816 bp, Heterodera glycines
  Genomic contig location: Contig_ID=SeqID_8748; Location=81..896; Strand=-
  SCN-specific regions: Sequence locations=1-600,639-653,675-780,806-816
atgcagtggatcaaattcaactgcacgctttgcccaattggacttcagtgtttctatccgcgcaagtacgcgaagcttgtgctgtgtgcgcatcccagcgtccgcaacatcacggactttttgagcaccggtcagcttgacgaagctgcaacaacaacaacaacatcagtacttccgacaactgcggaaacggcggcggcggcagaatgtgcacctccgcccgcgcatttgaccgcgtggatcgcggtgtgcacagcgctgatggcgcttttggtcatcgcgcaggtcgttaattttgggcatttatccaccaaatccatattcctcaatttagcttgtgcgcgccggattcaaagtgcgcaaatttttgaaggaccgcgcctacaaaaaggggatgctgagccgacatcgtcagcgtgagtttctcactatttgaattacatttttagcaaattgtaattaacaatttgtacaggaatgagtgccgcccgtcgcaactgccaaccggtgagcgcgccgactccgcttattttgccggcaatgttggccggcgtttctctgcgcccgacgggcgtcaatttgacggtggaccgggtgggcaaatttaattaaattaaaatctttatatattttaatttctcactcattaaaattacaatttaaatttaaaagcagcgaggcagcgccgcgcggatggtgcaattgaggagggcgaagagcccgtctacgatgaggtgccgcttgacagcgacatcgtggtcgagatgcgcgatgaaatggggaggaggatgaggaagaagatgacaatgatttttg

SEQ ID NO: 69103 - DNA, 875 bp, Heterodera glycines
  Genomic contig location: Contig_ID=SeqID_40863; Location=155..1029; Strand=+
  SCN-specific regions: Sequence locations=1-562,584-616,666-813,835-875
atgcgattgttttcaaattttgttataaaatgccgtacctatcaatatgagaggcccgacatgaaatatggtctaccatctcctcaatataaacacgtatgcatatactacagtatgattagtaaatagcctttttaatgagatccctaaaatggccggtatgaactttatagctttttttgacaaatcccagccataattaatcatttttaaaataccaatcctctaatacaatagtcaaaattccggccctgatgaagtgattttcaaaaaaaacacaaagaaatttattcaactttaatccatcaccatgctaggtgatcgtgaccggtgcagaggaacacggactgcccaccaactacattcagtggttgcgcgaaaattttgaggacaatggctatgacgggcctgtggaagtgaatctgaaggcacttgagacaatgccgaggccgactaagaaaagaaagctaagccacaaaaaagaaggggaagctgaaagctcgaacatggcgctgaacaactgatggatgagtgagtgagtagccgtggagttggctttgtgttgatcagcaaagaaatacagaaaattagcaaccaaattaatcagcagaatgacaaaatattttttatttttttgcaattattagataaattttcaatttttagcaataattctaaaaagcaatatattttttttgtgtgttaatttctaatcccgctaaaggattgggattcaaattttagcggaacgggattttgtgtgattaatcacaaaaaatgagggattgcggactggggatcgagcgaaacccgcttttaaaatatattttctaatctttcatttagttttttatattaatctatcatgaactata

SEQ ID NO: 69104 - DNA, 56 bp, Heterodera glycines
  Genomic contig location: Contig_ID=SeqID_40864; Location=37..92; Strand=+
  SCN-specific regions: Sequence locations=1-56
tgccctaccgggaccggaacctgagcttttcaaaatccgggaccgggaaccgggac

SEQ ID NO: 69105 - DNA, 843 bp, Heterodera glycines
  Genomic contig location: Contig_ID=SeqID_40866; Location=702..1544; Strand=+
  SCN-specific regions: Sequence locations=1-54,76-142,180-353,400 -436,458-501,534-598,620-804,826-843
atgattggatttcggcttccacaaaacggcggaaattgtgacggagggtgggaattttcaaaacaaaacataaaattgttaaattaaaacatttttgaatacctgttgagacttaaactttattcatattaatatatctgtctaattaattaattatatcaattaattcaatgaattaaatccaatccgattacaagcgaatgcgcagtataaaagaccaatgatgatcatagaaatagctcaactcattggtgtggcataaactgcgcacagtgcaaatgccaacaaacaacagcacagtttttggcaccattatgctggtgccatcaattgttccgcttcattagcttaggataaaattaatttattaaaataattgtcataaattaaataattattgcctatcgaattattggggaaaatcaacgtcaattttcaattgtctttgatggaaaaataattggcgtgcgttttagctattttgactaaatatgatggaactattaaattaacaaaattattatttaaattttcagaaagttttttttgcttcctgtttatgagagcgccatgcaaagagcctttttatgtcatcttcgtcaaaatggggatatatttttaaaagattatgccgaactttggctgctcgagtttgacatggtgcggataatgaaacagcagggggagataaagctgttagtcagtcgcagctgcaactgcaccatggaagaattggtaatgcaatctttgactaattggacgtgctttggcatgactaatggcaattttccaaacaaaatgatatttgtttgtttttatgtatttaaagctgcatgtatttaa

SEQ ID NO: 69106 - DNA, 366 bp, Heterodera glycines
  Genomic contig location: Contig_ID=SeqID_40867; Location=597..962; Strand=+
  SCN-specific regions: Sequence locations=1-366
tatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccatttatgagcgcagaaaattatcagagtgccgaaaatcgcatgtgatctaa

SEQ ID NO: 69107 - DNA, 235 bp, Heterodera glycines
  Genomic contig location: Contig_ID=SeqID_8751; Location=2011..2245; Strand=-
  SCN-specific regions: Sequence locations=1-149,187-235
ggaaataaattcaaggacattattgaaaaaaaattcagaaaaaaagaaaacggtgatcactaacagtttaaatgatagggaggtgattttgtggcgatcagaggtcatttgaagcccaaagattgaattattctgtggtgacatagatggaaaaataaatcccataaaataaatatgtggtaatatcccatactctgtataacttggtcctatttcctatggtatttctttagtg

SEQ ID NO: 69108 - DNA, 309 bp, Heterodera glycines
  Genomic contig location: Contig_ID=SeqID_40874; Location=1..309; Strand=-
  SCN-specific regions: Sequence locations=1-1,24-159,189-309
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagagccaggttcgatgaagttttggtaagcc

SEQ ID NO: 69109 - DNA, 1021 bp, Heterodera glycines
  misc_feature (51)..(51): n is a, c, g, or t
  Genomic contig location: Contig_ID=SeqID_40877; Location=386..1406; Strand=-
  SCN-specific regions: Sequence locations=1-99,131-437,460-761,820-1021
atgaaattagaattaacaaacaaaaactatgacgaatattttgggcatttntaagcaatgcgtttatttctttgttattaccctgctgatgtgaagtagttattttatattaatttttttagaataattactctcaccgaaattatttttccaaaattgctcagaagcttatgaatgaaattgcagaaaaaatcaaagaacaacagcacaaccagcagatgaagcaacaaaagaaacagaaactgaagcaaaagcggacgacgaaaggacaaatgggaggtaaacaaataaatgaataatgacctttgtttggggcaaaagagtagaaggaaatgaaaattgatcaccaaggctgcaaaaaatatgcacgaaaaatgacctaaatatgcaaataaaattgccaaatatgcacaaaaaaacttgaaaattaggggtacaaattaattaaaaaattttattcctcataaattttatcggttgtttttgtaattgcaaatcaaaaatttctcaagcttttcggcagtgaagctcactgttgacccactcgcgcatccattcaaatttggatttaattttaggcataatcaaaagagatattcaaatcggaaaatatttgacgaaaaatggcaaaatatacatgaaatatgcataaaaacccaaaatatgcaaataaaagtaccgatatttgcatgttttttgcagccctgttgatcactttcttactatgaatgcactcaactcaacggcactgaaaggggtgcaattaaaaatgaaaatttaataaatttatcatattcaaattcattttttcatttttttgatttgctcttttccactttaaaatttgctttttgtcaagaattttgattgaattttggtcatttgattttcctaaacctcccttcgtttgatgaaatagatatgcttgttaagctacttttcgagttttatgtttgttttgattctagtgcagaacacgcattggctttctcccaaaattctttgagaagaattcaataaa

SEQ ID NO: 69110 - DNA, 403 bp, Heterodera glycines
  Genomic contig location: Contig_ID=SeqID_40879; Location=128..530; Strand=+
  SCN-specific regions: Sequence locations=1-92,201-403
atgaaatcaccaaaagggaaaaataacaccgcacaagcggtcgaggccaatggcaatttgaagcgcaacggtaacagcggagccaatgatgggaagaagctgaatggagaggcaaaagcggagggaaaggtagttgaagccgaagaggaagatgaagaatttgaaggtgaagccgagcagcaggaaggaggcggagaaggcgtaaagagcgatcagaacattgcaatgggaatggagtgatctgagggagggaaaaggaaaggaactcggcgccgacgggactcgaacacgcggccaaccaaaccgaccgcgcaattacgcattattttctcccgtaatttttgtcaacaaatgggaagcttatttcgattattttctgacaaacttctcctaataattgcca

SEQ ID NO: 69111 - DNA, 419 bp, Heterodera glycines
  Genomic contig location: Contig_ID=SeqID_40881; Location=860..1278; Strand=-
  SCN-specific regions: Sequence locations=1-94,217-419
atgtacggcaaaagggcgaacgtcgccaccggcggacgaaacgcgtcatcatcaaccacacaaacagaggaaaagcgtggtaataaagcagcggaaattaacaattttattagaaattttattatttaaagttttgaatttagtttttttttcattttatttccgaacatttaaaattatttaaaaattaattctgattaaaatatattattaatagggctcacatttatagttgctaaaaagtgccaaaataattaatttttagtttctaaaaaacccacaaaatagttgctaaaaatgggaaaatagttgctaaaaactttcaaatttaggggtgtaaaatgacaaattttatccaaaaaggtaagaaaattaaaccaataatttttaaaatcaaaaattctcgtcaaaaaaataaa

SEQ ID NO: 69112 - DNA, 664 bp, Heterodera glycines
  Genomic contig location: Contig_ID=SeqID_8753; Location=110..773; Strand=-
  SCN-specific regions: Sequence locations=1-293,315-664
atgacgcctccgccttttactgcccttcaatttgctctgtttggctatatgattcttctcaatgccttcgtcccgtccgacacgaatttgtcatctaaacccaaatcggatgctgttgaacaagttgaccatgaacatgaccatcggaacagtaagaacgagactgatcaagaagtgaacaaagagcagcagttcaatgatcgtgatttggaccatgaaaatgacgaagacaatgatcgggagaagaacaaaaaggaaaaagatagccacgaaaatgggaatggtcaaacatcggatgaagaacaaaatggagaaaaagatggaaagagtaaaatggatgcataatgtaattaactaatcattaaatcatttaattaaaggctacaaaaatcgtcactccaaaaaatatctgactgaacggcagaggattctcgatcgattggaaaaactggataaatcaattgtaaaacaaccagctgaacacaacgagaaccgatcaaattttgctaatcatggaagccatcagaagacgactgatcaagagggaaataatgaggaacacgatgatcagaatgagaaaagtgatcaggaaaaaaagcaaaatgatgaagacgatgttgaacagaaggaaaaaaaggggggagagaaaagtaattcccattaa

SEQ ID NO: 69113 - DNA, 830 bp, Heterodera glycines
  Genomic contig location: Contig_ID=SeqID_40882; Location=694..1523; Strand=+
  SCN-specific regions: Sequence locations=1-763,796-830
atgggagggctaaactatgcactgccaatcatcagtgacgggtaaggaaatgtgtcatcatcagatacaaaaaaaggcttacaacctccccccctgccgccgtatcaattccccgtgaaatatttaaaaaaattttcaaaccaaaattttctttaaataacttttcattttttttgaaaaattctttctttaaattttcttgcaattttccgaggggaaacaatacggagggatgtggaaacgaacttccccgttccgatttatttaaaaggtttttttcgttactgtcatttcatgttgcgcatttttcagcatgctcatggagacattggtgatcggttttgccgtcaaccaccccgccggtggtttcggcatggattcggaccagaaaaatggcaacggaagcaatggcacaagcgacacgggcagtgacgcggcgagtgacaatggcaacggcgccaacggacacaaaccgcagaaaaagccgcaagtcttcgagaagagcgtcccgtcagtggtcggggtaagaagtgaacacagtcaagggacgacggagcaggacaaaacgtcgtcgccgaaacgtcgtcagccaaaaaggccgaaaaatttactaacttagaaaaattttcaaagaaaaaatttttagaatttttcttctgaaaaatttctaagttagtaaatttcacggaattttccggcgctttttggcatgacgaatttttgagaaatttaagtgatgttgttttttgagggggcaccaataatgaaaaacaaaaatgtttcccttaaaatttcgactgaggatatcgagttgggtttttgcttaaaaa

SEQ ID NO: 69114 - DNA, 79 bp, Heterodera glycines
  Genomic contig location: Contig_ID=SeqID_40883; Location=210..288; Strand=-
  SCN-specific regions: Sequence locations=1-7,29-79
cggacaaatgatgaaaatgattaaatatccattcaattggttcccaacgaagagtaaccagaagactaaaatcgcaaaa

SEQ ID NO: 69115 - DNA, 800 bp, Heterodera glycines
  Genomic contig location: Contig_ID=SeqID_40883; Location=494..1293; Strand=-
  SCN-specific regions: Sequence locations=1-101,134-196,218-530,552 -576,598-604,626-634,658-673,701-731,753-800
  Gene Ontology: Mol. function=zinc ion binding; Cellular component =nucleus; Biological process=regulation of transcription, DNA -dependent
catggacaagcagcgaacccgcagcagttcaagtgcgaattgtgctcgaaaactttcagtgcccattacaatttgacacggcacatgccggtgattgatcgatttaatttaattttatcatttaaatttaaatgcttttcaggtccataccggtgccagaccgtttcaatgcaaagtgccgttttattcacttatgaaaaattggcaaaatttaaggtttgcggaaaggcctttcgccaggcttcgacactttgtcgacacaaaatcattcacacggaggacaaaccgcacagggtaaaaaaaaatgaaatgagaaaagtcaaattaatttaaatttggtttaatcggcgccttttcagtgcaaaatttgtgggaaatgcttcaacaggtaaatcagagattaaaaaaagaagtgaaatgcttatttacacttgcttcattttacgccaaatgcttaattaaggtcctcaactctaaatacgcatttgcggattcacaccggtaattaacttaaatgccaatgattaatgtttttaattttatttaatttagggttcaagccgtacacatggtgtgttttgtttattgattatatgtttccattaaattatttgaaagatggataattaaatagcaaactgaaaagtttctttgtttaccatttcatttattatttttatctttcccattcattgctcagcgaatactgtggaaaaggcttccatcagaacggcaattacaaaaatcacaaattgacacatcaacaggagaagcggtacaaatgcgaagtgtgcgcaaag

SEQ ID NO: 69116 - DNA, 196 bp, Heterodera glycines
  Genomic contig location: Contig_ID=SeqID_40885; Location=27..222; Strand=+
  SCN-specific regions: Sequence locations=1-196
atgagcgcaaacgtaccgaccgatatctgcttcagctttaccggcctggtacagcgcggcggccgcaccgggccgcataaggatggctggggcattaccttctatgaagggaacggctgccgcacattcaaggatccgcagccgagcttcaactcgccgatcgcccgcctggtgcaggactacccgatcaagtcct

SEQ ID NO: 69117 - DNA, 1010 bp, Heterodera glycines
  misc_feature (238)..(238): n is a, c, g, or t
  misc_feature (253)..(253): n is a, c, g, or t
  Genomic contig location: Contig_ID=SeqID_40886; Location=1..1010; Strand=-
  SCN-specific regions: Sequence locations=1-192,215-298,324-1010
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaattttttctccatcttcctttttgatactanagcatcagagtgctnaaattaacttgtaaataaattttggtgcgctttagagcactttctgaaaaatatttatgaaataaaaaatcgatttattcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaataatatttaaa

SEQ ID NO: 69118 - DNA, 545 bp, Heterodera glycines
  Genomic contig location: Contig_ID=SeqID_40887; Location=112..656; Strand=-
  SCN-specific regions: Sequence locations=1-96,119-164,188-545
atgcacttctttgaagacgatcaacgggctactgttgctctttcaagagctcgccacgctgtcttcatcattggagacttggtctcaataaatgcaggacaagtgtggaaacgtttcatcgaaatggcgataacaagaacaagcgtagtccgagccgagtatgttttggcacttttgggacgaacactcgtgaggtcgtcgacatgcctatttgattcggccaaaagagaatcggtggaggatgaaggctttcttgaaagttgggcattgaagcatgggttgcgcctggaccgaacgaatgcctttggacaacaacaatcacagcagccgcgagctccctcattccaattccagaatcgccactttcctgcctacagacgacagggccctcagatcaagccggtccatctggcagcggtggtcaacaaagaggtgcgcctactttggcaccacagtatggaagaggtcaaggaagacgtggcccggacaaccagtggatgcactacggcggaaacccgaaacgacagaagggtggcagacgctga

SEQ ID NO: 69119 - DNA, 437 bp, Heterodera glycines
  Genomic contig location: Contig_ID=SeqID_40888; Location=68..504; Strand=-
  SCN-specific regions: Sequence locations=1-437
aaaatggtgtaagtaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctcttcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgc

SEQ ID NO: 69120 - DNA, 372 bp, Heterodera glycines
  Genomic contig location: Contig_ID=SeqID_40888; Location=656..1027; Strand=-
  SCN-specific regions: Sequence locations=1-372
tatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagctctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaa

SEQ ID NO: 69121 - DNA, 799 bp, Heterodera glycines
  Genomic contig location: Contig_ID=SeqID_40889; Location=1224..2022; Strand=-
  SCN-specific regions: Sequence locations=1-772
tgattagaagagtgattagaagaggtcaaaaagtgattagaagtggtacaaaagtgattagaagaggtacaactgtgattaggagtggtacaaaagtgattagaagagtgattagaagaggtacaacagcgattagaagagtgaatagaagaggttcaacagtgattagaagagtgattagaagaggttcaacagtgattagaagtggtacaacagcgattagaagagtgattagaagtggtacaacagtgattagaagaggtacaacagcgattagaagagtgattagaagtggtacaacagtgattagaagaggtacaacagcgattagaagaggtacaacagcgattagaagaggtacaacagagattagaagaggtacaacagtgatcagaagaggtacaacagtgattagaagaggtacaacagtaaatagaagaggtacaacagtgattaggagaggtacaacagtaaatagaagaggtacaacagtgattaaaagaggtacaaaagtgattaaaagaggtacaaaagtgattaaaagaggtacaaaagtgattaaaagaggtacaaaagtgattaaaagaggtacaaaaatgattaaaagaggtacaacagtgattaaaagaggtacaaaaatgattagaagaggtacaacagtgattagaagaggtacaacagtgataaaagaggtacaaaagtgattaaaagaggtacaaaagtgattaaaagaggtacaaaagtgattaaaagaggtacaaaaattgaatgcaatttattataaattttaaaaaataaa

SEQ ID NO: 69122 - DNA, 505 bp, Heterodera glycines
  Genomic contig location: Contig_ID=SeqID_40890; Location=481..985; Strand=-
  SCN-specific regions: Sequence locations=1-1,23-126,155-258,287 -295,317-397,419-505
caaaagttttttacaaccacttattgctaatctaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattcattacccaaaagttttttacaaccacttattgccaatctaatttcttgcagattgaaagccatccattgcctgccggttctcggcacagcaaagcactaatagggtgtttgactcacttcaaaaaataattccatacccaaaagttttttacaaccacttattgccaatctaatttcttgcagatttaaagccatccattgcctgccggttctcggcacagcaaagcactaatacggtgtttgactc

SEQ ID NO: 69123 - DNA, 544 bp, Heterodera glycines
  Genomic contig location: Contig_ID=SeqID_8756; Location=301..844; Strand=+
  SCN-specific regions: Sequence locations=1-198,244-406,431-544
tttattattttgtttttgatatttgtgctatttagcaattccgtgtcggactgtcgaaatgcgcactcccaaaactgcggacataaaattcgggaagagaaagcctattgtttgaccaggcaaacgcaaaacggaaaaggttattaattattgctaaagttacaaatgaattgataaatctttaaatgggtgaattggtaataaaaattaattttaaaaaatattatttagttaattaattaactctaatttctgttaagatgcatttattgtggaaaaaagttgtgtgacaacgcgccaattttaccagcaattccctgaagaattggagaagcatagtgccgacgaagtgccaattggctgtgatgccacttatgacggtgaaaattcaaagatattacaaaaataataatttaaaatgttttaaggctttgtgaattattgcttatgtgacgagcaaatgtgcaacagaaattcgttaagcgaacaagcggaaagaaatgggaaaaggcgagaaatttaaatgaaaatgaaattgaaagaa

SEQ ID NO: 69124 - DNA, 712 bp, Heterodera glycines
  Genomic contig location: Contig_ID=SeqID_8756; Location=914..1625; Strand=+
  SCN-specific regions: Sequence locations=1-108,130-154,176-241,263 -580,607-626,649-712
atgagaaacaaaacgagaacagataaagaagaaaagcacggaaaaagcagtgaagaaaaaaagcgaccattatttgtaccatcagcagcaggtgagaaaacaaaaatgatttaaataataaattaatttgacagatttaacgccaataattaacatgagaccaataaaatcatcagcagaattggctaatcagaaagaaacggggtacttttatcatcaaattaatttaaacgccatttacaatattttttaaagtgttagatcctttggcgacgatccttcgccgcccaattggctctcaaattggccatcttcggatgcccccaattggccgacttccgccgcttctcccattttggtgccggccaccactccgccgtcgaatttaaccgaacaaaatgaccgactcaaaaaatggaagcaaaacagcgaaagggccaaaaggccattcgaaagtgacggaggcgaagagtcatcagacggaaagcggacgattttatccatgggaattggaattgttcacgcaatactcacactttttgcctccctttatctaatgctatgaaagaattttattcgcttaaatatttattttaaataatttatcacataaacaatttattcacttttcaataattttaaataactcaattaaagattgaaattgtttctgactttttttagttttagttttattcgccaaaagtcaata

SEQ ID NO: 69125 - DNA, 581 bp, Heterodera glycines
  Genomic contig location: Contig_ID=SeqID_8756; Location=1786..2366; Strand=-
  SCN-specific regions: Sequence locations=1-109,145-390,412-581
atgcgcgggctccaaataccggcgaatttgcacaatctcagcgaacgctatcaggtaaatcccattcattcattcattattcgtcattcgtttaaattcctccaatttcatttttataatttgattttatttaaattaaatttagttggccgaaaatattcgaacggggcgccaactcgcgccgacttttctgttccatttcattaacatttgcgggtccgtcttcaccccatttgtcgtcttttcatctgtctgatcaccgacccaattttgctgaatttaattgtgttcacttattactccgtcctttctctcagcaacgctttgattgaattgactttaatgaggtcattaaaagtgataatagaataaaactcattatttaaatgcattttaattaattaatttttagacgtcatccaattttgaggaaaaatgcattgaaaattttggcaaaatttcttccaaatcgctgcttctccaataatcgcatcactgacagtggcaaaagtcagaaaatggtccaaagaattgacgggcaaaagcggtgggaaaagcgacagcaaaaaagagacaataaa

SEQ ID NO: 69126 - DNA, 1270 bp, Heterodera glycines
  Genomic contig location: Contig_ID=SeqID_8757; Location=1778..3047; Strand=-
  SCN-specific regions: Sequence locations=1-374,396-656,678-954,989 -1270
  Gene Ontology: Mol. function=structural constituent of bone; Cellular component=collagen type I; Biological process=cuticle biosynthesis (sensu Nematoda)
atgggcatggcattattattttttggtcattcattccacggcactttgtctctaaaggcattccgcgtgaacaccgactcggcatggaacgaactgatggaagtacaaattacggtcactcctccggcaaaaccccgcgagaatcctttcgtctccatcttccgctccaagcggcagctgcctggacattgtcaatgtgccggcgtccaacagccccaatgtccgcctggcccaccgggacccgcgggggcacccggacagcccggataccctggacaagccggagagccaggacagccgggagtgcctggacagcccggttggataatatatattaagtttttatgtttttttttactttttcctctaaaacattttcttcttctcttaatttcggtaccaaaaatcacttagctaccaaaaaaagttgtctaatttctaaataaccatcgccattacatacagtagaaaaaagagaatattttgcaacgaagaaaaaagattatctgatcatcaaaggagcgccatgcccggatgttcctcacgtctgccagcattgcccagctgggccgcctggaaagcccggagatcaaggacctgccggccaagccggtcaacctggcaggccaggccagcctggacagagcggaggagtgggcccacccggacctcctggcccgcaaggacaagccggaagcccaggacgacctgggggatcgggacaaccaggacaacccggaccaaaatggcgttgtgtagtaagtggcattttgttttcacttttggcaccgcatgaaccatttaaccctttgcagtaagaccgttcctggaccgaagggacaacccgggccaacctggagcaccgggacagcctggcgcacctggacgacctgggaagcctggagaccaaggacaacccggagccccggggcacccaggacagccaggccaacccggagcaccgggacagcctggtcatcctggcgctgctggagcacccggcaaagatgcctcgtactgcgcctgcccgccccggtcgggcggcggttatggcgtttccgggggaggcggaggcggtgccaaagtcgaacacgcgcccttgcccgctgaacaggcacctgtgccggaacaaccggcagaaagcgtcggcgtagcgcctgcaccggccgaagtggcgtcaaacgccgccggtggccaaggcgaagcagaagcggcgaaaggatacaggaagaaaatgtgaaagatcggataattattaatgcagaataaa

SEQ ID NO: 69127 - DNA, 465 bp, Heterodera glycines
  Genomic contig location: Contig_ID=SeqID_8758; Location=169..633; Strand=-
  SCN-specific regions: Sequence locations=1-395,417-465
  Gene Ontology: Biological process=embryogenesis and morphogenesis
atgaaggtgcacacggccactttcttggcctcctccatttcgggaatttctctgctcggctgtctgctgctgatcgccaacatttacaacgacgtgcaacaaatttggcaggagttggaccagcaaatctttctgttccgctccgagacggatgacttgtggcgcgacatgatgaagttgggccaaaaggcgcgaactcgtcgcgctgccgcggggtacgaaggcggaagtgcgtcggtcagcggcgggccaagcgtatcggcaccgtcgggcaatcgtaatggaaaacagaagtcaattttatttaacttattattttcaggcgcatcatctcatgctaatggcggtgcttcccccggagttcccccagggagcgttaatccgcccagcgtcccgccaagcatccaaaccggaacagctgggggagctggatgcagtgagtactatcaatacgggacccgctaa

SEQ ID NO: 69128 - DNA, 291 bp, Heterodera glycines
  Genomic contig location: Contig_ID=SeqID_40892; Location=259..549; Strand=+
  SCN-specific regions: Sequence locations=1-291
atgaaggcgtggaaggaatggacgcagcaaaaaaatcaatgggaaagtggtggcacggcacaaggagggaaaagattttttgagaacacgctgaaatccgcagtgatctcggcgaacgaaacacgagccatcccaccagaaggaatgagctggaaacgtcatgtttcgagctttcaaacagcgccgcctggccccggcttcaagcgccgataccacgacgtgagcccaatcagaagaatggacaacacgggacaagtgacgtcggcggcgagcggaacggaagaaaagatt

SEQ ID NO: 69129 - DNA, 49 bp, Heterodera glycines; identical to SEQ ID NO: 51181
  Genomic contig location: Contig_ID=SeqID_40896; Location=510..558; Strand=-
  SCN-specific regions: Sequence locations=1-49

SEQ ID NO: 69130 - DNA, 928 bp, Heterodera glycines
  Genomic contig location: Contig_ID=SeqID_40897; Location=22..949; Strand=+
  SCN-specific regions: Sequence locations=1-392,414-928
atgcaaaaacctactcctttaaaccgccccaattcttctgtctccaaaacccttgcctgcgggcttgaaaaaattgtgaatttgagtggaaatgagccactctcggtgccggtgctggcggatcggagtgatccgctgggactcaagtcggtccaacccgacgcggtgccaatggagagtgctgagggcaccaaggaagtggaaataatggaagtggatgaaatgagtggaggaaaagggaaaagggatgaaatgggtaaagaaaaggtgaaaagtggtggaatggaagaggaagaagaaagtgagggcagtgaaagtgaactgctcggagaaggtggatttggttcgatacaattaaaccccagcctgagggcgggaaataaagcagttgaaaaggaggataaggggaaaccttatctgatcgcccaagtgaggggcgatggtgtgatcgccgcccggatgaaacttttctgggatttcccggaattggtttttgtcccgtttagcctcttcgacaacgcccagccgatcgaaatcggcgacactttccgcctacataagtgcgaatggaccaagagcgagacaggatgggaagagcgcggagattggctctatgaagtcaccggacggctcaactaccaagccacggcgacggacgtgagccgactgcgccaacgcctccccactcgtgcggtcggcattttggtcgacgtccagagggcccgtgacagacacgtcaaagtggcgctggtctcagcacctgagctaagctgcgtcatgcgagcctaccgtcgccacttcccggccgaattcacggagaccgacatccggtaccgatccgttgtccgtcttcaacttcggcagatcaacagtccgccatgggtgctgtattcgcagcaatttgcgtacgttttgccatccgattttg

SEQ ID NO: 69131 - DNA, 888 bp, Heterodera glycines
  Genomic contig location: Contig_ID=SeqID_40898; Location=654..1541; Strand=-
  SCN-specific regions: Sequence locations=1-389,413-580,602-888
atggcaagcctaatccagaagggcatcacattcacactcaaggcgctggataatgccagaacaaccacggcactttcactacatccagacgccgacctctcaaactgggaaaacgcagtcaaattggaggctcaatgcacacgcgtcaacagagaagtccaaacaattgaagcacaactggacaatctacgcgacctctccaacaattggattgacctactaaaccgcctcgaaggaacagaaaaagacaaaggcgagaaagaatacgtcaaattcgacacgtatgagaaaattgctgaacgccatgacgcagccacaaccaaactccgggatctgcgggatctcgaagcaacgctcagtgccgatgccaaactttaccgaggcagagcagaaagagaagcaagagcggatcagcaagcaaatccgccaccacaaactgcaacgcctccaatagcagctcctacattcacggcaccgctctatcaattccagccaatccagctggacaaattcttcggtcaaaagcgaaaatggcccgaattctacgagtccttcaaatcggccatcggcagccaatcaatcagcaaagcacagaagctgaacttgctccgcaatcttctgggcggagaagcacgggaactcatcgctgggttccgcctggaggaccaaaactacgagacggtccttcagttgctgaaggacacttacggcgcacctgaagagcacatcagggcgctacactttgagctggccaatctcaagacgtgccgaagtctccgagacacaaaagacttcctgcttcagctcgaacgactgacaagagagctgaacaatgccggagaggacatcgagggaccgcaggtgttcctcatgttggagaaatggtga

SEQ ID NO: 69132 - DNA, 503 bp, Heterodera glycines
  Genomic contig location: Contig_ID=SeqID_40899; Location=390..892; Strand=-
  SCN-specific regions: Sequence locations=1-107,134-263,292-503
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagatttttattcatctccctttttgatagtgaaagcatctgagtgcctaaaataacttgtaaataaa

SEQ ID NO: 69133 - DNA, 1189 bp, Heterodera glycines
  Genomic contig location: Contig_ID=SeqID_8759; Location=2050..3238; Strand=-
  SCN-specific regions: Sequence locations=1-117,139-367,389-703,725 -800,824-1008,1030-1189
atgtttgaacagctcgaaaaagaatttgatgaagacggtttaacggaaataatcaaacataaattatatgggtttatcagtgatggagcttctgtaatgcgtggaacacgaggtggtttatttgctcatttagaaaagttcataaatcatgataaaaaactcacgggaatccattgctttgctcatcgtttttcagtcacgtcttaagaatgtttatgactggcaattaaaactcagactatgaggctgattttctgtgtgcaactgatggtaaaagatatgaacatgctcaatatatgttaagacaacaagcacatacacgatcgactgccgaagagaatctagttgttggaatttcccctcctattcctgaattcaataaagcccttcgggaaaaattgattaataatattgttgcggaaatcaaacagtattttcctttcggaacgcttatggatgagattgatctcttagatcctagtaatttacccaatcgttcagctgatataaatcaatatgcaaacaagctaaagaaattggcgaattattacaactatgttgggcatttaatttatcaggaattttcaaacgttctttctcttattttgaatgacaaccggctttgtagtttgaagaactcactaactcctcaaagattttggaaattagttatagaaaaactaggggatacttttggagaagaattgaaaaattttgtacaccatatgcttatttttggtttgggttcagctgatgctgagagagccttttctgtcttatttcatgtacgaggaaaaaggttgttttacttttttggatgttataattttccaaaattagatctgcaaggattacggcgcttaatctagatgctaagttgagagtgcgcctcaatggcccacctgttgaacaaatttcaatgcattcatttaaagaacgttggttattggaagaatgacattttgctagtgatagtaaaatgcgtacgcatggttttacaacaaaaagtggctttgatgaaaatgacgaacctttgttgatatatggagaaaggttgaacaaattgatattgacggatttattgaaacaaatagaaaagatgcatattttaaagacccggaaaggaaggctatttatagtatatttctttgagttctttttttcacttttctagccgctgcggaataaa

SEQ ID NO: 69134 - DNA, 186 bp, Heterodera glycines
  Genomic contig location: Contig_ID=SeqID_8759; Location=602..787; Strand=-
  SCN-specific regions: Sequence locations=1-14,37-126,148-186
gtcaaattgatacgaaaaaacaaaagcctaaaataacgcatgaaggccagcttcggccggtgggctgatcgaatgaaagaatgtttcggagacggcacattttcattggcacctccaatgttctaccaaataaattgtttccatttcttcattttgttaattattatatttaacgaaaaatttcat

SEQ ID NO: 69135 - DNA, 671 bp, Heterodera glycines
  Genomic contig location: Contig_ID=SeqID_40902; Location=1..671; Strand=-
  SCN-specific regions: Sequence locations=1-381,470-499,529-671
  Gene Ontology: Mol. function=potassium channel activity; Cellular component=integral to plasma membrane; Biological process=synaptic transmission
atgaaacgccaaaatgtgcggacactttcgctgattgtctgcacactcacttatctgatggtcggctccgccgttttcgatgcgctcgaatcggaggccgaacttcgacaagtgagcaataattaatgggggaagtgacagagaaaagtaatcagacaaaggaaagcattggacgaaagagagggaaattttggaggggaaaaagtaattattggaaggaattgtcagaggcaacaagtggaggcagtgaagagccgattagtggccaagtacaacatcacggagacggactacgctctgctcgagtcaatcatcgtccgtgccatcccccacaaggcgggccatcagtggaaattcagtggggtaattggagaggggattagagagagagagagagagaggagacaaagaagagggggaggaggggagagagagagagggcaaagcggaagttagagagaaagagagacaattatgaaagtctgattcccttttcaagatttttagaaatttctttcttttgttttggttgcggctcttatacattgccattaaaggcattttacttctccaccaccgtaattaccaccttcggatacgggcacagctgttgggtgacaatgggcggcaaaatcttgtgtatgttctacgctttggttggttttcgtttg

SEQ ID NO: 69136 - DNA, 56 bp, Heterodera glycines
  misc_feature (2)..(2): n is a, c, g, or t
  Genomic contig location: Contig_ID=SeqID_40903; Location=898..953; Strand=-
  SCN-specific regions: Sequence locations=1-56
cntatagggaagctattcccgaaggattcggtctccccataaatctgggcgcatcg

SEQ ID NO: 69137 - DNA, 387 bp, Heterodera glycines; identical to SEQ ID NO: 52041
  Genomic contig location: Contig_ID=SeqID_40904; Location=190..576; Strand=+
  SCN-specific regions: Sequence locations=1-82,116-138,160-387

SEQ ID NO: 69138 - DNA, 441 bp, Heterodera glycines
  Genomic contig location: Contig_ID=SeqID_40907; Location=150..590; Strand=+
  SCN-specific regions: Sequence locations=1-69,163-358,411-441
gttgaggaggagcagcgtcggcgtgaggaacagcgagagaactttttgatgagtgaaaagtgagagaacaattaaaaatataattaatattttaatttataaattattcaacaaaaaaaaatcttccaaaatttaaattatttaataaaattaaaaatatttgtttcaggaaattgaacattgtgctgtccgaacgcgatgaacttgttgtgcgccgagagcaaatggaacgggataaacaacgggtggaagccgaagtgcaggaggaacgggcgcgcaagacggagctgcaaatggacaactcacagctgagcgccgcgcgacgccaagtggacaatgacctacaattgacgaaggcaaaaaatataaaaataaaatttgaataaaatatatttcaaaattgaaaaaatgacaattttaaaaggctataaaatgaaatga

SEQ ID NO: 69139 - DNA, 748 bp, Heterodera glycines
  Genomic contig location: Contig_ID=SeqID_8761; Location=1418..2165; Strand=+
  SCN-specific regions: Sequence locations=1-2,27-464,493-517,539-748
atgccctccctccttctcctcccaacattttgcttcttcgcctttgccgtcgtagtggcccattcccagatgactttctccgatggttggggaaaacgttcagcggttgcgccattcgcattgcttgcggacagacatatggcgggaaacaaacggcacgaaaagccgagggcggcggccaatctgttcatcagtcgtaagtacatttttggaaatgaaagattggacggatggttcagcgacggatgaggacgcactggcgatgagcccggcaatggaagcgtgtcaagtgggatacgcgcaaagactgatgcaactgcacgagcaaatgctggtgagaccgatggaccaatcactgacagtcggaagcaaaatgttccgtccgtcgcttttagactttgttcagcacgtaccaacaatgtcagacaaaagcgacgatgatggagacgaagaaagcgtagagaacgacgagagaaagaaagggacgaaaagcaaaacgaagccaaaagcgaaaagacaccaaaggaaaagccagtgtcactcaaaagtaattcattgtgtttaaagctaaattagtcattcgttgaagcaaaatgccgaggggaaaagaaaaactcaccggaaaatgcccaggaaaaggttcagtccgtcctgcttctcaaagtcgccgaaagtgttgctgtaatagcgcgaaattgtttggaacacatctcgacttctttcctttaataacaaatttggagaataa

SEQ ID NO: 69140 - DNA, 1534 bp, Heterodera glycines
  Genomic contig location: Contig_ID=SeqID_8762; Location=7..1540; Strand=+
  SCN-specific regions: Sequence locations=1-445,467-1534
atgcaactgcacgagcaaatgctggtgagaccgatggaccaatcactgacaatcggaggcaaaacgttccgtccgtcgcttttagactttgttcagcacgtaccaacaatgtcagacaaaagcgacgatgatggagacgaagaaagcgtagagagaacgacgagagaaagaaagggacgaaaagcaaaacgaagccaaaagcgaaaagacaccaaaggaaaagccagtgtcactcaaaagtaattcattgtgtttaaagctaaaattagtcattcgttgaagcaaaatgccgaggggaaaagaaaaactcaccggaaaatgcccaggaaaaggttcagtccgtcctgcttctcaaagtcgccgaaagtgttgctgtaatagcgcgaaattgtttggaacacatctcgacttctttcctttaataacaaatttggagaataattaaaaccattcgcttgcctttccatacctgaaaaacggctgtccttttgtacgtttttatggaatggaccaattgagaaccggcatattgccatgccaaagtgttgccgtgctcatcgaacatttcctcaaaaacacggcacacctcactgtgaagctgcaacgaccatggcaaagccaaaaagcccatggagtaaagttgccagccaagtgccaccttcccttacaaggaaaagcctaatgtagtcacgtgtatgaaatttaagtggtattaacagataaaaggctcgacgcaacacacccaaatggaaaggaaatccaaccgattccgaattggacgacatttgtccggtccaaacagtccacgcaattcgaacgaacgacgccatgctgcaaaagcattcgcgcgtccggcgaagtttgggcagtgaaatgagaaatgttttcttcgatttttggaggtgccgcggaggacatttggtcaagcaaaatgtgagggagtcgagaatgaagaagagggaaattctgaaggggggtgtattttgaaaacgaagcaaaccaacttggaaccatccgccggacattgccacccgttgcccaatttcctccaaacgctgcaaaacgcggccacttttgttgcaacgactgacatcgaaactgatgtaatcaatgcattcgccaactctgcggaaatcgtttaaatagcgaacagtctgaaaaaccaaacgaaatgaacaatggaagaaccaaacaaatgcactttcagaaatattttgtggagtaggttctcgttatgtctgtgctcctctctcttcaccaaattcagcaccaccaacggatgtccgtattttctgcccaattctctgaagtgtttggccgtggtcagtgcgtgcggctccacccgatcgatcaaaatgggcggctttccgacgaccattggggagccgcggtgggtggggtcctgcgaccaaaaaagcggcacggagccgcggcgttggacgaaggaggagaatttgccggaacgaaaggacagaggactgctcgtgtcccaaacgacctgctcagtctcaacgtcgttggccacagctcctga

SEQ ID NO: 69141 - DNA, 585 bp, Heterodera glycines
  Genomic contig location: Contig_ID=SeqID_40912; Location=218..802; Strand=-
  SCN-specific regions: Sequence locations=1-364,417-585
atgtgttttttaaacattgtgtcaaccaaatatgagaaacgcagagccccgcttcttgatcacgttaacattataattaatgatgcggtgagagtggtatgtaagattaaacaccaaaaaatttgtaattaacaacaaaaataatataaattacttgaactaactatactcattcactatttttagcaaatacttggtgtgatgtgtgaaggaatcgtgtcgacagagcaggatgattacaaatttcatcgtcttcagataagggagtatgatcgactgactaaaaatacggcgcttgcaatgtcagcctgggttgaggctgatttggtatgttcatgccttgttgtcagttaaatccgtcaccaaaattaaaaattataattttctccttttaattaatattttaaaaaaattttgtttttcttaatatgtgataattattaaggattcggcttggccagacgtgatcttatcccacacaaagttggcgttggaaacagaccggaacgatgacatttctgaggccgaatttgaaaaatttgcattgctaattcaacagattgctgatgagagaggaaaacaaaa

SEQ ID NO: 69142 - DNA, 522 bp, Heterodera glycines
  Genomic contig location: Contig_ID=SeqID_40915; Location=300..821; Strand=+
  SCN-specific regions: Sequence locations=1-522
atgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcgtgtgatctacgcctagaaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggt

SEQ ID NO: 69143 - DNA, 438 bp, Heterodera glycines
  Genomic contig location: Contig_ID=SeqID_40918; Location=321..758; Strand=-
  SCN-specific regions: Sequence locations=1-438
aagatggtctaagtaaaaatcgtaattacgctcttaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgc

SEQ ID NO: 69144 - DNA, 767 bp, Heterodera glycines
  Genomic contig location: Contig_ID=SeqID_40920; Location=1..767; Strand=+
  SCN-specific regions: Sequence locations=1-42,68-85,292-333,368 -402,476-589,613-644,701-701
gtctatcgaccaagcacatgaaccaaatgtctgaaccctctcttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 69145 - DNA, 1932 bp, Heterodera glycines
  Genomic contig location: Contig_ID=SeqID_1163; Location=39..1970; Strand=-
  SCN-specific regions: Sequence locations=1-46,77-154,176-191,214 -485,507-687,727-1857,1879-1932
agttcaaccaaaagttggattttgctaaaataaaaattgtgcgctcttatttaaatatattaaatttaattaaaatgacttcaaaacgcaacgggactttgcaaaaaggcggtccgtcgaccaaaaaatgggattttcgagctatagggtaagcaatttttaataatatatttaagagacaagtgtaatcaataatttttcaggaacaattttactgaggaaatggaaaattataaattaattgacgaacggtcgacgatttgcgaaaaatttggattcacgaagaacattacggaatttcggatcaattcggatgtgagacgccctgacgaagcgatgagggacgcaatcgacacaatgattaaggcggcttttaagactacggaagaaaggatgaagcggaaagtgcggatgtttggtgtggcaataacgggtgccgggcttgcttccccggtatggttaccgtacagggcgtacccgcagaacaatgcggatgttattatgcaggagattaataagttagggcagagcggggacggggatgaaaataagaaaacgcttttgttgtctgagcctattatgatgaaaattacttgcgtcaccgtgcccagtggagaagggccgagaaatgtacacaaatttgatttcggattcaaggaacaccaacggataaggtgagtttttgagaaaaaaaagagaaaaaaaaaaggaaaacagaaaaaaaaattataattatttattaaggatttcgaatgtggataaaatttgtttgttttatgctttggtggcgtcaaagctttatttggaagtgcatcggaatatttttaatcgttttatgaataatattatgagacaacgagaggcggctgttgaactattacgtaattgtggaattgatattaacgaatatagctatggagtggagcacttatcgaatgttcagaattattgggtgagtttaaaaattgttaacacagaaatgaccgatttttaggatgagatttaccccggaaaattccggattgttgagtttgagaagtctgcggatccgcggaaatcgatccgtgttttatggaaggggcctatggggcgagagatggtcgtgccgatatttttggagaacactcactgggatggtctgaagaattacgtctgcttttttaatcgcgggaggaaattttgcgttgattgtgagtgcttttactcgcgtgatatttatcatactttggagtgtcgggcaaggtgttattattgcaacagagtgggcggagtaccgtgtggaaaggagagtggagtgaagattgaatgcccgaagtgtcgccgttacttttacaattgggagtgttataactatcatcaaggacatcagacttgtaaattatggaaacgttgtgtgatttgtgataagacttatttatttaatccgaagaaggaccatgaatgtggtgagacttattgccaactttgtagtgtgagccacgaccccaagcggggatgttatattatgccgattgaggaaaaagaggacaaggacgtctacagaattgtagtttgggtaagttttacaacaaaacaacaaaataggtcttgttttacaggattcggaaacatcgcaggattcgatttataagggggaccagaaagagcatgtgatcaattatatttcggtgagagttacgtgtacggaatgttgtgacgacaaaaataggacgaattgcaaaatttgtggggaggtgaggaccaaggattggagtgaggctgagggacatgagccgatgaaggattttgtggagtggattttaactgcttttaccagttatgatacgtacatttttgcgcacaacgccggacgatttgatggtaatgataaaatttaatccttacttttttaatcctaaaatttcaggacattttgtatttaattatctctaa

SEQ ID NO: 69146 - DNA, 330 bp, Heterodera glycines
  Genomic contig location: Contig_ID=SeqID_1164; Location=1747..2076; Strand=+
  SCN-specific regions: Sequence locations=1-61,119-330
cggagtacctggataactggcattcctgcttggatttttcgtcctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcacccc

SEQ ID NO: 69147 - DNA, 431 bp, Heterodera glycines
  Genomic contig location: Contig_ID=SeqID_1165; Location=1147..1577; Strand=-
  SCN-specific regions: Sequence locations=1-431
atggtatcagtgtggggaaggaccgaatttataaaaagctcaacaaattcacatctacaatttctgttaatttctacaattatttttagaggagaagaaggtaaattttcgaactttcacaagggtgatcgagaaaattgaaaccggaaattgttgacgctaatcaactcggtccttctgcaccactgataatgtttaatatttagactgtaatgagatgatttttaataagtccaagagaatttcggagtttcgactccttaggctacaaaaatgaaatgaatcagtgttgcagaagaactcagttgataaggtcaataatctccactttactattttcgctcgactaatttgtgaaattgttcacaatttcagctcctcattctaaaaatataaatggtatcagtgttggggaaggaccgaatttataa

SEQ ID NO: 69148 - DNA, 1269 bp, Heterodera glycines
  Genomic contig location: Contig_ID=SeqID_8763; Location=1..1269; Strand=-
  SCN-specific regions: Sequence locations=1-1269
  Gene Ontology: Cellular component=actin filament; Biological process =nerve ensheathment
tcccaaaaagtcgtgtccccaaatgacgaatccccaaatgtcgggtccccaaatgtcgggatccccaaatgtcgggtccccaaatgtcgggatcccccaaaagtcgggtccccaaatgtcgggatccccaaatgtcgggtccccaaatgtcgggatccccaaatgtcgtgatccccaaaagtcaggtccccaaaagtcgggtccccaaatgtcgggatcccaaaagtcgggtccccaaaagtcgggtccccaaaagtcgtgtccccaaatgtcgggtccccaaatgtcgggttccttaagtgtcgggctccaaagttagtccccaaatgtcgggttccttaagtgtcgggtctccaaagttagtccccaaaagtcgggtccccaaatgtcgggttccttaagtgtcgggctccaaagttagtccccaaatgtcgggttccttaagtgtcgggtctccaaagttagtccccaaatgtcgggttccttaagtgtcgggtctccaaagttagtccccaaaagtcgggttccttaagtgtcgggtctccaaagttagtccccaaatgtcgggtccccaaatgtcgggatccccaaaagtcgggtccccaaatgtcgggatccccaaaagtcgggtccccaaatgtcgggatccccaaaagtcgggtccccaaatgtcgggatccccaaaagtcgggtccccaaatgtcgggatccccaaaagtcgggttcccaaatgttgggatccccaaaagtcgtgtccccaaatgacgggtccccaaatgtcgggtccccaaatgtcgggatccccaaatgtcgggatccccaaaagtcaggtccccaaaagtcgggtccccaaatgtcgggatcccaaaagtcgggtccccaaaagtcgggtccccaaaagtcgtgtccccaaatgtcgggtccccaaatgtcgggttccttaagtgtcgggctccaaagttagtccccaaaagtcgggtccccaaatgtcgggttccttaagtgtcgggctccaaagttagtccccaaatgtcgggttccttaagtgtcgggtctccaaagttagtccccaaatgtcgggttccttaagtgtcgggtctccaaagttagtccccaaaagtcgggttccttaagtgtcgggtctcctaagttagtccccaaatgtcgggttccccaaaagtcgggtccccaaatgtcgggatccccaaatgtcgggatccccaaaagtcaggtccccaaaagtcgggtcccctaaatgtcgggatcccc

SEQ ID NO: 69149 - DNA, 723 bp, Heterodera glycines
  Genomic contig location: Contig_ID=SeqID_40922; Location=12..734; Strand=-
  SCN-specific regions: Sequence locations=1-154,177-280,304-492,514-723
atgaggacccctttttattggcgaacactcactcttcgcactttggcggtggccagcgaagaacggtgagaaaagggacaacaaatttcttacacttaaaatacgaacattaaaaaatcaaatatatatatgtgtagctttgaaatccatctgcatttttatatttttaaaattaagcatgtgggccgttcaattttgcaacgacgcgtgaatttccgtggacaacagcagggggaagactttgaccaagaccaagactcggaggacgggggcagtgaggtggaaaatcaaatacaaaatttatgagcggatttgtgaaataggactcctcctgtggattcggtagccaatggggaggaaggagtgattgagggggtgggtacacgggggtacatattaaggaaaaattccttaaaaaaacacaaaattggctgagagaaatctttttgcgttacttataaatcagtaaagtatcaaaaaaatgacttttgtttgtaaataatattttttcttgtagattcaaggccatttagtgaatttgaatcgattttggacaatacatatgaattttggtgaaaaattaatttgtgttagaattcgggttcgggattcgaaataggtcaaaactgacgtcatattcgtgatcagcgcccccgaaaaccctcgagtactacgaaatgcataaaaacaactttttaatcttttttttatgggaccaataaa

SEQ ID NO: 69150 - DNA, 96 bp, Heterodera glycines
  Genomic contig location: Contig_ID=SeqID_40923; Location=97..192; Strand=-
  SCN-specific regions: Sequence locations=1-96
atgaatggcccctcaattaagcaactgagcactcactttgcacaagtccaatttcgaattcagcaaattgcgaaggcaccggacgaacagcgaaat

SEQ ID NO: 69151 - DNA, 1123 bp, Heterodera glycines
  misc_feature (109)..(110): n is a, c, g, or t
  Genomic contig location: Contig_ID=SeqID_40924; Location=1..1123; Strand=-
  SCN-specific regions: Sequence locations=1-179,201-213,235-243,265 -275,297-306,328-347,373-607,640-735,757-836,858-962,985-1013,1043 -1123
  Gene Ontology: Mol. function=ATP dependent RNA helicase activity; Cellular component=cytoplasm; Biological process=regulation of translation
ccccccccccctcattagacatccaattgcactcggacgccttctgtttggtgatgaccacgaaatttttgcgctcaatgctttacaacgggtcggaagtcatcggaannttggagtggtgcatttttgacgaggtaatggcacaaacacaatttttggttgtttttttttgttgcaacttttgggataataaattttataaattagccgaaatttttcggatttaaaaattttggatgctttaatttccattttattgtttctgttttcaggtccactacatcaacgatgccgaggttggtgtgcttttttttttattaaaaaaatcgctttttttacgagaaaaattcattaaaatttgaaaaacaatttccagcgaggccatgtctgggaggaggtgctgatcatgttgccggcccatgtcaaaattgtgatgttgtccgccacggtgcccaactgtatggaatttgcggattgggttgggtgagcaaaattggcaaaaactgaattttaaaaagccaaaaaaaagtttaggcgcataaaaaatcgaaaaatttttgtcatccaaacgctgaagcggcccgtgcccctcgaacagtaaaattggaattatattttaaattttattgttttaattttgtaacagttatttgtacacgggacaggacgggaagaccaagaaggacatgttcctgattttggacaaacgtggcgactttttgacatccgggcaagtgcaattaaattaaatctaattttgattttttgaaaagaaaaccgagcagggtaaaacatttgccggaaaatatagtgccaaaaatctatactaaaaaaagaggggttttctgaaattttcccggcgattttttttaatgttttgtgcttaccgaaataaactttaaaacccttgaaaagttacaataaaaactacaggttaatccttagaaaaaaaaattacattaaaaatacagtaattgaagaaacttaaaaaataggcgcattttttttgttttgaacttttaggattaaaaaattccacatacattctggataaataatttttacattttacaatactacaatatcgcaaaaatgatataaaaaaaatttaagctaccaaaaa

SEQ ID NO: 69152 - DNA, 489 bp, Heterodera glycines
  Genomic contig location: Contig_ID=SeqID_40930; Location=121..609; Strand=-
  SCN-specific regions: Sequence locations=1-33,65-106,132-247,429-489
atgcaaaaaaatttggcacgcattttgccatggtaaaaaatttaaaaaaaaaatttctttttaagcccaagtgctcatctgttgagaacatcgacaaagcaaatgggtgaagatggtgatgatgatggtggaaatcagcagcaaattgaaaatgttggacgaacacggccatggaaaggggcaaacaaaaagaaagcggcggcatggaaaggcggtgccggcggaggacgggtggaaaagagacggcagagacgagaagcgaagagagagcgcaggaaaggcggagattggcacagagatggacagcagaagagacaaacagaggaaaatgatggggaagaaatggagcaatgacagagagaggaagagagagagagagcacaggaaaagtggagagaaattagagatggagaaggacagaagagagattgtggcgattctaattcaaatttttgtttattgttttcttcaattgttactttaaataaa

SEQ ID NO: 69153 - DNA, 659 bp, Heterodera glycines
  Genomic contig location: Contig_ID=SeqID_40931; Location=254..912; Strand=-
  SCN-specific regions: Sequence locations=1-345,367-499,526-608,651-659
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 69154 - DNA, 206 bp, Heterodera glycines
  Genomic contig location: Contig_ID=SeqID_40931; Location=1118..1323; Strand=+
  SCN-specific regions: Sequence locations=1-88,113-206
atttataagcatttgaagggttctcagcagtttccctgcaaaatttggtgagcttctgatcagtgtagaacgttgggtgatcaaatgcaaaaaataatttaaaaaaaataatgctggtgtggtaagtgtgaagaactgtgttcctccaggcaaaaaattctaagaaaatttataagcatttgtagggttctcagcagtttccttgc

SEQ ID NO: 69155 - DNA, 742 bp, Heterodera glycines
  Genomic contig location: Contig_ID=SeqID_8767; Location=303..1044; Strand=+
  SCN-specific regions: Sequence locations=1-51,74-217,251-391,431 -579,617-666,696-742
atggtgcacaacattacctcattcctttccactcccccgcacattcctaatggtattttttctgtttgcttataatttaattttgttaaacaataacttattttccagaatcggcacccgcgtctctttcctcgggctccgtgctgcagctgcttatcgtgctccaaattttcatcattttgcttacggtgagtaaaaattatttatcataaaagcgaaaaataatttatttatgaaaaatatttaatttctttaaggtggctttatgctgctgtttgctcgtttgtgccgcgcgaggtcgaacttacacggtgaatggtcgccgttccactcggcgccgcgctgccgctgcaactttgagcgcctttcaggcgcgcacttcgggtgggcgtttttatattaatttgttataataaaaatttattattatgtttggggtgagggaagggctggatttcggtttttgaaaatcatttttccaatttcagcacttggtcttggcaccgttggtccgttggcggttccaaaccgtccggcggattccacttctcatcgtgtgccgggtagcgtgacttttccaatttatttttttattttaattttcatttattttttaggctgaattgtgccagatggtcaacgaatgaatgatgtgtgaagaaaatggggataaaatttttaaaaagaagaatgattggataatatttaatcttttttttgccttttatttttttaaaattta

SEQ ID NO: 69156 - DNA, 518 bp, Heterodera glycines
  Genomic contig location: Contig_ID=SeqID_8767; Location=1197..1714; Strand=-
  SCN-specific regions: Sequence locations=1-247,269-487,509-518
atgtcctccccaagcaaattctctccgacaaaaagctcccccgtcaaaaaggagaacaatgttggaaaagctgaatttgtggttccttccttgaaagcgcccacccgtaagcagtcgtcaaaaaatgtgggaatgaatggtggtgaggagcagcagccgtcaatgaaaaagcgaaaagtcgaggaccgagacctgtggaaactcgccaaaggaaaatacatgctgggtttctacctctgcgttggtgaataactatttattttttattgttaaatacttataaatctcagatgattggaacaaattgtacaacaacaagcagagggtgttgcgcaaggatgatggccgcttcgctgtcaattttgaactgtgcgaggagtgcacttgggtgaacgctcgggccactgatttgatcgcgccgcccaaggcaaagaaacgcaccgagtaaaaaccggacagcagtaaaaatccgaaattacacaataataatttgtaatgtttatttttcaattaataaa

SEQ ID NO: 69157 - DNA, 969 bp, Heterodera glycines
  Genomic contig location: Contig_ID=SeqID_8767; Location=1908..2876; Strand=+
  SCN-specific regions: Sequence locations=1-568,591-727,749-969
atggccatcaacatgagcgacaagcggggcttgctccgacagattctcggcgaagcggaaatcaccgtaactacgtctggcctgacaattagcggcccccgtctgtccacacctcgattcctgccatttgacgagtgcggtcgctgccgctcatgtaaggcaaccgaagtggaggttgacacaatggtgacgaaagagggggtcacgatttggtgcacgcgcatcgacaaagtgcagttcgtgccatttgacatggtctacgaattgccagggcactgcttcttccgactgaaaaacaagtcgcgcgtgttcaaccttccatatggcgacctgccctctgagtcgtgtgaaattccgctaattcaacacgctgatgatgaacgggacctcaagcgaaaggcaaaagctgcgctcgaattggtggaggccggactgattgcggacagcactgtgcaggacggggcccgattgaaaaaagccaaaactgcgatgaaagtgatcagtgacattctgctctctgaaccggagggagatgatcacaagaagacggttgaagtggcagatgtcgacaagcaggcacaagagcagcaaccagcccctgtacaacagaagaccgcctcggtacccgctgtggaacagagcactgttgaagagaatacggaagaagataccaaagatgatcttgactgacattgatcgaacactctatgaaatttttgcgacgcgtcaagccgcacccacctaaatgattacgaatactaatatacatcctacatatatattagtgcacgatatcacttgttcacagtaatctctgataaatacacatcgcgcattcaattcaatatatttggatattttgccctaatgagaaacatatataaaagatatcttcgtatgaaaaatgacaatatctactatataatatggacagatacttccaaattgactcttgcacactgttattga

SEQ ID NO: 69158 - DNA, 939 bp, Heterodera glycines
  Genomic contig location: Contig_ID=SeqID_40932; Location=2..940; Strand=-
  SCN-specific regions: Sequence locations=1-179,201-317,339-466,498-939
atgtcaaatgaaaaggcgcattttcacgtcactaaatacaattgtaaaatgtcaaatgaaaaggcgcattttcggtaactaaatacaattgtaaaatgtcaaatgaaaaggcgcattttcggtaaccaaatacaattgtaaaatatcaaatgaaaagcgcattttcggtaactaaatacaattgtaaaaatcaaataaaaaggcgcatttttcgataacaaattacaattgtaaaagtcaattaaaaatgcgcattttcggtaactaaatacaattgtaaaatgtcaaatgaaaaggcgcattttcggtaaccaaatacaattgtaaaatatcaaataaaaaggcgcattttccctaactaaatacaattgtaaaatatcaaatgaaaaggcgcatttccgttaatacctaacttattttccagtaactaaattacaattgtgaaaggcattttccgataacgaaattacaaatgtatttttctataaaatgcaaaaaacacaagcagtccgaccagcctacctactatcccctccgccccaaaagcatttaaaaatttctagacataacaattccgtccaccactgcgaaaaaaagaccggaaatttttgcgccaattccgtacgtgccttggccgtgccgtcccggcacacatcgcgaagttcgatctccgtcaacgggtcatccgtttcggttgatttaccaccgcctgtcgtcgccgatgatttggtcgctgtcccctcttcgtccgacgtggtggacgcgctggaacagatggagtacggcttggtaacgctgtcatcaccgccaacaccgctctcgttcaaactgatctgtgggtgtgcaaaaatttaggtaaaatttaaaaattggcgtttttttaattattcgtgatgcgaaagaattctcgaaaaattcgaaaaaagaaagcagattaaa

SEQ ID NO: 69159 - DNA, 503 bp, Heterodera glycines
  Genomic contig location: Contig_ID=SeqID_40935; Location=22..524; Strand=-
  SCN-specific regions: Sequence locations=1-124,153-161,183-256,285 -425,447-503
caagttttttacaaccacttattgccaatttaatttcttgcagatttaaagccatccattgcctgccggttctcggcacagcaaagcactaatacggtgtttgactcacttcaaaaaataattcattacccaaaagttttttacaaccacttattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactc

SEQ ID NO: 69160 - DNA, 59 bp, Heterodera glycines; identical to SEQ ID NO: 52421
  Genomic contig location: Contig_ID=SeqID_40936; Location=92..150; Strand=+
  SCN-specific regions: Sequence locations=1-59

SEQ ID NO: 69161 - DNA, 59 bp, Heterodera glycines; identical to SEQ ID NO: 52422
  Genomic contig location: Contig_ID=SeqID_40936; Location=222..280; Strand=+
  SCN-specific regions: Sequence locations=1-59

SEQ ID NO: 69162 - DNA, 59 bp, Heterodera glycines; identical to SEQ ID NO: 52421
  Genomic contig location: Contig_ID=SeqID_40936; Location=352..410; Strand=+
  SCN-specific regions: Sequence locations=1-59

SEQ ID NO: 69163 - DNA, 59 bp, Heterodera glycines; identical to SEQ ID NO: 52421
  Genomic contig location: Contig_ID=SeqID_40936; Location=482..540; Strand=+
  SCN-specific regions: Sequence locations=1-59

SEQ ID NO: 69164 - DNA, 59 bp, Heterodera glycines; identical to SEQ ID NO: 52421
  Genomic contig location: Contig_ID=SeqID_40936; Location=612..670; Strand=+
  SCN-specific regions: Sequence locations=1-59

SEQ ID NO: 69165 - DNA, 59 bp, Heterodera glycines; identical to SEQ ID NO: 52421
  Genomic contig location: Contig_ID=SeqID_40936; Location=742..800; Strand=+
  SCN-specific regions: Sequence locations=1-59

SEQ ID NO: 69166 - DNA, 59 bp, Heterodera glycines; identical to SEQ ID NO: 52421
  Genomic contig location: Contig_ID=SeqID_40936; Location=872..930; Strand=+
  SCN-specific regions: Sequence locations=1-59

SEQ ID NO: 69167 - DNA, 450 bp, Heterodera glycines
  Genomic contig location: Contig_ID=SeqID_40939; Location=383..832; Strand=-
  SCN-specific regions: Sequence locations=1-67,90-180,225-273,295 -310,336-450
atgtcaatttcaagcggcatttctttttggcagaatgtcaccaaaccggtgccatttgaaaacgaaaaatttttggacattttgactgccgacaaatttccggaggccgaagcgaagcaatgggttgacggacgttttccattgaccattcaggtgaaaaattaattacgctttatcagcataaaatttaaaaatatttgactaattttacaattaatatttttggccgcttaaattttgaactttttcccggccctctccgatttggcaaatcccttttccccaaccttgggcctctagccttaataagacagatttttacaaatattattttaaagttaccaaaaagcactctcaactctttataattgaaaaaatcgagaccgagactcgagaccaaaattctcgagcaacattaatgaatagggctataattttgtgggcaataaa

SEQ ID NO: 69168 - DNA, 788 bp, Heterodera glycines
  Genomic contig location: Contig_ID=SeqID_40940; Location=52..839; Strand=-
  SCN-specific regions: Sequence locations=1-189,211-246,299-383,412 -447,469-517,589-659,681-724,785-788
atggcccctccttcagcaagtgccgttgggtcgcacatcggcggtccgtcgccgtcaccgccgctgggcatccgcgcacaatttcggcgacagggatcaagctgtaattaattaactaattgtttttaaatgagctacttacagttctgtttatcttgccctaatttattgttcaatttgaacaaaaatccgaaaatttaatttattattgcaaatttacaaattgtaaggaattgaaaaaacccctaaaaaagtattttaaactatttaaaaatatgttaaaaataataaaattaatcaattaacagatggccattcgcatgtccatcacatggccctaatggtgacccccaaacgagtggattacagtgtaaataaggtggaaaattcaaaattcaaaaattaaatttccaattttttttcaaaagggtggcttaaaaacgtggattgtgctcattgtgtttgtgttgttgtgctccgccattttgaccattttttcggacgaaaatgaaagcggtaaattttaaaaatgcaatttaaaataaaatttaattggaaaaaatagaaaaattaaatttaaatttaattggaaaaaaatagaattggccaacgaagcgccgctggcggaccaaaaagatggggatgaagaagacaatgatggaggaggaggagaagcagcaaaaaatattcaatcagcggagggaataactgggactgatgatggggaagaggatgaggaaacggaagaggatgaagaagaggaggaggaggaagagaaagaggaaaaa

SEQ ID NO: 69169 - DNA, 2311 bp, Heterodera glycines
  Genomic contig location: Contig_ID=SeqID_8768; Location=2364..4674; Strand=+
  SCN-specific regions: Sequence locations=1-57,80-184,206-394,415 -433,462-1260,1282-1336,1366-1768,1790-1959,1982-2311
atgccttcatcaaactcattctatgtgatcgttccttccaacacaaatgttgaaggaaatcgcacaaactcttttcgagttcgactaccaagaaaacttcaatttaattcggaatgggatgtgggcttaggtgtgataatatacccccattcgtggccctcactcggcacatcagaggaccaatttgttcaaattgaatggaaaattggagagaatgttcaaataccaattccatcctctaacgtgacaaaccccgttgagctttggaaaagtctttacaaactgcttgaagaaggcaacaaaccgttcgcagttaaagtggaaggcgtacagaaaaaatttactgaagcggccaatacagcacgtcaattgggcagagccgagtacatcaataaacaacaacaacaacaacaaagagacaaaagaaatgttaatgatgatgatgatgatgatgatgacgaaaacgaagaacaattattaaacgcccttttagcgggggttgacacgttgcttgacctttacggagcaaccagtggtggtctacttgagagagaaaaacgtgcagcaacaagcaaggtccccctgcggaattgggatgacactgaagaggaatatcaggaaaagcttgataaatattttttgcgtctacgtggccgtaatttagaacacttagagggactgataacagaaaagttgaatgcggaaattgcactgatggatgacgaagaaaggaagattctcgatcaaaccaaagaattaggcatgacagcatggataaaagttttccaatcagcgtactctgcatgtttcctgcattttgacagtgcaacgaacagattttcgttgaaactggacgatcgttatgtgcaaaaaataaaaatttcagaccaattggcctacattttgggttttaactcaaccgatttcactgaaaaagaaacgattgcaaaatttatgccagacatgagtggaggagttgcttcttttcatgtttatgcacctgatctaattgaaccaatgatgattggtgacgtgattgccccagttttgcgtatcgttacgattcggggaaaacctgacgaaattatagaggagcagtttctctccgtccaataccatcgcgtactagtcaaagaaataagtgaaattttcatcgaaatcagaacatccggtggtaacctaatgccatttcaatacggtacatgtacattaaccttacactttagaaaaagttcctacttttaaaaatgaacagtgttcaaataaataaaattcttgctcgaaacccagtcacgcgttcgacctttttagggtgttttccatcagatcaaattccagcagtagcagccacaccagctccttattcaatggtgattaacgttgatccgagcggttcacctggttcacattgggttgccgtgtattgcgagcagcaaaatcgggtggaatactacgattccacaggaatttggccaccactaagccctttcatccaaaaatttttaaagagttttgctcaaattcagtttcatcaactctcgctccaagcaccatactcacactcatgtgggaagcatgtgattttctttatatttggacggtgtatggggatgcactttgaagcaattttgcaactgctaaaacgcgcaaaaatatcaccagatttttttgtaaacaaatttatgcaaaaaaatgtgtttaaacaaatataaataactagaaaactcaatttaaaaagcgcaaaaaaaaagaaagaaaaatgcacgttgattttgatccttttaaagttgaatggtcagaattaactcaaatttctccagaagtagtcgtccaatacggtggttataatgtgttcagagaagttccataccagcgcggtagtggtatcgggtctgtttttaggagtctattgcgttacctaataccaatcgggaaagaaatcgggacagccatcgggcgccaaggacttgaatctggaaatcgagttctatccaatgtattagagggtagggacctcaaagagtcacttgttagtgagggaaaaacggggctcaaaaatttgctagagaaagcagccaacaacataaatgcccaaaaaagtcaagggttcgacttcaaacgatacacaaagagaaatgatacaagagaaggtggtgcaattggtaaagcgaaaaaaggtataaataaactacaatcaaggttgggaccacacgatttcctaccagcaaacaccccagcaggtcggaagaaaaaacacactaaacagaaatcggtcaaacgccttcgtaccgatatacttggaacctattaa

SEQ ID NO: 69170 - DNA, 54 bp, Heterodera glycines; identical to SEQ ID NO: 53113
  Genomic contig location: Contig_ID=SeqID_40946; Location=99..152; Strand=-
  SCN-specific regions: Sequence locations=1-54

SEQ ID NO: 69171 - DNA, 489 bp, Heterodera glycines
  misc_feature (410)..(410): n is a, c, g, or t
  misc_feature (435)..(435): n is a, c, g, or t
  misc_feature (439)..(439): n is a, c, g, or t
  misc_feature (466)..(466): n is a, c, g, or t
  Genomic contig location: Contig_ID=SeqID_40946; Location=497..985; Strand=+
  SCN-specific regions: Sequence locations=1-489
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtcccgtttggggtactcaaacaattatggggagcaaaaatccaacgcagaattanagtacaggctatagggaagctattnccgnaagcgatcggtctccccataaatctgngcgcatcgggttcgggggggact

SEQ ID NO: 69172 - DNA, 438 bp, Heterodera glycines
  Genomic contig location: Contig_ID=SeqID_40947; Location=135..572; Strand=-
  SCN-specific regions: Sequence locations=1-438
aaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 69173 - DNA, 438 bp, Heterodera glycines
  Genomic contig location: Contig_ID=SeqID_40948; Location=203..640; Strand=-
  SCN-specific regions: Sequence locations=1-438
aaaatggtttaagtaaaaatcgtaattacgctcaaaaagcttctcaaacaattttagcgcttccaattccttctacaatcgcctttatacatcccattatgagcgctaaaattatcagagtgccgaaaatcgcatgtgatttaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 69174 - DNA, 669 bp, Heterodera glycines
  Genomic contig location: Contig_ID=SeqID_40951; Location=343..1011; Strand=-
  SCN-specific regions: Sequence locations=1-669
tgccccgaaaacaaaaaaatcgattttttcaagtgtccgtttggggtactcaaacaattatcggggagcaaaaatccaacgcataattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagtaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaac

SEQ ID NO: 69175 - DNA, 780 bp, Heterodera glycines
  Genomic contig location: Contig_ID=SeqID_8771; Location=854..1633; Strand=+
  SCN-specific regions: Sequence locations=1-197,219-298,325-494,516 -556,580-643,666-735,759-780
atgtcaagctctaatattattttatgccttttttctaatcattgtaagattctcaatatgatgggttccatggcgtttgggttagtgttgttaatgaatccgctgcacgtctatttgccatttatccgtcattttggctcacttgctgaactgatgccggcttttatggcactttgtacgtccgtcatggtaatgatcaatttttggtttctcatgctcggtgcgttcacttatgtgctcattcgtgacaagcgtagcttattcgtgtataaagagtaagtgatgcttaatcgggtccaaattatatttaatttttaaatatttggttttaattgttgaagtcggtaattaaatttttagaattttgaaaatttgttcaagtcagagactcggtattggatggtttcgtattcctgatcactgatctgtgacccgaaaacctgctgaaacaaacgtgttcccgacttgacttcaacctaaattttttttttgtaaccaaaagccctccccctggttttcaataacgaaaaaatactccgatttatattaattgatcaaaattgataaatttttctgtaaaatgagtaaaaatatgaaaaacatttgaacttttaagagaatatttcaataatggttatacggatgaagaaaaaatgaatgtcaaattggcgatgattcgtcgttcatcatccgctccaattagccgaatgtacagtggctgatgaatatcattgattttgcaattttttaacctctttttgaatttgtattaaatttgga

SEQ ID NO: 69176 - DNA, 537 bp, Heterodera glycines
  Genomic contig location: Contig_ID=SeqID_40952; Location=115..651; Strand=+
  SCN-specific regions: Sequence locations=1-60,84-465,489-537
agcccttgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatgggaacaaacctatattggactaccatacccaattaattatttttgggatgcgaattgttttgtgcgaaactgttatgaaaaaagggtacgaaaaactgggaaaaccccactcagagactagctaacaaaatcagcataggcttggacttccgtaccaattattatttttataatgggtgtgttaaatgcaaaacaattcacaaaagttgttataactccattcagagatgaaatagaaaaaaaacaaaaataagtttgaagagcccttgaagagctgcaccggatgcgagtgccgccgttgctgtacgctcaacggttgctgtgcaaagacggaaaattgcttatcagaaaaaacgaaataaaatcaggaatactcacgcccgtagacaaacc

SEQ ID NO: 69177 - DNA, 232 bp, Heterodera glycines
  misc_feature (123)..(123): n is a, c, g, or t
  misc_feature (191)..(191): n is a, c, g, or t
  misc_feature (194)..(194): n is a, c, g, or t
  Genomic contig location: Contig_ID=SeqID_40952; Location=773..1004; Strand=+
  SCN-specific regions: Sequence locations=1-232
ctcagagactagctaacaaaatcagcataggcttggacttccgtaccaattattatttttataatgggtttgttaaatgcaaaacaattcacaacagttgttataactccattcagagatganatagaaaaaaaacaaaaataagtttgaagagccctttgagagctgcaccggatgcgagtggccgccgntgntgtacgctcaatcggtgctgtgcaaagacggaaaattg

SEQ ID NO: 69178 - DNA, 1500 bp, Heterodera glycines
  misc_feature (1482)..(1482): n is a, c, g, or t
  Genomic contig location: Contig_ID=SeqID_40955; Location=1..1500; Strand=-
  SCN-specific regions: Sequence locations=1-7,36-341,376-425,505 -658,698-1294,1328-1464
  Gene Ontology: Mol. function=nicotinic acetylcholine-activated cation- selective channel activity; Cellular component=extracellular space; Biological process=synaptic transmission
tgccgaaaattttatttttgcttctgttgttgccaaatatattgtgctggataaatgaaaatcggagaatagaagaagaaattttgcgtaattatgaccgaaggcacaggttgaccttttgttttttgtttttgaaaaaggctcaaaaatttaggccagtgaaaagggagtcaacggtcactcaagtccaattgtttctgacaataaatcacattgaaaaagtggtgagtgaaaaatggaagtttaatttctgaattattttatgataattctcattttatattaaattgtttttcgtaaaattttcgaaatttggcacttttaacaattttttattcgtgttattaaaaaattaataaaataatttttaaaataggaccaatcggagggaacaatgctactgcatggcgttttatggtaagatgaattttttatatacatttttaatgttaaaaaataattatatttcatattttgaaatataaattaaataaaatttattaaggacttcatggacagatgaatatctgcagtggaacccatctgaacacaactacacctatgtggtttcgttggagacatggaaaatttggcagcccacttttgctctgtataattcggcacgttccactaattggttcgtctacatgaatggagtcagttttatttttagtaaaaattttctggaaaattttcatttatcaaacaattagcaccgtcaaattaggaggggggggggatcttttagatttgaaaattattttgttgtaatattagttaacttaagggtgttaggggtcgtttgtaagtaaccaattgataccaattttgaccaattccgacccaaactcaacaaaaaatcgaaacacgattttcgaatttggtttttttttttaaatttaggttaggaattggatgaaattgatgtagattcgtgagcagcaacccggaaaatcaccatgtacaattttcacttattaagtagcgcaaaattgtagttattcaaaattgtatcgcaagttggaaattaaaaatttgcaaaagatataccatcttaaaaagtgccaaactcaaaaagtgataaatgtcagcaaaatgaaaatctgatttacacatagataaaatattccacttttttcaccacaaggtttccgccactgtggcaaatgatggcaaagttatcgcggctggcactttcaccttccatgtgacgtgccaatttgacttcagtgcctttcccaacgatgtgcaggaatgcccaattgttttagcggattggatgtaaaatgccataaaagaatattagaaaatttaaaaggtttttaaagatttgataattcaaaagtgaatttgtccgggatggtgccacgttcaattggtggcattaatgtgaaaccagctgtacgccttagttttgatccgttgtcggaaacagtgaaaaagcatgtctcaggtggatattcgaatttattttttcattanatttttaaatattttaat

SEQ ID NO: 69179 - DNA, 528 bp, Heterodera glycines
  Genomic contig location: Contig_ID=SeqID_40956; Location=196..723; Strand=-
  SCN-specific regions: Sequence locations=1-55,77-113,135-157,181 -183,212-528
ctacccgattgaaataaaatggaaaaaaaaagcaaagtcaaaagacaaaataggaactttatacaaatttaaaaaagtaatatttttgtatattgtatatgcatttaatcaaatttctactttctttataaaatgttagctaattagtcagcgtctatttattttctgtaaaaatttgccctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggacaaaaaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattgaa

SEQ ID NO: 69180 - DNA, 62 bp, Heterodera glycines
  Genomic contig location: Contig_ID=SeqID_40957; Location=695..756; Strand=+
  SCN-specific regions: Sequence locations=1-62
atgccaatgccggacaaagcattgcccagcaaagtgatcggattcaaaagcattatgatcag

SEQ ID NO: 69181 - DNA, 733 bp, Heterodera glycines
  Genomic contig location: Contig_ID=SeqID_40959; Location=119..851; Strand=-
  SCN-specific regions: Sequence locations=1-611,649-733
atgccatcttttaattccgggttggttgcaggtgcagcgcttggtagcgccattggttattatgtgagaaaaaaacgcaataaaataggataatcttttctacagttagggagtcaaacaagcaacgacaatttggtgatccaggcagagcataaccacccaccggtaaacccgcgaggacgcggggaagcgcaggaggatgtgttcaacgaagtccgagaggctcttcgtggacaaggagttcatcagccgactatagagcagcaagtggagactgttgttgcattgagcgacttcattcgtcgcgaacttggcggagttggaaatgtaggaagcgacattgtcataacattgaaacttttcacatttcagactgaacaggtgagcaacgtcggcgagacgtttcagactgaaccggcgagcaacgtcggtgagatgtttcagactgaaccggcgagcaacgtcggcgagacgtttaagactgaaccggcgagcaacgtcaacgtcggggagaccaatcatgtggtagatagggtcgcatatgaagtttataatcttctaacttttataattaaggctgggaacgaagcaaccggcaatggcggtgaatgaccaccaaagaaggaaattgtggtgtgtaatagtgtgttgttatgtcgtgacatttgaatggcatatttgttctttattacatgcataaaattggtgcttttttagaagttatgcaaataaa

SEQ ID NO: 69182 - DNA, 403 bp, Heterodera glycines
  Genomic contig location: Contig_ID=SeqID_8773; Location=104..506; Strand=+
  SCN-specific regions: Sequence locations=1-123,152-403
atggtcccgtttcgtgatccaaaaactgttgccgagaagcgtttcaacactgctttatgcaaaggccgttcagttattgagcatgcttttggaatttttaaacggcgattttcaattgcaaagttataaagattttttttaaaattaaaaacgctatttcagaacatcatgccgtttgaagcttaggcggatcgcaactgccattctagcagccgctgttctacataatattgcaattgaaatgcgtttgcctgaaccaccagcgacggaagatttaaatgaaaatgatgatttaaacgaaatcaacaatgagaatgaaaatcggaatgccattttaaatgatcgtcaatcgcgccaagctggaattgagaaaagacaagaattggtggcccgttttacctaa

SEQ ID NO: 69183 - DNA, 304 bp, Heterodera glycines
  Genomic contig location: Contig_ID=SeqID_40964; Location=1..304; Strand=-
  SCN-specific regions: Sequence locations=1-262,284-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaagtctattgcgcaccgccctccctatcatg

SEQ ID NO: 69184 - DNA, 304 bp, Heterodera glycines; identical to SEQ ID NO: 51570
  Genomic contig location: Contig_ID=SeqID_40964; Location=507..810; Strand=-
  SCN-specific regions: Sequence locations=1-304

SEQ ID NO: 69185 - DNA, 101 bp, Heterodera glycines
  misc_feature (14)..(14): n is a, c, g, or t
  Genomic contig location: Contig_ID=SeqID_40964; Location=964..1064; Strand=-
  SCN-specific regions: Sequence locations=1-101
aaaattccctcaanaataaaaggtctattgcgcaccgccctcccctatcatgctcgagagcatttgtatgtgtataaaatttatcaaaaaaagagatagcc

SEQ ID NO: 69186 - DNA, 323 bp, Heterodera glycines
  Genomic contig location: Contig_ID=SeqID_40967; Location=259..581; Strand=-
  SCN-specific regions: Sequence locations=1-79,113-246,280-323
atttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaa

SEQ ID NO: 69187 - DNA, 720 bp, Heterodera glycines
  Genomic contig location: Contig_ID=SeqID_40969; Location=112..831; Strand=-
  SCN-specific regions: Sequence locations=1-244,266-720
atgttggttcagcacaaacatcgcccggcgatcattcccgaattgcaagcgcagatcactgccgaattggaagtggccgaaaagcacaaaaatatccgccgtttatttgcgagaaccttgaagggatgtgaaacggagaataatcaaagcggaataccaatttacgactttgaggagagggagtgcgaatatttggacgtgaagagggcattggaggaggacagagagaccgaaaaaaatagggacaaaaggccaaaaaaggaaactccggcttacgaaatttacgatttaaacgttatttacaaacgaaataacaacccgaaatggcctaatggagaagcattggacaaatatttgacggcaataattgaaatgtacacggaaaagaacaaagataatcgaagagagacaattgcgcgctctttggaacacgcgaaaaggcaactattggatgcggtgcattttgacgggatggtccaattggaggacggcgcctcacaatcagccgccgtcagtaatgcaccgtcagtgactgttaccccggtggtggaaaagcggcaaacggtgcaaacaaaggcgcctacggagaagacgaaagaagcaagtacacctttgaggtgtacaggtggaatcatttattgcctttcaattttcatattcgcgattaacagaggtcgaagcgacagcaacggcgactgccgggcaaaccaatgtggctga

SEQ ID NO: 69188 - DNA, 692 bp, Heterodera glycines
  Genomic contig location: Contig_ID=SeqID_40970; Location=732..1423; Strand=+
  SCN-specific regions: Sequence locations=1-75,97-115,141-177,199 -256,280-435,458-475,497-692
atgagtgaaaaatcccatcatttgttgaactgcttcattggcctgctggcgatgatgcttttcatcagcggaggcaaagcacaagagcaaacaacaccgtaagaagacaaaatgccagataaataaaaatgcaaatatttggacaataattagtgtcctcaattaagccccttgggcacatttttaaatgtttttaaatagtggccctgaatcttgagacaaacatggggcaagggacaagggccagaatttttagaaaaattcaggaaaaccctttttgcttggaaaccctggcattttccgaaaaaccgtagcgttaaatgccaaaaaaatttcaaaattatataaatttccaaaaaaatagcattcgtctgactggtggtgacacctctatgttctccattccaattgccacggtggaccaatgcatgccgcatgaagaatggaatacttttggcatcgaatttcgcctgccaaaacagggaggacactgtgatgaagggtacggtagatcagtggtagaaaattttcaattaaatttcggaaattcacagtatgctcatctgttacccgagcacattggcctaccatgatgtgaacaccgtccacacggttgacgaatttgcagtgcgctctgagctgtacaacctccgcaacatggtcaacaaataggggaaattttagtgacaaaa

SEQ ID NO: 69189 - DNA, 1061 bp, Heterodera glycines
  Genomic contig location: Contig_ID=SeqID_8775; Location=29..1089; Strand=-
  SCN-specific regions: Sequence locations=1-128,151-232,254-305,327 -778,803-888,997-1061
atgaagattcgaccgatggagaaacaatggaagtgagtgcaatgaatgaatggatgcgtttggtagggaatgcaccgcttaaatacgcagaaaattgcataaatttgtcagtcgttgttttcaaaaagtgtgtataaatagccaaaattttgagtcttttccatttttttttggttggttcgaattcattcaaattcactcttctgttctgtccattttcgaccttttgtcctttttaattgtaccattttttggacaatttaggttcgagttttcgatagaaacattaaagagcccccttaatgttttcaaaggatttttaagggcgtagaccaaaaaatagtgcattctaaattgttctccgatgattttgagttcttttccattttttgtttggttcgaatttcattcttcactctctgttcaagtcggctttactttatccctccctaattgaattatttgcaattaaattttagcgcttacacatttccctctctctgctctctgttgcgctatcacaacacaattccaattcgtcaacagcttcttcttccacaattccaattcgtcaacagcttcgatgaatttcaagggcattgtgggttggatgtgcgtggcagtgcttgcgttcgtcggtggagtggtgggttctgagggtcgggggaatcgctttttaatttcggacacggaaaccctatccccctttcagttctgtggcatcaattggatgctccattcgctcagtaagatttgccactatttttctgttcatgttaatgtttgtttcttttatttcagtgaccctgccgggcagaatcgaacggcgtgccggacggcgtgcacagtgggcgggggcagtggcgactaaaaccgatgcaaccggagcggcgactacgacgacgaacgcggcgactaacactgacgcaactggagctgcgactacggcgaaaacgactacgaccacggatggggcggcggcgactacgacgacgaatgccaacaacaatacgacccatgggaatgcgaccagaagcgcctcaaacagcgacagtgactga

SEQ ID NO: 69190 - DNA, 306 bp, Heterodera glycines
  Genomic contig location: Contig_ID=SeqID_8775; Location=1176..1481; Strand=+
  SCN-specific regions: Sequence locations=1-306
atggtcagagcaacaacggccaggacaagggcatcagcagcgcgagcacggagcatcaaaatcaatcgtcgaaatgccaagaaggcgcgtgccgcaattggacgagccggacatgtgagtgaagcggagggcaattaatacactaattaattcaattcggcaccttttttaaatgtgccaatttttcagacacgcaatgcgatggcacgagagaagtgcatgatgtgtctgggcaaagtgagctccatgacgcgtgtgaccatgggctgtgtgcacgaatttcatcgcaggtggaggcggggctaa

SEQ ID NO: 69191 - DNA, 2476 bp, Heterodera glycines
  Genomic contig location: Contig_ID=SeqID_8776; Location=108..2583; Strand=-
  SCN-specific regions: Sequence locations=1-153,175-204,227-554,576 -758,784-916,940-1045,1067-2210,2343-2476
  Gene Ontology: Mol. function=helicase activity; Cellular component =cell wall (sensu Fungi)
atggcggtacgaaaacgtcccccgtacgaaaacggcggtacgaaaacggcggtacgaaaatggcggtacgaaaacgtccctgaccgcaaaagttatgacaattttttttctcgaaaaacagtacgagttgggtttcgtcccttttttaatctaatataattttttcaaattttgcaggcttataaaaaacacttaggcttatcgtttgatatcaaaataatttatttggttgcaaaataaaaaaaaattagaaaacttcaaaattggcggcgccaaaatgtcccgcgtcaaagtgacccccgactctctccgcgtttccaacgaaatttggcagtataaaaggaacgaaatttacggccaattccacacacacaattcatttttatatttccgccttccgtcggctgatgcccaacacctttgccttccttcgttattttttgtcgccactccgttttttgaattagtaagtatttcaaatttcaacttaatttgcttactcccttctgggttttgaacctaaactcttaaaaaacattttccccaccaattaacaaaaacagcgaaaaaaacaatttttttttgttttcaaaactcatggaaaaatgtttctcccaatgtattttcggtttcgcgctgatcacgaatagggcacatccatttcgactaaactcgaacccccgggcgtgaattcgaacaaaaagtttgaaaacttcaaatttttcgagtttcgcatttttgttttcaaaacaacggcttaaaaacaaagaaacaaacaaaagtcatcaatgaaaaaaaaaattgttagaccatttttgagaccaaaaacacgcgattctaaatatttgagttttcgactgtttgttcgagttcgggcccggggttcgagattggcctaaatggaatgccagttttgtgaaaaactttctaatgacattttctggagtttccctaacttactttttttcaccccatgtaaaaatgccgaaaattttttgtataacttcccgactttttcacaattaatgtctttgcatttaccatatatcaattctccattacattttagctccgtatccctgcttctgtcttctgtataccaatccgtctacaatttggccgaaatgactgtggacatcgtcacgccgggcaccacccaaacagcgaccaggacaaggacgaggaggactgcttcacgccgtcgcgcgtcaacagcagcgcgttcggtgagccgtccctggcgctagtggtcggtcaactgcgtctaatgagacaactttaagaagccatcacatttttcggcacttttgctgtttggtgaatcccgaaaagacaaaaagtcttacacgcgctattttcgtgtttctctttctctgcttccactgtcccttgttatgagcggtagaagagacgcatacttttataagtaaagcaaaagcaacattttttttaaaactatgcgttctctacctctcataacaaggggacagtggaaacagagaaagagaattgtgcaaatagtgtgtgaaaatgaaattctctgtcgttctttttcgggaccctcttaaacagcaaaagtgccgaaaaagatggcttctgaaagttttctcaagctcagttggcccccgcttcagtccctcttttttgctgcaactatttccgtgtctcattttacgccctccccgccgttgttcagagagctcgtcgacgacagcagggcgcctcaaccaacaacagacggacagcgccagtgcgtggtcgaagcagcgcccgagcgcgtgtgagtgcagcggtgcgccgcgcgtcacgtcggcaggggaacaacaacgacggcgacgggaccaggacgaggaagaagcgcggctcggcaatgcgtcgtccgctcaagctcaaaccgctccttggacgaccgaagggatcgcgtaaatcgagggcggcgccgcgcactgctggacaaaagcgtggccgtggacgtccgaggaccgtgaaaaaaggccgtgcccgacgggggaagaacgctgcccagcagcagacgacgacgactgcggatgcagccaccaacactgacgcaaccggagctgcgactgtgacaacggacgcggcgaccactgcgactactccaccgacaacgacgaccgcggacggagcgacggtgaccaacgccaacgaacccggtgcgactacggcgaccaacactgaggcgcccgctgcgactactccagcgacaacgacgaacgcggacggagcgacggtgaccaacgccaacgaacccggtgcgactacgacgacgatggctgcgacgaccaatactgaggcgaccgctgcgacgacaacgacggcgattgcggatggcgcggtggcgactaacactgatccaaccggagcggcgactactccgacgacgaatgcggcgaccaacactgaggcgcccgctgcgactactccagcgacaaccgcggatgtggctttggattag

SEQ ID NO: 69192 - DNA, 52 bp, Heterodera glycines; identical to SEQ ID NO: 52019
  Genomic contig location: Contig_ID=SeqID_40972; Location=450..501; Strand=+
  SCN-specific regions: Sequence locations=1-52

SEQ ID NO: 69193 - DNA, 534 bp, Heterodera glycines
  Genomic contig location: Contig_ID=SeqID_40972; Location=501..1034; Strand=-
  SCN-specific regions: Sequence locations=1-117,144-347,369-452,479-534
ttattttttgcaaaattaattcataagtattttttcagaaagtgctctgaaacgcaccaaatgttaattaaaagttaaataaggctctctgatgctttttctatcaaaagggagatgaataaattttttaaaaatttttaattcctttttaaacaggccaaaaagtttaggcttatattttaaaaagtttcatcgaacctagcgcactaaaatctatataatctctccaaattttgcaggccttctccattgtaaaggactaacttaacctgaaaaaatgccaacgcttgttgtttttaaaatttttcaaaattctgactttttcattacttatttattattttgcaaaattaattcataaatattttttcagaacgtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacc

SEQ ID NO: 69194 - DNA, 49 bp, Heterodera glycines; identical to SEQ ID NO: 60106
  Genomic contig location: Contig_ID=SeqID_40974; Location=453..501; Strand=+
  SCN-specific regions: Sequence locations=1-49

SEQ ID NO: 69195 - DNA, 235 bp, Heterodera glycines
  Genomic contig location: Contig_ID=SeqID_40975; Location=758..992; Strand=-
  SCN-specific regions: Sequence locations=1-235
atcgtttcggggggactgccccgaaaacaaaaaaatcgatttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaaca

SEQ ID NO: 69196 - DNA, 480 bp, Heterodera glycines
  Genomic contig location: Contig_ID=SeqID_40977; Location=1..480; Strand=+
  SCN-specific regions: Sequence locations=1-183,205-347,371-480
ttaattctgcgttggatttttgctccccataattgtcctactaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaa

SEQ ID NO: 69197 - DNA, 703 bp, Heterodera glycines
  Genomic contig location: Contig_ID=SeqID_40978; Location=243..945; Strand=+
  SCN-specific regions: Sequence locations=1-625,648-655,679-703
atggtcatgattcacgtgttaattcaaaatcatgatttacgtgttaatttacggtcatgtaagtttaacttacagtcattattcacgtgtcaatttaggggttaattcacgtgacaattcacagtcatgatttacgtgttaatacacggtcatgattcacgtgttaattcacggtcatgtacgtttaattttcagtcattattcacgtgtcaatttacgggttaaatcacgtgtcaattcacgctcattattcacatgtcaatttacgggttaaatcacgtgtcaattcacggtcatgagttacgtgttaattcacgatcatgatttacgtgttaatacacggtcatgattcacgtgttaatacacggtcatgattcacgtgttaattcaaaatcatgatttacgtgttaatttacggtcatgattcacgtgttaattcacggtcatgtacgttaaatttacagtcattattcacgtgtctatttacgggttaaatcacgtgtttcactgtcatgattcacgtgctcaatcaggggcgaattaaaggtaacggtcataattcactatccataattaattagtccaaattaaagttgataaataattgaagactctaatacatcaaatttaaaagaattaaattaaaaggcatgaaatatatatatatatatatatataaattagtcataaattaatagtatga

SEQ ID NO: 69198 - DNA, 101 bp, Heterodera glycines
  Genomic contig location: Contig_ID=SeqID_8778; Location=486..586; Strand=-
  SCN-specific regions: Sequence locations=1-61,100-101
ctgtgccaagtgtatgggacacaaattcaacttggccaaagaaacggaacagtacggaaaagaggacgaggaggaggaggaagaagaggagcaggaggatg

SEQ ID NO: 69199 - DNA, 428 bp, Heterodera glycines
  Genomic contig location: Contig_ID=SeqID_8779; Location=340..767; Strand=-
  SCN-specific regions: Sequence locations=1-363,385-428
atgcgaaatgcgctaagaaacaatgcacagaatcggtggacaacggaaaaggacgaaacggacggaaaatttgtgataccctaccgaataacgggcaatttcagtgggtctaaaaagcactcaaatgaaataaataattaatcgaagcgaattaaaaaggaaaatttaattaccccaattaaattcaataaattaattttagcacaaaaggaattggcagtgattttcggagcaatggaagaaattgagcggaatacgtgcataaaattcaggacaaaaaggagcagcggaggaggggacaaagactttgtggacattcaaaacgaatacggcgaagggtaaaaagcaattcattaatcattaggaattgtttaattatggcatttaaagcaatagtttaaatggggccttcccaaatccaaattaaa

SEQ ID NO: 69200 - DNA, 857 bp, Heterodera glycines
  Genomic contig location: Contig_ID=SeqID_8779; Location=1183..2039; Strand=-
  SCN-specific regions: Sequence locations=1-18,40-252,274-647,670 -799,821-857
atggaccaaagggacttcggcacttttatgccaaaagttacgaaattaatgcttaaggaattgccggccgatttagccgcccttttgccttccaaagtcgtagcggatattaatgcattgctggccaacaagtcgctggactgtgctcagaaattggaaaagatcgacgaactgatgaaaacggtgccggacgaagtgatggaaaagctgccgatgccgccgcatttggcacaacttccggaggaagtccgtgccatgaaatagcaaaattccaataaatttaaatcgaatttcgtgtaaattgttaggtgcaagcccaaatcaagaaattgtgcctagaaacgaagcacaaatcggtggaagaaaagaaagaagcattcaaagcgtacgctggcactttgcccgcggaacagcgagcgatcatttgcaaggaaaagccatcatgtggcaaatgatagaaccgatcagaaatggggacggacggaggacggaaaagttatcagaggaaaatgcgatcagataatcagcccaatccattgtagtcaatttttagtgtaattaatccgaccaatttgtaacttttttgtgcaattggcaatggcttttgtcattaaaaaacaattttggaaaggaaattaagcacaataatccatctttttgtatccatttttgtgttgtgcaatttttggaccaagaaaaaaaattgattgatgatcttccctaattatttttttattttgaaagtttttccattatttaaatttttccgattcttttttttgcgtcatcccactgaacaaataataatttctttccaaatgaatgggaattttgctgaactaattccaattaataaa

SEQ ID NO: 69201 - DNA, 731 bp, Heterodera glycines
  Genomic contig location: Contig_ID=SeqID_8780; Location=316..1046; Strand=+
  SCN-specific regions: Sequence locations=1-87,110-389,411-592,615 -635,662-731
atgaatccatcccttcggcattctttcagcatcgaaaacattttaacaaaaagcgtaaattttgagaccttttctgagtaagtccgaaatgaaattgtttacaaaattttgtctgaattattaggccagaatttgccaacaaatctctccaacaattttcgccatcttttctattctcgtgagaaattgtttaaattattatgaaaattgaccaaaatattaaggccattgcttccgcaccatttcctcggccgctgttttgacaaagtgccaacatttgtcttagaaccgccgccaaaagcatttccaactgaatttagcagcgcattttttgagcggaataatggagaacgagaaggtgttagaagttagaaaacgcaaaatacagtaacataaatgcaaaaatcccacgataaacccataaatacggtaaagcacagtaatcgtaaggaagaagctgactgctgggcgcttaaaatgctgaaagcgataagatccataaaaagaaagagcggatgtgcctcgatagctcaatggtagaattgtccacggaatggggtggacgagtgggttcgattcccatgcgatgcctaacattttgcccatttcttatttaatgtatacatatcacaccgaaagaaatagaaaatataaatagaaaaatgaattcaaattttaaccgatgcttcactctttttgattcgtattttagtcgaatttgaaatatttaa

SEQ ID NO: 69202 - DNA, 596 bp, Heterodera glycines
  Genomic contig location: Contig_ID=SeqID_40982; Location=439..1034; Strand=+
  SCN-specific regions: Sequence locations=1-49,87-596
atggcaagtcaagcggaaatggcaaatttatttcggcaattaacggatgccctccaaaacattgcaacccaaacaaacccaaacccgaataaacaaaattccgacctattcactacaattaattcacaattgtctgagtttgtgtataatccggaaacggattctacatttgacatttggcatgatcggtttggcgctttcatcgagaaggacggacagcaaatgccagacgacatgaaaacgcggttacttttgggtaaaatgagttcacaggattacgcgaggtattctgagagtattttgccacaaaaaccaacaagtcggacaaagaacgtggcgatcaaattcgaagcaattgtcgaggagtgccgcaccattttgtcacttcgtagtgcagcggcagctctggaacaacccggccaaagtttcaatgccaatgcaattgctttaaaaccccaacaggcaaaagagcgacatagtcggcatcaaaagttcagtccttcatcacgccgtgaaaacagcggaaatcagtcccgctctccatcattgaacattcgccgatcatcaaattcgcgtccaccgttcccctgcaagtg

SEQ ID NO: 69203 - DNA, 783 bp, Heterodera glycines
  Genomic contig location: Contig_ID=SeqID_40984; Location=160..942; Strand=-
  SCN-specific regions: Sequence locations=1-495,517-783
tttgagaacagctcggtccgatcgtgttgcccttcgcaaacgtcgcttcatcggtgatctgatcgacattggcaaatttgcttttgatactggctgcaaattgttccacaccgtgatctgcgacttgggcaaaaaacggaagcgtgaggccgcctatggcaaagacgagccggcaccaaacccggcagcggtgaacgagttcaaagtcctgcagagcacccctattgacgagcttgtggaaaaggtgaagaaacagctgagagaagtggcggagaagcctggcttcaaggatctgagcccggtggaccaggaagacacacttttggatgcaatcagcgcagacgatcagtttatgaaggtaaaaccaattgttgggtggacgagccgatttctattgtttaggacctcgttagagaatctatcgacgattcagtggtacagctgcggaaagtgacggacgactttgtcacgtactctcatgcaaatttggaggggaggaaggccatgaagaaagtgttcgacgcctacgagaacacctacaagacgccgaagcagaagctggacaaagtgaagcagctgcaagcggaaatgtcggatgagctgcgcaacagcctgaagatgaccacggatcctgaggtgctgaaggaggcgtcgttcgccttcggcgatgtgccgaccttcaccggaatcaccaagagagtgtcggcgttgccgcccaaatacttgagcatcaaaggccatgaacaatgcgtggacaagtacgtcgtgtacggttggcactag

SEQ ID NO: 69204 - DNA, 560 bp, Heterodera glycines
  Genomic contig location: Contig_ID=SeqID_40986; Location=2..561; Strand=-
  SCN-specific regions: Sequence locations=1-72,160-352,388-560
atggcaaaattaattttgttggcgttggcctttctgagcatgtttggcattgtgtgcagtttggaggaaccgtaaaattttgaaaaataaaattcgatataaattttaaaaataatttaaaatagaaatttgtaaaaaataatttaacatataaaaaaacaacattatctacaatgtttaatatttttttggggtttcagcattcatttggattgattcagtttaattatcttttcggaaaagatgagatgattgaaaaaatttggattatgtgtaatttaattggccctaattaaatcggaggccaagtgaatttaaatttcaagtctttctttgttcgataaatttttggaatttttaattttaaaaatttatttttattttttagctccgtttgctgccaccagtgcggcaaagagtttttggaatgccaaagcacgtgcaaaccggaggatcgggcgggcaatgtggaatgtcctgagtactgcaatttcgggttggaagactgctcgcgcgataagtgtcgtaagccatgccctcgtccgaaagaggaacactga

SEQ ID NO: 69205 - DNA, 1126 bp, Heterodera glycines
  misc_feature (37)..(37): n is a, c, g, or t
  Genomic contig location: Contig_ID=SeqID_40987; Location=31..1156; Strand=+
  SCN-specific regions: Sequence locations=1-173,195-200,222-338,374 -577,618-632,658-665,687-1126
atgcccactgtgttgatctatccgattgatgcgcacnaaaaattggatgaacaggtgaaatgtttgctcaaacgtgcctctggcgacgtgtcgtccacgacaaagaaattgaaggcgcaggtgagcgggcaaatacttttaaccaaaattaatcacttgtataacttttcatgtttttctatatttttgctaattaacctccctccccccttctctaaaaggatgccattctcgaagcattggagaccatcgaaggcacttccttccaatacatgaagcgcgaccaaattgcacgtctgatgaccaacaaaggcattttattggctcggatggaaaagtagaaaagataaaattaaaaacaaaatttaagatttttgcccgtttcagacgcgacgaggcgggccgtgccttctctgcagctgcacaactcgagctgagcgacacggccatgccatcgtcattcgcttccgtgtggaagcattgggccaattttctgggcaatctttacctggctaaccagtgagtttacttcacttttttcaatgagttttgattaattttaagacgttgctatttgaatttaaatttaaaaataaaataaatttttgaaaaattttcatagcagattttaaaatttatgataaattattaacaatgcaattaaaaaatttcaaaattcaccactttagctctgagagttcagcactgagcaccggtgtgcaggccatggcgtccactttggagcacatttcgatggtcggtgcgcaaaagtcgcgcacttctgtggccaaattgttgtggctgctcaaaattgcctccgcatgcccttccgaaaagctgatgaatgccgtggatgagctgctgttccgctacgtggacaccattcagccggcgaattggcttttttggtgggaatggcacattttaaaatgggcactgttttctcttaatttgcactaaatccaggttgaacgaactgatcactgatgttcaacagcggaggggtaacgcgatggccgagattctaaagcgagtcggtctcctgcagccgcaagaagtgttctgcgcattgcgcgtcgaacttgggccaagccatgttggccgttacatccaacaatgttcgtaa

SEQ ID NO: 69206 - DNA, 154 bp, Heterodera glycines
  Genomic contig location: Contig_ID=SeqID_40989; Location=107..260; Strand=-
  SCN-specific regions: Sequence locations=1-32,59-154
taagcctaaactttttggcctgtttaaaaaggaattaaaaatttttaaaaattttattcatctcccttttgataaaaaagcatcagagagccttatttaacttttaattaacatttggtgcgtttcagagcacgttctaaaaaatatttatgaa

SEQ ID NO: 69207 - DNA, 72 bp, Heterodera glycines
  Genomic contig location: Contig_ID=SeqID_40989; Location=816..887; Strand=-
  SCN-specific regions: Sequence locations=1-9,36-72
ttaaaaaggaattaaaaatttttaaaaattttattcatctccctttgatagaaaaagcatcagagagcctta

SEQ ID NO: 69208 - DNA, 1397 bp, Heterodera glycines
  misc_feature (27)..(27): n is a, c, g, or t
  Genomic contig location: Contig_ID=SeqID_40990; Location=336..1732; Strand=-
  SCN-specific regions: Sequence locations=1-313,335-416,438-1016,1038 -1099,1121-1397
atgacccagtttctcaatgacggcttngctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgttcaatgtggtactcattttgccgactctttgcctacccaatatggcagattggatgtgcaactgacggacaaaattagaaagataatttctgacattttgccgtccacattgttgaccgggattgttgatgtccaaaatcttacggcccaacacgatggaaatagctgcgggtactttgtgtgcctgtatgctgaatcatggcttatgaacaaccgcacatttgttctaccagatttatccatcaattatgaaaaaaagcgcattttgtggcacatcaatgagctgtatggctctgataatgtgccatatcatccaagggaaggggtgccaactccttacccaattgtctacagacatgcggatgaagcgcagtctacatccaaggccgctgagccaatggaaattgatgaagaagatgacataatgatcatcgggccacagatgagtggacaggcagttaatgctattctcacccaagcccaagtggcaggtgaaaaccaagctgacacgcttggtttggtgtcggagtcttgcgcaccgcaagagccaattgcgcaggcagacgatgcaatatttgtcagaccgaagacgccaccgaggcgatcatcgcggataggcagacggcaatcagcttcgattagccgttcgccttcacccgcaccgagacgcagcttattagcaaaggctgttgagaaagtcactgcatttacgcagcgttgctaccttgcccacaagggttggtgctgtgctgccgcagcagcaaagcattatccaggatattcaaattctggtaagcttggtgacaagaagtgctctcattgtggagcactactcttcccgcatgaggacagcagagtttgctgtcgtcaaggaagagttgttttgccaaagcttaacccgcacccaaaagagcttgaagagctcatcgtgtgcgacaaacaaccccgcgaagggaaggagtttgttcggaatatgtcgcggtacaataatttgctccaatttgcgagtgtttcggctggcaataagccatgccctgctggcggaccgatggcagtaattctcaacggagaattccatcgccgcataagcagcatgcaggctggcacaacccagatagtacccattgttctactagaaagaactgcatctgttttagtgaaaagtgctag

SEQ ID NO: 69209 - DNA, 75 bp, Heterodera glycines
  Genomic contig location: Contig_ID=SeqID_40991; Location=239..313; Strand=-
  SCN-specific regions: Sequence locations=1-36,58-75
tccaagtggggaattgaacccaggcgaaaaattatgaaagatagaaagtttaaccactacaccacatgtgcatgt

SEQ ID NO: 69210 - DNA, 2500 bp, Heterodera glycines
  misc_feature (5)..(5): n is a, c, g, or t
  Genomic contig location: Contig_ID=SeqID_8781; Location=1..2500; Strand=-
  SCN-specific regions: Sequence locations=1-341,363-804,826-955,981 -1005,1027-1156,1178-1447,1483-2388,2412-2500
ttccntttttctaactaaacaaaatgttatcccaattcacattttacccttttcagttatgtttgcgccactttcatttttgaatcgatggcaattgcgttttgcgaagggcaccgcctcgtgagcaattgcaggagggtgcctttgtggtggaggacgatgtgccgtcgagtgcggacggggaaatgagcgaggttcgcgtaggaagtgtcgtggtggacgcggacggctcctccgaacaacgcttctatttcccggcaaaccccgcgggcgcatcggcgtacattcagtcgcaaaacgaacgccgcgggcaaacgccgaccgaatccgatttcgaaatcgaaaggagaatcgaaattgtaacgcaatgcgattttggcttaaaaatattacatttgcttgtcagagtgaaatggcccatttgtttctgggacagtcgggcaccattctctcctatcttttgctcaccatttatctgttcggcgacctcgcggtgagaatttgcatttttaatttcaaaagcctgaatcatacatagttcaactaactgccataataaatattaggatttggttctctctcagttaatgtaacagaaaagtatactttgggaaaagatgttttttatggagaaaatgagtgtcaaatttcaaattgtcgggtcggagaaacattttctttgccccaattcacgcttttttctcaaaatcacttgcttttcagtcctaaatttgcctttttccaatgcttttgctttatgttcgtccccattctttttgggtactttcccattatgagaccacaagccaaaattttaaaaaatcaacaaaggtgcgcggttgcattactttggaggcataaacataaattgctaatttatgcggtgggaatgtggaatttgcgcgccctttgtagattttttaaaatttttgcttgtggtctcataatgggaaagaacctctttttgccttctctgctgatattgccccttttctcaggtgtattcctccactgtccccaagtcccttatgaatgtgatttgctcttcgctgaatgtttctgccgtttccatcagtcccttctccccgtgccattctcatccaaatgatcttttccattcgctcagtcgcttcgccgtttatcgcatttgcatcttcgcttttctcctcttctgtctgccaatggtttttcccttttattccaataaaattgctaattcttttgttcagattttgatgggaatcactcggacgaaatggcttcaattggccacgactctttcgagatggacaggcgagaaaacggggggggggggattattaattggtgaaattgtatcaatcacttaaaaattgacaattttaatgtaaaatcttttaaaatatttcgtccttttttgattttttcctccaaaaagttaaatttgctcatttcggatcgcaaatccatttataaattttacaaaataaaaaaaaattatttcacggcaacgccgtttttcgaaaatttttgacgaggaaaaagaaaacgtcacacgccgaggacggcactccgtccgagtcgtcaaagtatgggatttccctgcaacaaagccgagaattgggtccttaacacaaaccatgggcccaatctcacgccgtttgttgccaaacaattggaaaggggcaaaaggtgctttcagccgctgggcatttgccgtaagcgaaaagcaaatttgttcccacaatttacaattttattaccaactatttggttttaaatttatcctacatttgcgttggtttagcctttttgctgatgattgtcttggccatcgcccaattggcccacaacggcccaaagggttcgccggcacctgttaattttcacggcttcggatctttgttcggcgtcgccgtttacgcctttatgtgccaccattcactccctgctctgatcaccccaattaggcgagtgccttcgcccaatttgctcacattttgccctgttcaggaataagcatcatttgagtgccaaattgacttccgtttactctctcgttttccttttttactgcgccctttctttgagcggtgccttcacttttgcgcatgtccaagacatttacaccatcaattttctcgtccgtttccatccgttttctctcccatttttcctgtattttcgcttcctttcagcacgacgaacaaacgggcggtcttctgagactgaccgattactttttggcactgttccccgtctttatgctcacttcctcctacgtaattgtggccattacgctgtgcaataacatccgcgtgctcggcactttgtttgaccgttgcaaaagggtcggggggacggacggaagagcgaagtgagtgaccgatcggagaagggatgccctaattggctttgggttcctcttcttcgtaattgatggtgccctccttttcagtgcttcttccgtcaatgaggagagtgaagcgcttttgtccgactttgcccacccaaattggca

SEQ ID NO: 69211 - DNA, 315 bp, Heterodera glycines
  Genomic contig location: Contig_ID=SeqID_40994; Location=1..315; Strand=-
  SCN-specific regions: Sequence locations=1-315
ccggtcaccatgtccaaccgtcagcacaccaacgttttggagctgttctttcgccgaccccaccaccttcggcttatccgtccgctggtgtcgtcatctcttccaaagtcccgtcattctttcgcagtgttccgcccgcttccccctttgtttgtcccgcacctccttcggttgttctctctcaaccgcccccgatgggctctccactgccccaacgggcgcagctgagccgtgagcagttgctgagcaggcacagccgagacgtggaggcacgcaaagtcacggtcaaactgtaccacttgcagcggacaatca

SEQ ID NO: 69212 - DNA, 132 bp, Heterodera glycines
  Genomic contig location: Contig_ID=SeqID_40995; Location=1101..1232; Strand=-
  SCN-specific regions: Sequence locations=1-19,41-132
ggacctaccttttccactatttttacaagttttttgccttaaaacggccaaaatttggtcatttttaatgaaaaagtgcagttgttacccagcagtggaaaaaaagttattggttaaatagcaaaaaaaaaa

SEQ ID NO: 69213 - DNA, 687 bp, Heterodera glycines
  Genomic contig location: Contig_ID=SeqID_40996; Location=375..1061; Strand=+
  SCN-specific regions: Sequence locations=1-17,39-74,257-338,390 -588,610-687
atgaaagtatgcttattaatttcttcatttgcatttttgattaccatcttaattagtaataattatgttggatcagaaaagaaaaaaatggaacaaaaaacatttgacgaaatatttggagaaaaatgggaagaaaaaagaaacgaagaacagaaaaaaagagaaataattggaaaatttaataaaataaaagagaaaattaagcaaaaaggaagaaaatacgcaagaaaagaatggagtaaaattgaaggaaaaatagcaaaaaaattgggcacaaatcgccaatatatttatgaatggatcaaagaattgggattaaatcaaaagaattgctacaaatcaaaaactgaagaagaaaagattgaaattatcaataaattcattgaaatgcaaaatgaatttaagcaaaaaagaaaatattcaagaaaagaatggaacaaaaattatgaagaaatttgtaagaaaatcggagttagccttttcataattaaaaaatggatgaaacaatttggaattagccgaaaaataacggagaaagaaaaaatggagaaaatgaaaatttattggcacataaaaaaagaaaagccgaaaatgagtgacaaagaaattggaaaaatgttgaaaattcatcaaaataccattggcaattggaagaaacaatttgtacacggactaatggaagattga

SEQ ID NO: 69214 - DNA, 1040 bp, Heterodera glycines
  Genomic contig location: Contig_ID=SeqID_41001; Location=17..1056; Strand=+
  SCN-specific regions: Sequence locations=1-187,210-457,480-1040
atgcaccaagggacaccaaacgtgccaacagtgtcgaacaacggaacatcgtttggacgaatagcacctccgggaatttcggacggcacaatgcaccaaggcataccaaatgtgccaacagtgtcgaacaacggaacatcgtttgggcgagtggcacctccgggaatttcggacggcacaatgaaccaagggataccaaatgtgccaacagtgtcgaacaacggaacatcgtttggacgaataacgcctcagggaatttccgacggcataatgcaccaagggacaccaaacgtgccaacagtgtcgaacaacggaacatcgtttggacgaataacacctcagggaatttcggacggcataatgcaccaagggacaccaaacgtgccaacagtgtcgaacaacggaacatcgtttgggcgagtggcacctccgggaatttcggacggcacaatgaaccaagggataccaaatgtgccaacagtgtcgaacaacggaacatcgtttggacgaataacacctcagggaatttcggacggcataatgcaccaagggacaccaaacgtgccaacagtgtcgaacaacggaacatcgtttgggcgagtggcacctcagggaatttcggacggcacaatgcaccaagggacaccaaatgtgccaacactgtcgaacaacggaacatcgtttggacgaataacgcctcagggaatttcggacggcataatgcaccaaggcataccaaatgtgccaacactgtcgaacaacggaacatcgtttggacgaataacgcctcagggaatttcgcacggcataatgcaccaaggcataccaaatgtgccaacagtgtcgaacaacggaacatcgtttgggcgagtggcacctccggggatttcggacggcacaatgaaccaaggcataccaaatgtgccaacattgtcgaacaacggaacatcgtttgggcgagtggcacctccgggaatttcggacggcacaatgaaccaagggacaccaaatgtgccaacactgtcgaacaacggaacatc

SEQ ID NO: 69215 - DNA, 82 bp, Heterodera glycines
  Genomic contig location: Contig_ID=SeqID_41001; Location=916..997; Strand=-
  SCN-specific regions: Sequence locations=1-82
cgaaattcccggaggtgccactcgcccaaacgatgttccgttgttcgacaatgttggcacatttggtatgccttggttcatt

SEQ ID NO: 69216 - DNA, 552 bp, Heterodera glycines
  Genomic contig location: Contig_ID=SeqID_8784; Location=877..1428; Strand=+
  SCN-specific regions: Sequence locations=1-137,159-234,336-374,396-552
atgtgtacttatcaaagaatgtacttggaaaaaggaaaacagaaaccaaaaacagaaaccaaacaatgtaagtgtccttatcgcgttggacaaaaacaaacaaaaacaagaacaataaaaaaatttttggcatttatggcattttatgccttttcaaattttgccacatttttgaaaaaaaatggtaacatgtgatttcgtcagtgagtgatttcgtcagtacggggttcgtagtaataataatattttttttacgaaaaaattttaataattcataaattaaattcgttcaaaatatattaaaaaatatgtaaattcaaaaataaagattatttgttcgattatcaacctattttcggccggtcacttacatataagcaaaataatttgtatttgagcctcgtctttgctacttttatctcctatatgttcattctagatggtcgtcagccattatcattctgcattaacctcgaaatttcgctttcaattttcttaacagtgttggagcgcgaccgcgagttttctgtccgcgttccacctctttcttaa

SEQ ID NO: 69217 - DNA, 910 bp, Heterodera glycines
  Genomic contig location: Contig_ID=SeqID_8785; Location=84..993; Strand=+
  SCN-specific regions: Sequence locations=1-534,560-600,636-910
atgtcgtcaaccaacagcaacaacaacgggagagcagttcaacaacaacagcaaaacaatggccgggaaagtgccggcggtgccatcaaacaaagggacggagcagcgaaagagccgacggcacagcttcagcaacaacaacagaaaattatcagtgagtttattatatatgtgtcgtttggtgcatggatgggagtatcaatgccaaaaagtaatcgaaaagcggcacttgccgtactccaatggcatagccggggttggggctgagggggctaagccccgccctcccccaaaaatataaattgaattcagccccccccccccgtattataaaaaagttttaggaattttgtgatcggcttgtttaccggccgagttttcggcagatttgtgaggttttatactgcttgagattgcccctcttggcaacattcccgataaaggaaagggtgccatcaagcatttcaacttttattggcatttctaagggaatcagtcccaacttaccaacgagttgctgttttgttttagggtcaaacatttttgtggcattaaatatggccattctcaaactcgagagtcccgacccgggcagcgcccaattaactaattaattaattatcacttaattaattgcccagcaaaaagtcaatggttggattggacacggtggagtcgttgtgagaacggtgaacgaattcgggtgcgcaaatgtttgagcatcaacggtggtccatgtgaggtcagttgtggtgcagggcgtggtgagcttaaaaaccccaccaacgaagaaaaaattgtattttagcatttcccaatcaaaaattgtccaattttaaaaacagaaagaaaattaatcgagaacgaagaccgagaagaaaatagccctgggaaaaagtaggaaaagtga

SEQ ID NO: 69218 - DNA, 930 bp, Heterodera glycines
  Genomic contig location: Contig_ID=SeqID_8786; Location=324..1253; Strand=-
  SCN-specific regions: Sequence locations=1-247,269-347,391-482,540 -575,633-735,757-797,820-930
aagcactcactttgcccatcaccgtggaacagttgcgcatctttgccaattctccaattgacgtggcggaggaagaacggcttgaccaggtggcctccccccccccccccacaatttgttcggagaccgaaagaatttggcccattaaattgacattttctgttttacgattaaaaaaacgaatagctagcagcaacattctttatttaggagaaaagtcgcaaggtgctggagctttaccgtggcaaaacggtcaaacagttggaggcgttgttgtttcaacagcagcaacagaatggtaatggttggtcacattggggtgcactgtgttctcccccccccccttcaaattaattttgaaaaaaattttagaatgttttttataaaaaacttcaataattttgaaacatatttcagcgttattgaaaatttttttgaaaaactaagtaattgactataaaatttgtaagaatcgctagaagattttttgaaaaaaaaatctttaatttttttttataaaaatttttctatttttatttctaaaatcctctaattggctattttagtgtctctgcatttttttataacaaaaattattaaaaaatattcataaaattgaattaaaataaaatccaagcaaaattgaaaaaaaaaactgaaaataaaggaaatccacttcctctgcaagaatttaaaaaatccaaaaaaactattttttaaggtggtgctgccatcaattgcaattgtgccaatgaattgaccaacggtgagaatggcactggtgcagtaacggtcaaccaacaccatcatcaccagcccaattgtgctgccatcgccacaacaaaaacatcgccgacagtggccacagaggccgtcgttgtggaaacattggcacaagcggtccaccggctcacccaacggcacgaagaa

SEQ ID NO: 69219 - DNA, 260 bp, Heterodera glycines
  misc_feature (221)..(221): n is a, c, g, or t
  Genomic contig location: Contig_ID=SeqID_8786; Location=1214..1473; Strand=+
  SCN-specific regions: Sequence locations=1-260
atgcgcaactgttccacggtgatgggcaaagtgagtgcttctgaagaggaaaaaccaattcaaaataattcaaatttctagcaaaaaaaagtaaaacaaacccgagcttggaatattccgaaagatttagtaaaacaaagaatacacatttggaaaaaggcaatgagaagcggagcaaattaaaaaaaactccctatccttattatgcaaatttttagaanaaagtgactaaatttgtcggaaaaactccgagcatgtaa

SEQ ID NO: 69220 - DNA, 593 bp, Heterodera glycines
  misc_feature (2)..(2): n is a, c, g, or t
  Genomic contig location: Contig_ID=SeqID_41002; Location=326..918; Strand=-
  SCN-specific regions: Sequence locations=1-118,141-184,206-227,268 -445,469-556,578-593
gntaagttagtcctgtaccggggagtatgcctataaaatttggtacgattttatagcttattgaaagagctagagccgaagaaaatttttttaatttaagcctaaactttttggcatgtttaaaaagcaattaaaaattttattcatctccctttttgatagtaaaagcatcagagagccttatttaacttgtacataaaatttggtgcgtttcagagcactttctgaaaaaatatttatgaattaatttttcaaaaaataaataaacagttaaaaactcagaatttctaaaaaaatttaaaatcaattacaattgtcattttttcaggtcaagttagtcctgtaccggggagtatgcctataaaatttggtacgattttattgcttattgaaagagctagagccgaagaaaattttttaatttaagcctaaactttttggcatgtttaaaaagcaaattaaaaattttattcatctccctttttgatagtaaaagcatcagagagccttatttaacttgtaaataacttggttgcgtttaagagcactttctgaaaaaatatttatgaattaattttgcaaaaaataataaa

SEQ ID NO: 69221 - DNA, 892 bp, Heterodera glycines
  misc_feature (8)..(8): n is a, c, g, or t
  Genomic contig location: Contig_ID=SeqID_41003; Location=45..936; Strand=+
  SCN-specific regions: Sequence locations=1-72,110-110,142-204,229 -360,385-424,446-483,533-703,725-736,784-892
atgggagncaaaaagattggccaccatttgaaacgtgtctttttatttggaaaaatcttcgcctatttttggtaatttaatttatttattaaaataaaagaattattaagtgagtggagcaaaggagaaaaatatgaagaaagtcacgaaaaattgtggaaaatatttgtaaataatttgtcggatttgaacaaaaattcaaacgaaaaacaattaaattttattaaaatgatggaaaatcttttgaattatttgcgaaatcaatcgccccaaatcagtgccgacgcccaaaggaactcaaaagaattgttggccaattgtgtcaatcagtttttacttctttgcgaaagcaatgccgagttttttgaaaattttcgggaattgtccaaaagtcgcgcagttttcaaagaaattctcgattttgcttccaaaggaatggaagaaatgcttcccaaccgattaatgaattggtttaatggtgggaaaaaataaaaaattaattaggaaaattaactaatttttaaataaaaatctagatcataacaaaaaccaaaaggaccttgaaaatttcggtgttggacgatcttttgctgatcgcatctttgagaagagtaatatcaaaaagtcatacgacgaatgcccaaaggaaaatatgacgaacaaagaactgatcagggctgatcagaaagcacaaagcaatggtgaaaaaatctttttcattaaattttaaatcctctaaatttttttaattaatcaaaattattatttattaaatgattttttgtttgtcagatcctgaggcttattacttgatgacttcttacattgacttcttgcaaacatcagcagatgatcggtaaattgaattttacgaattgccaaaaatctttaa

SEQ ID NO: 69222 - DNA, 652 bp, Heterodera glycines
  Genomic contig location: Contig_ID=SeqID_41007; Location=470..1121; Strand=+
  SCN-specific regions: Sequence locations=1-20,42-275,297-552,574-652
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattgaaaagagcagctcgagctctacaagaaggtatggaaagaaaaaatagttatttctgggactttttcagaaatcagaattaattctccaatgtggcccaaattttagggccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagattgtga

SEQ ID NO: 69223 - DNA, 1042 bp, Heterodera glycines
  Genomic contig location: Contig_ID=SeqID_41008; Location=47..1088; Strand=+
  SCN-specific regions: Sequence locations=1-85,109-571,611-615,639 -640,662-732,755-761,783-1042
ccaaagtgattaacgacaatgataaagctgaaggaagcactgggccttctgcggctaatcatcagcagaatgtcagtgaacaatacctcacaaaattggagcttgaaaaggtgagttaatttttttaaaaaaagttttgccaatttctttttttccgatggtttttcatctaaattccggttttcgacagattttatggtaccaaatttccagttgctaaatgaatttttccaacgaaattcggatttccggtttttaattccaaatcgacaaccatggggcttattgcgagaaaaaaaaaattgacatttaagcgaatttgttggcatattttggctctcccaagacaaaatttcaagaaaatttacctgtttttctgggaatttccctgtttggttattggctgctaaagaaacaatggcatttggtgaaaaaaaaaacatttttgtatttcagaggctgctcaaagccgaattgaagcaaagagaaatgatggaagagcttaaagagttgaaagatgccaacattgaacagcagaaaaaggagaatggtaatggaaaattacgataggaaattaaaaagtttaaaaattaataaattacaaattaaagaattaggtatttgtttttcaaaaagttcgctaattaaacaaaaatatttaagcgttcattggacaaatccaagagttgaaggatgaacagcagaagtgcttggacaaatatgaagcattggaaaaagaattggccagaaaatacagcaagcttttttaaaattaattgcttgcaaattttctttgaaaatatacgaagttatggttcctagggttttaacatatattttttgtgctggttttcttcactaaaaatacacgaaaaatccatttttttcatggtttcaatttcgcctatatttttgccgttttcgccccgatttcgacacttatttttggtgtttgttaaacaaatcttaattatttcccaatcaaattccgatccaaattcgaaaatcaatttttaattcttcaatttcattcgaaaattaa

SEQ ID NO: 69224 - DNA, 694 bp, Heterodera glycines
  Genomic contig location: Contig_ID=SeqID_8787; Location=1989..2682; Strand=+
  SCN-specific regions: Sequence locations=1-344,378-694
atgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggccgattttatagagcacaaaattctctacaatattcaaaaaaccgcatgtctctatgacttataccggctgaggtatgggcaagcgccaattcgaatcttaatggagtattaattattgctgttaattagtactaattaacaattaatttgcacctcctttttccgaagcggtgcaccaaaggtaaatggagtgaaggtgctgatgtccagcccagaatatgaggaagggaacgagtgagaccgaggattggatttggggggaaaaaggaataagccaaaatccgggccctggataaatgacctccccaaattggtaataccttggccgctctctagctcgcattcgcgtacggcgatgggcgagaaggagtaaactataagatatatattggccaatctcatgggatgataattgccccgcgctcctctcttgtctctcgtttttcgactatctcttctctccactgctacggtatagagtgcactctttccgtataaaatactcgaatttagtgccgttgtaagtcaaatagatggtaacaata

SEQ ID NO: 69225 - DNA, 517 bp, Heterodera glycines
  Genomic contig location: Contig_ID=SeqID_8787; Location=1..517; Strand=-
  SCN-specific regions: Sequence locations=1-2,82-135,163-172,196-517
tcaaaaaaaaatttgaaaaaaataaatttcagataaaaatatatatttccgaaagattaataaattaaattttaaaaaaatgcaaaacctaggctttttaataataacgtacgttctatagaaacctaacagatattctcattttttaaaatacaagaatttagtggataacaaattattatatattattattttctttggttgctgtcgatggtcaatagaaatggataaaattgctcattgcttgctggtctgctgtttattaataattttttttcgattgtacggactatggagaaaatgaaaaatgtataaattaacatttgttgcattaatcatccatcaatagggatgcgatttttaggcaaatgcctaaaatttttgcgcacttaatacgtacagataagcacgaacaacgcattttccgcttgatttggcgtgtctacgatgacttttataatgcctaactttgcctattttggattttttgtgcttaatgcctatttcgccgattttt

SEQ ID NO: 69226 - DNA, 74 bp, Heterodera glycines
  Genomic contig location: Contig_ID=SeqID_8787; Location=1831..1904; Strand=+
  SCN-specific regions: Sequence locations=1-74
ttttgtgacataaacatttatttgatttattttaccatattcacaatttgatcaaaatataggtggtcaaaagt

SEQ ID NO: 69227 - DNA, 1158 bp, Heterodera glycines
  Genomic contig location: Contig_ID=SeqID_8789; Location=203..1360; Strand=+
  SCN-specific regions: Sequence locations=1-395,417-432,469-588,640 -867,895-1000,1022-1028,1051-1158
atgactgaaaagggcataaattccaaaaaattgaaaaaaaatacaaaacaagcacaggttggaaactaaaaacaagaaaatttatcggggtctaaacccttggtctaggttaaaattttcatttttacctaaattaaagaatttttaattgccaaaaattgccggtccgtgcaattgtaatttttgaagttttttaaaaaatggaataaaataaatcgcaaaaccaaaaactcagatcattttttctcctcatcaatatgcctttttaagctattgagttcactaaaactggataccattatttgttgattattttttaatcctttttcttttctacattatctatttttcggaataattttgattccatatacaattgattatttctttgttgttgtattttacaaattatatattgcatatttgctacggaatattttatttattgtatatgtatttatttaatatgattttgcagagacttttagcatttaaagaagccgacatgaattatcttcttgccactattttgattcaacaatttatcattttagtatgtggtgcgaatgaaaaggtaaacttagattgattaattactttaattaatttttaaattattaaaatatttaaaaaaattaaggaaattattacattatacaaatttatgtgcaaagagttgactgaaaatgatgaagcaaatttatacagaaacactaaagattggcaacatatcaaaacaattatccacaatgagcaaattatggacaaatttgagactttaattgagtggcaaattcgctattcatctattgaacgttggttcaactattgtgaaaagctcaaaacatatatcaattctaaaaatggtatatttaaatttaaaataataaaataggaaaaaaatggattttttttaaatcagttaatggcgaagcattactaatgtcaatttcactgaagccaaagtttacattgccaaacggaaatggcattttgccaattgccaaggcaatggctaacattgttgaagcatacaaaaatattttcatgggaaactgtgaaaaaattttccgaaattgttacaaaaaaataattaagcaagaagaaaattcttcagaaatgaattttgaaaacaaagaagattcaatcaaggtttga

SEQ ID NO: 69228 - DNA, 836 bp, Heterodera glycines
  Genomic contig location: Contig_ID=SeqID_1167; Location=789..1624; Strand=+
  SCN-specific regions: Sequence locations=1-57,82-486,509-514,536 -547,579-836
  Gene Ontology: Cellular component=mitochondrion
atggactacggcttgggacgcatacgccgaagactctccaactatggagcgatgtcaccgacaaagagtgtccaggaggtgcaacccgtggctttgtcttgggaccgtctcaccgttcggcaatttcttggtaaaccagtcggagttgtgtcctctatgtcaaagattgtttcgactttcttagactacgtgtccggcaaggccgacactgaccaactcgtggcactaatgggcgacggcggagtgggcaaaacaacgcttttgaacactttgctgaaccgaaatttgaagaatctgagcatggaggaccaagtgctgatcaacgcgcattccttgggccaattcatcaattacgtcatcaaggtgagtcttagcgatgcgaagtgcggaggttcgtgattccttgactcggatattccccaaatagtttttcgaaccccttttattatccttataatttgcatccaatttcagtacgtgcaacatgacgacttgttcatgggcacgctgactatgaaggagcatctgatggcgcaggcacagcttcggatggtcggacacacccaacggacgatgcgcagacgcgtcaatgaggtgggatttgggggatggacagaggcagtagcaaactggaaatcatttaaggtaattgacgagtttggtctgcaagagtgtcgccacgagcccgttggattcagcggggtaattatcatttttttcaaatttacaaatacaatttttaggacaaaaagggcattttcggggtggtgaggcggcgtccgtttgctgttcgcttccgaacttatgaacaatccgcaaatcatttttgccgatga

SEQ ID NO: 69229 - DNA, 2262 bp, Heterodera glycines
  Genomic contig location: Contig_ID=SeqID_1168; Location=360..2621; Strand=+
  SCN-specific regions: Sequence locations=1-57,82-486,509-514,536 -547,579-1136,1158-1391,1416-1450,1483-1555,1582-1688,1711-1963,1992 -2101,2133-2262
  Gene Ontology: Mol. function=xenobiotic-transporting ATPase activity; Cellular component=integral to membrane; Biological process=transport
atggactacggcttgggacgcatacgccgaagactctccaactatggagcgatgtcaccgacaaagagtgtccaggaggtgcaacccgtggctttgtcttgggaccgtctcaccgtttggcaatttcttggtaaaccagtcggagttgtgtcctctatgtcaaagattgtttcgactttcttagactacgtgtccggcaaggccgacactgaccaactcgtggcactaatgggcgacggcggagtgggcaaaacaacgcttttgaacactttgctgaaccgaaatttgaagaatctgagcatggaggaccaagtgctgatcaacgcgcattccttgggccaattcatcaattacgtcatcaaggtgagtcttagcgatgcgaagtgcggaggttcgtgattccttgactcggatattccccaaatagtttttcgaaccccttttattatccttataatttgcatccaatttcagtacgtgcaacatgacgacttgttcatgggcacgctgactatgaaggagcatctgatggcgcaggcacagcttcggatggtcggacacacccaacggacgatgcgcagacgcgtcaatgaggtgggatttgggggatggacagaggcagtagcaaactggaaatcatttaaggtaattgacgagtttggtctgcaagagtgtcgtcacgagcccgttggattcagcggggtaattatcattttttttcaaatttacaaatacaatttttaggacaaaaagggcatttcgggtggtgaggcgcgtcgtttgctgttcgcttccgaacttatgaacaatccgcaaatcatttttgccgatgaaccgaacaaagtcaatttttggttgaaaattttcaaaaagtccccctttagagcctcgacttgtcggtggcggacagtgtggtcttgaaagttctgcgtgccctgacttcctacgggtgtacaataattttcaccatccatcagacttcgttaaatttttactgggtacgaattcgcgtaaaacttaatgttcaatgtggtcccgatccctcttcaatgtgtaaattatgacctttttatctaaaaattaaccccagtaatttgcattaaaaaaaatttgaagagaagaaacaaaaagtttgcacttatgccctatgccaaattctttattattaggcccattatttttgaaaaaacctggtttaaccagtttgggagaggccggactcgggaaccggctgcctaagaaaatctcggtctattcatgttattgactattttatttgcatttgaatttctggccatttgtagttgaaacacagcgcaagtgacgcattgaccatggactacggcttgggacgcaaacgccgaagacagtccaattatggagcgatgtcaccgacaaagagtgtccaggaggtgcaacccgtggctttgtcatgggacggtctcaccgttgtccatgccaaatcgggacggaaaattcttggtaaaacatgttggggttgcactcattgtgtatataaatttctaccttttacagacaatgtgtccggcatggtcgacgcgggccaactcgtggcactgatgggcgccagcggggcgggcaaaactacgctactgaacacgttactcaaccgaaatctgaagagtctgagcgtggaaggtcaagtgctgatcaacggacattcctttggccggttcatcacttacgtcagcggggtgagtcgttgtgattcaatgttcaggtgttgcggttcggaacctggattcggaaatcccttgggtttttggggcctcgtttttcgaaccctttttttcataataattttccacccaatttcagtacgtgcagcaggacgacatgttcatgggctcgctgacggtggagcatttcatggcgcaggattggatggtcggagacactcaacggacgaagcgcacacgcgccaagaatgttctggaggtgcaacccgtggcattgtcttggcacggtcttaccgctgtccatgcaaaatcgggacggaaaatccctggtaaacacagccgagttatgtccattatgtcaaacactgtcaagttttttttagacgccgtgtccggcttgaccgacgcgggccaactcgtggcactgacgggtgccagtggggtggacagaaccacgctgttcaacactttgctgaacaggaacttgaagagtctgagcgtggagggtcaattgctgatcaacgcgcactctttgggccaattcatcaattacgccagcggg

SEQ ID NO: 69230 - DNA, 199 bp, Heterodera glycines
  Genomic contig location: Contig_ID=SeqID_1169; Location=66..264; Strand=+
  SCN-specific regions: Sequence locations=1-199
atgcgcaacctcttcaaattgcccaagccggcaattttcaaaacctcaatcagctcccaaattgttagtcaacgaaaatttccattcaaaattaccatttagtgcaacaaaatcaacagcaatatggtcagtatccgtttgttcctactcctcttgggtatccgccggcgcctcagggaaatccgtaatttgttcgtcg

SEQ ID NO: 69231 - DNA, 907 bp, Heterodera glycines
  Genomic contig location: Contig_ID=SeqID_1170; Location=1599..2505; Strand=+
  SCN-specific regions: Sequence locations=1-232,261-575,597-727,749-907
atggccgcctttgatgcgaataacaatagccgtttatctccagaagtaaattttatttgcatattgcttagggtaatttggtctcagtttgttatcacgggtccggaggaattttcagtggaagaattcagaacaaaaatttatgagcatggaacttaatgtattaattctggttcggctgaattgtttaaaatttcacttcgtttaatgtttaagctgaaatccctatgagttttaaatttaccaaaaaataattttttggcgttttgccttaaagcttaatggaattcgttgtcagctttgttgcactataatttaacaattttctgtttaacttcttatgtacatccgagagttagaatccccgggtgagctccctttggttttgttaaatgcgcctcgttcttgctgtcgtccgactaagcatgttcggatttattaacatattacttttgcgttaaataaatacctattgtgattttttgagaaaggaaaaattttcaaactaatagtttgattatgattttggttcagtaacaccaattcaaccagtaaaattttaggaacaattccgagcagttttaaatctgagaagaactgcgcaacgccttacggtcgaaaactcgaggttggacagaatgaacgcgatgctggttgtactttttcagcgtcttacaggtttttttttttttggtttaccttggtgactaaaagtgcaaattttacttttattaaaaaatctaaaattgtgttgaatagaaatgtcgctttttcattgtttcattttactatggcatgtatggtcaatcatttatataatttcacaatattttcagcttttgccgttccaccggttgtacctgttgtgcctgtcaacgcgaacaataacaacagacacagctacaat

SEQ ID NO: 69232 - DNA, 222 bp, Heterodera glycines
  Genomic contig location: Contig_ID=SeqID_1171; Location=223..444; Strand=+
  SCN-specific regions: Sequence locations=1-72,95-180,204-222
atgtcaaccccaacccgccgggagttttccaaccgggtcagcaattgtttgacgacaattgtatgcgcatgatttttccaataagaaattttctacaaaaatttaatttgcagttgttgatgcttatcttcagaatatggacccgaactaaaagaaattcatccgccgatgatctttcactttattcattttaaaatatttaatgtgtgtgtgacaatgaga

SEQ ID NO: 69233 - DNA, 1415 bp, Heterodera glycines
  Genomic contig location: Contig_ID=SeqID_8791; Location=110..1524; Strand=-
  SCN-specific regions: Sequence locations=1-209,270-298,320-573,595 -691,715-1109,1145-1262,1303-1315,1337-1367,1400-1415
atgctaacgaaggggaaagtgtttggggtgggccacagtcgatggatgctgttgccttgttccccgtcccgcggggtcaaagtccgctgcttttgccacccgcgggcgcagattgctgcattattagcttgtctgtccattctttggactgtgaagtccatcaaaagcacatcaatcgcatttcctataatggtgggtttaagtttcgcttattaaaaaatattaggataaattttgtataattaaattaaaaaatattttgaaaaaatgtcttgtttcttgttatttatgccaaaacaaatttttttaatatatttttccattttgagacgattcatcagttgcataaaattgcttggtcggggacgcaacactccggccattttcgaacaagcgacgtgcgcattggtgacaaactttgcccagagtgggagaaagttgggggactaatggatggattggtaacacgcatcagagctgcggtggcgaatgatgacgatgacactttcatgaaaaacgcgataaaatatcacgtggagtttgtgagttaaaccataaaaataatagttttggctgcttttgagcaaaactgatttttaacattatctaaaatggtagatttaaaaaatccaacatgaatttacatcatcccaaatcgttgttcatcaaacgagttgttttattggccaatttcaaaaaattttcaagcattttcttaggtttgaaatcgctcaaaaatgtggctcttttcacaaatcaaacaattaatatagattagctagcagaattgtaaaaaaaattcttttcttttagctaaatgtgcatccttacatagacgccaatgggcgaacatcgcggcttttattaaatctgcttcttctgaaaagattggtgacttacatctatcctccaatatttaaaatgaacaaaaattttagaacttgtcatttgtccttccaaaaaacaaatggaaggattatgaagataccattaacaaagccacaattaaatctgatgaaaatcctcacccggcaccaacagcggcattgattttcttacgtggtttatccataatcatgaggagagcaaagacgagtaaagagacgaacatatattttaaaataaaaaaataataatatatattctcaaaattagagttgggtgggaacgggagtcccatcccttgggaaacccgggaatcccttcccttttttcgtttacatttcccataaattaaaaatgttggtatcaccttattttaaaataatcaatcccgaaaattcaatttattaattttttgaccattaataccaattttaatcatatcacttacataggtgaatggaagccgaatttgcgagattttgtataattaaattaaaaaatattttgaaaaaatgtcttgattaaataaa

SEQ ID NO: 69234 - DNA, 651 bp, Heterodera glycines
  Genomic contig location: Contig_ID=SeqID_8792; Location=666..1316; Strand=-
  SCN-specific regions: Sequence locations=1-133,156-299,322-407,429 -453,476-651
  Gene Ontology: Mol. function=ATP binding; Cellular component=signal recognition particle; Biological process=signal transduction
tttacaatatcttttcgttcatccgtccatgtttcagttgatcctggcgtcacaccgttccaaccggtcaaagggcggccaaatgtggtgatgtttgtcggtctgcagggtgccggaaaaacgaccacctgcacaaaggtttgggggcccaaaaccattgacagatttcattttatattttggatttaacccctcgggcgaattttgtaattttgggaatatttttgactgggcgagttaccttttatgttctacataacgaattcctcttgaccatttttttatacaaacgcttaaacggtttgaaaaattttttaccacgctccaaatttttaacaaaaaattaatgaaaaataaaaagaggtcacaaaaaccttttccttacaatttgcgactctgtgcctttgttcattattcatttgtctatttgcaatcagataatggcaccactactaaaaaaataataatattttttcatgaatttccgggcattattctagttacactgaggtggacccggtgatcatcgcagcgaatggggtggacaaattcaaaaatgacggcttcgaaatgattgtcgtcgacacgtccggacggcacaagcaggaagtggcactgttcgaggagatgcttcaagttttaaatgccgtt

SEQ ID NO: 69235 - DNA, 548 bp, Heterodera glycines
  Genomic contig location: Contig_ID=SeqID_8793; Location=164..711; Strand=-
  SCN-specific regions: Sequence locations=1-280,302-462,501-527
  Gene Ontology: Mol. function=ATP binding
atgattgttgtcgacacgtccggacgacacaagcaggaagtggcactgttcgaggagatgctccaagtttcaaatgccgttgtacgtacttttcaaaaataacccatgccatggggttggctcgtaaaaaatcgggcctaaattggagttcgttcctaaaaacttgactttcatcgctctccaccaccctttttggagtaattttagttttttaagactttgtcattaaaagttcacttttttaccaatttgtaaccccccccccctctccactcgaaatttttgagggaaaaatagtattttaggctgaaattttcggtttttcttgttcgtagcccttccatgatctgcttttcctggaaccgtctctggtttcctgccgtttttacgcgaaatttcctgggtattgggtttaaaaaaaaagtgacaccttttttcttggtcggtttttgtccctttatgatttaaaaataataatttttataactattaaataatttcagaaaccagacaacgttgtcttcgtcatggacgcctccattggacag

SEQ ID NO: 69236 - DNA, 804 bp, Heterodera glycines
  Genomic contig location: Contig_ID=SeqID_41023; Location=45..848; Strand=+
  SCN-specific regions: Sequence locations=1-112,141-289,314-376,398 -411,434-804
atggaatatgccgaaaaaggagatcccgaaatgcataaacagttgcaaaatttaattggtgcctttcatacactgagcggaatgaatcgttttcgaagtatattcgctcgcgtaaaatattaatttatttttataattttgccgtgctaggttaaattgaaatttaaaaaaaatatagcataggaaataaaattttcggactttttttctcacactttttaaaaaatcaaaagaatttttttttgaaattttgctgcctaacagagacaatctttaggattagcgaatgatactttatttcttgaaaaatattgtgacaatattgttcgtaaaaatgccaaaagagacgaaattaacaaaatatgctctctcaaatttgtttcgctaataaatttactaaaactgaaaaacaaaaataattaaaaatttaaatctaattagcagatttacaatatttaagagcccttttgggatgaacaacaatacaattccattcacaaattagtcatgggaagtgccaattattttcagcatcgttttggcattaatttggccgatttttcgcagaatccaacgcaatttggcgatatgaactcaaaaattgtgccattaattaatttggtgcgaaatcgtctgctgattgaagatgggccaaagcaacagaagaaggcgaaggatggagaaaaacaacagaaaaacaaaaaagatgggcaaaagcgaacgatgccaaaggagggggcaaacgatgccaaagatgatggagtcaatgggcattttaggaaattggccaaatggcggccgacg

SEQ ID NO: 69237 - DNA, 632 bp, Heterodera glycines
  Genomic contig location: Contig_ID=SeqID_41024; Location=839..1470; Strand=+
  SCN-specific regions: Sequence locations=1-351,373-397,426-544,580-632
atggagaaggcctgcaaaattaggagagattatatcgattttagtgcgctaggttcgatgaaactttttaaaatataagcctaaatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtattaaaaatttttagattttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagatttttattcatctccctttttgatagtgaaagcatctgagtgcctaaactaacctgtaa

SEQ ID NO: 69238 - DNA, 83 bp, Heterodera glycines
  Genomic contig location: Contig_ID=SeqID_41024; Location=1..83; Strand=+
  SCN-specific regions: Sequence locations=1-83
gatagaaaagcatcagagagccttattatctttaaattaacatttggtgcgtttcagagcacgttctaaaaaatatttatgaa

SEQ ID NO: 69239 - DNA, 152 bp, Heterodera glycines
  Genomic contig location: Contig_ID=SeqID_41024; Location=265..416; Strand=-
  SCN-specific regions: Sequence locations=1-97,124-152
ttcataaatattttttagaacgtgctctgaaacgcaccaaatgttaattaaaagataaataaggctctctgatgctttttctatcaaaagggagatgaataaaatttttaaaaatttttaattcctttttaaacaggccaaaaagtttaggc

SEQ ID NO: 69240 - DNA, 145 bp, Heterodera glycines
  Genomic contig location: Contig_ID=SeqID_41024; Location=590..734; Strand=+
  SCN-specific regions: Sequence locations=1-23,50-145
actttttggcctgtttaaaaaggaattaaaaatttttaaaaattttattcatctccctttgatagaaaaagcatcagagagccttatttaacttttaattaacatttggtgcgtttcagagcacgttctaaaaaatatttatgaa

SEQ ID NO: 69241 - DNA, 59 bp, Heterodera glycines; identical to SEQ ID NO: 52421
  Genomic contig location: Contig_ID=SeqID_41028; Location=148..206; Strand=-
  SCN-specific regions: Sequence locations=1-59

SEQ ID NO: 69242 - DNA, 59 bp, Heterodera glycines; identical to SEQ ID NO: 52421
  Genomic contig location: Contig_ID=SeqID_41028; Location=278..336; Strand=-
  SCN-specific regions: Sequence locations=1-59

SEQ ID NO: 69243 - DNA, 59 bp, Heterodera glycines; identical to SEQ ID NO: 52422
  Genomic contig location: Contig_ID=SeqID_41028; Location=408..466; Strand=-
  SCN-specific regions: Sequence locations=1-59

SEQ ID NO: 69244 - DNA, 59 bp, Heterodera glycines; identical to SEQ ID NO: 52421
  Genomic contig location: Contig_ID=SeqID_41028; Location=538..596; Strand=-
  SCN-specific regions: Sequence locations=1-59

SEQ ID NO: 69245 - DNA, 59 bp, Heterodera glycines; identical to SEQ ID NO: 52422
  Genomic contig location: Contig_ID=SeqID_41028; Location=668..726; Strand=-
  SCN-specific regions: Sequence locations=1-59

SEQ ID NO: 69246 - DNA, 59 bp, Heterodera glycines; identical to SEQ ID NO: 52422
  Genomic contig location: Contig_ID=SeqID_41028; Location=799..857; Strand=-
  SCN-specific regions: Sequence locations=1-59

SEQ ID NO: 69247 - DNA, 295 bp, Heterodera glycines
  Genomic contig location: Contig_ID=SeqID_41030; Location=893..1187; Strand=-
  SCN-specific regions: Sequence locations=1-295
aatttcgaatcatggtatcattcgaaagccctagatgtttagaagaaatttataagctatttctcagtgattaatcagctctcaaaaaagttgtcagtttaaaaccgcaaaaaaggcagaattttcaaagttttttatttctatctttttttatagttcgaaatttttgtaatttttagtaggctaatagagcctgtgaagagctttcgaatgatatcaagattgtttgattcggtcaataacttcaagagttatattgactcaaagttggctcagacggagttggcccgttccg

SEQ ID NO: 69248 - DNA, 601 bp, Heterodera glycines
  Genomic contig location: Contig_ID=SeqID_41031; Location=1..601; Strand=+
  SCN-specific regions: Sequence locations=1-4,126-167,202-236,310 -423,447-478,535-535
tggcgaattctgcttcgcaatgataggaagagccgacctccaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 69249 - DNA, 936 bp, Heterodera glycines
  Genomic contig location: Contig_ID=SeqID_8794; Location=421..1356; Strand=+
  SCN-specific regions: Sequence locations=1-127,149-401,423-599,642-936
atgtgtccgcccatccaaatgtgcacattggtgtgagttatctccaacactgccgaggcgttgctctccgtgaacagttggcgagtgcggtcctcattctaaacagttcattttcgactcctagaagaacaagtcggtggatgggaaagtcactccgtcgggtgtgaaggcgaatatgtgggcgaagttttggtgtgtgtagtgtggtatcgactctgaaatcatttaattctttttggtgagttaaaatgatattaattaaactgactggtgaacggtcagcaacgagccttggtctccatttctgggcgcaagacgtcgttgcacgggtttatcatccggcttaatcagatcgatgatttaactgactttgagtgattgtgcatttattggatggtcatttttgtttgaaaaatgtttcagcagcaggaattatacaacaatttagttaattttctaaaagctattttgtttgtacttttcagggtattttttaattgctataattaaaagtgaaacgatttgggcaagaaattccaaggaaacgttttgaggctgagaccccgaggagaaaatgttaagtaccgtaccactctcaaaaagtggaagaaagggcgggttttaatttaaaaaatgttataaaaccaaattatctgatcctattagtgttttttgtaaataccaataaataattacagtaatccaattagtcaaaaagccgtcaatgacataaccactgtcatttttggatcccatgaatttgtcggtccaaatgatggaatcggcctgtcaaatattttcttggtaaacaaaaagtaagccgggaaagcacagggttaggaagtccttggtccaacgacgagtcccaatagggaagggccaccgaagggtcaatggaacgaaggccgaattccaaactgaaggtgaatttggaaa

SEQ ID NO: 69250 - DNA, 778 bp, Heterodera glycines
  Genomic contig location: Contig_ID=SeqID_8794; Location=1567..2344; Strand=-
  SCN-specific regions: Sequence locations=1-107,129-224,247-306,328 -646,668-733,755-778
atgcgtattgttttgtcttctctaactctgatcattttcctctgtattttcaccgttagcggccaatcagctgaaaatgccaccaaatcggtgccacattcagtgccaaacggaaaggaaaagccgaactactccatttgtgccagatttggggccaacaagcagagagcgtgcagaataatggtgcacaatttgtttgagacgcgcaatgtgcgtcgaaagggcattttactacattttcatattggaaaaacatattgaagaacagaatgaatttataataaaattattgtgcaattccaattaattagttaattaactaatccaattatttacaataatgacgctttttaggccgaaagggagggaagggttgcgaaggaagatgatctgctcccaccatccatcaaaattggttcctttttgaattatttgccaaatttaggttaaaatttgtttttttaaaggtttgcccacttctgtgccctcttcacgagctgccgaacttttggatgagaaacccccgccaaattacaggccgaaaagctcgcttgtcttaacctcacctgcttctgctcatatgttgatggtaataataaacaaatacaattgtttaactaagctaattaatggttaaattctaattcaattccaatttcaggaatttcctcttcgcctgctcagtgctcaatcaatgggaaaagttatgggaaggcattgcgcatggaataccgaatgctcagtgatgagcaacgggaccgattcgtaagcaattaaa

SEQ ID NO: 69251 - DNA, 372 bp, Heterodera glycines
  Genomic contig location: Contig_ID=SeqID_8795; Location=614..985; Strand=-
  SCN-specific regions: Sequence locations=1-19,45-101,133-372
atgcaaagagacggtgtgccaagcagcgccagcagcagcagcattgcttgttcagagccgagtgtaattgtcagaagcacggtacctgtgctgtcaaatgagaacaaaaatgctgaaaagattagagaaaattatcaaagtgatgataatgagaacggcgaaagcagttgtgatgcttgtgaagctgatgaagaagacgacgtggaagagaatatgcaaaatgaagagagcggtgatagtggtagtgaagattcgcacgacaatgatagcgatggacactacagtgataacaatcaggcggagagtagtgatgagaagcggaaggaaacttacaaggaacatagtgatggtcattcgaggggaagtatctga

SEQ ID NO: 69252 - DNA, 1047 bp, Heterodera glycines
  Genomic contig location: Contig_ID=SeqID_8795; Location=1070..2116; Strand=-
  SCN-specific regions: Sequence locations=1-86,110-516,539-1047
atgagcgaaaaacttgcatttttcctaaaatcaactcaggaaaagcaatcttcacctaagctacggacgaaacttaacacaccgatggcacaaaaaacaaaggctccaacgaaggcagctaaaaatcaagcaattccaaaaaaccaaaagcacacggcttcgtcagatagacaaaaaaaagtgacagaaaagaaagcggtttctcttggcaatgataaattccgccgtcgacgacgtgccataacgccaattgactcttcgacaattcacgctttattaatcgctcttgctattctttgtatcactgtactagccttcagcagtgaccttaacccatgggcgattgttgcaattgtctttcttacacttaattctcaacaagcaaataatcggcccaatcaaattgccaaagtaattgctaatgttgcaaatcggatttatgggacgacagatcgtcacacagagcgagagccattgctcaacagtgatgatgagccgcacagaaatgttccacaaacacatggactacaagcatttcataggggtagttacacagaaagggatcgtcatggaaatgcccaacaagcgacgcctggtttattaaagcagcaattatctaccccagaatttgagtttaaacttgactactacccgccgaccaatcggaacaacaacaagaacagtcgcaccgctggtgaggcttctcatcaaagccgaccggctgctcctatcgccacgatggcattggcgaggagtgggaacaatcagcagattgaaaggtcggcatcaaacaaatcaacagcgagaagtgagagaagtggcaagaagatggaaagcggagagtgttgtgatgaggacggagagtgtggtggcggggacggagagtgttgtgatgaggacggagagtgtgctggtgtaagcagaacgagtagttggaacaatgatccgaatgaaagtgcggcatcaaataagttaacagcgaaaagtgagagaagtagcgagaagaaagagagaaatgacgactcggttggcacttctgcttattaa

SEQ ID NO: 69253 - DNA, 3236 bp, Heterodera glycines
  Genomic contig location: Contig_ID=SeqID_8796; Location=113..3348; Strand=+
  SCN-specific regions: Sequence locations=1-389,411-1138,1160 -2138,2173-2265,2287-2457,2479-2534,2556-2760,2782-3236
atgattagaaaccagcccaccccggcaacaaatgcgaatactgttccattgaatgctccaaatcgaactcaaaatcaaaattttcgtccctacggttctaatgcaattgttgtaaccgaaaaaaatgaggatgattcgccagtaatttctgtcgcccattttgaacaaaaagagactagggactatgaaaaattttttaatgctctttcaactcattccacggagttcccaacgaacaatcccgcacttgtcaaaacatcaaaatgtttagacatcacattaagcgttgtggaaaaagaggctaaaggcttaatggattcgggagctgaggccaacattgcaaaccctgaattcttataccaaatttcagtggaaaagggaattaatctcacagattggggattttgtccaaattctggtcccaccaaattgccattttcagttgcttcattcaatggcggaaatatttcagtaatcggtgtaattaatgtgccaattcgtaaaggaaatatcgaaagtgttatttcatgcctaatttcactaaaaccttttagttacgattttgttttggggccaaacgcattagacgcattgggttattatatcgggaacacaattacaaatgaaatcctgaattttacatcgaaatttcccactaaaaatgcacttctaaatactgtttacgtttcttcttttaaatctattcctccgttttcatcctgttttgtcgaatcattcgtcaaaacccaaaataactgtcaaaaaaggtcccaatttcttatagaaaacagtatgagcgaacaagaccttcttgactatgaatcggaaacggagcgtgatgaaaatgtgatggaattatgcggcgaggaggaagagaaaatgctcaaaaagttcgggattttggacgaaaagccaaaaattgtccgctcaaaatcagctccggaaacagacgatgtaaaagttcctattaataatttgatggtcgttgagcgggcaattgtcggatcgaaacgtggtaagttcaaaattctaattcacaacaaaagtaatgaacggatttttttggaaccgggtatgaaggtggcacaagctgaagtaattgagagagtttttgatcctttttccgaactaatgcccaaaagttttgatcaattgcttcttccacaaattttcataagaaacctttccaaaattgattcaaaaaacagaatcaatgatcttttttctattctcgatccgaaaacaggcccactttccgagtcggaaaaagaacaaatgcacgaagtctggtgtgaatttaacgaaattttggcgttagacgaatcagaattgacccaaaccggtcttataaagcaccatataaacacggaaaattcgaacccaatcaaaagtcctccaaggcctatcccatttggggtgagagcaaaagttactgaaatgatcaacgattatctgaatcgaggcgtaatacaaccatcttcttccccatgggcctccccaatagttttggttacaaaaaaggatggaactgttcgattttgtgtggattacagaaaattgaatgcggtaacagtaaaagattcatatccactcccaaacattgagcaaattcttatgtatttggggaaccgaaaatttttctctgttttagacttaatctcaggctattggcaagtcaaagttaatccggaggatgttcccaaaacagcatttactatgcccgagggactatacgaatttttagttcttccatttggtctttgtaatgccccggccaccttccaacgtttcatgaataatattttgggcgaatttgtgaatgattttgtctatcttgacgatattctaatcgcctcaaaaacgtttgatgaacatatcattcatctcaaaaaagtttttcaaaaactcaaagattttgaagtcaaagttaaggcgaaaaaatgtggtttcgcacaatccaatttaccgtacctggggcatattcttacaagacaaggccttgccaaggatcccgaaaaatataaaccgattttggattttccgcaacctaaaacaattaaacagcttcaaagatttttgggcatgactggttggcacagaaaattcataaaagactacgcaaaaattgcggcacctcttaccaaaatttttaagaaaaacccaaccaacaaatcttgggagtgggacgaaggggctgaaaaggcatttacaaatctgaaagaaagcattgttaaagaagttgttttaaaatatcctgattttgaacttgcccaaaaagacccaaaatacaaattccatattttctgtgacgcgtcaaaagaaggcctaggagcggttctttgtcaaagggataaatccgggaaattgaggccgatttgttatgcttcaagaaaatgtaataaggcagagtcaaattacggtcccacagttttggaatgtttaggaattaaattttccgttcaaaaatttaaacagtttattgcttggctcccaacaattgtcgttaccgatcataaagcacttccggggatgtttcggagcaaaaattcagttgggaatccgaaagttgaccgttggatcatggaattaggtgccccttttcaattggaagttgtttacagtccgggaaaagaaaattatgtcgctgacgcactttcaagagcattcccgaatgatgccctatttcaatttggtgataatgaggaaaatgagaacgtgacaatttcagtgatggtcattcaaaaaaataattccttgcccaaaaatagttcaaaagaagaatggttaaaagaagtcaaaaattcggaattaggctttatctttgaatttttggaccataaaatcttgccatccgatcaaaaacttcgccaaaaagttattggattcccttggaagatttactgttgatgacggaattctttttcgtttaaatgaacacatggaaactgaacttttcattccaacaaaattccgagaatccctcatcgcagaacatcactcaggaccatgtgcaggccaccagagcgggaaaaagatgtttaagcgactaaaagctttaaattttttttggcctaatatgtactccgactgccaacgtttttcaaggtcatgcagaatttgtgctcataatcgtgttccaaaaaaaaatcatccgggtttaaatccaattgttacaattagaccacttcaattagtctgtatggacattttaaaactcggtccaacacgtaatggga

SEQ ID NO: 69254 - DNA, 720 bp, Heterodera glycines
  Genomic contig location: Contig_ID=SeqID_41032; Location=396..1115; Strand=-
  SCN-specific regions: Sequence locations=1-403,426-461,501-720
atgaatataaaaaagggaaaaccgttcattggaactgaatgtccgctcaacgccacattcgtagacaatggtgaatttttgcgggtcattaatatcacggacaaggcaaacaatctgaaaaattaaaaaagtcgaaaactttagagattcatagatttaaaacatggatttattaagtcacttgagactgaatgttatttggaaaacaacatagaattaacttatataacttaatcaaaaaaattttagtgtgatttttttctacaagtctatttaataatttcgatttggtcagtttccatgagtaatattattgtcgttgaacaattagtgagggttttgtggaattatttgagttctaattagcaattattggaatgggaagaagtttttctatctaatgaaatcatttgcataagatttaaatataacaatttaatgaacatcattacaggacaacttatgaaaaatgatgccacaaattccctttatttttgttatcccaccgttcgaagtgatctggcacaaatgacagcgtaactgatcgggtctctctctatgatgcacgactcgctaaggcataacaatcgccgcgtggacaacgcattttgtcgggcctccgacgacgcgccgctggcgcattttgcagtgaatttttgcacattaaattccacgtaagaagcgagttgctcatccttgctgaattaaatcgaaaataaa

SEQ ID NO: 69255 - DNA, 905 bp, Heterodera glycines
  Genomic contig location: Contig_ID=SeqID_41032; Location=268..1172; Strand=+
  SCN-specific regions: Sequence locations=1-348,388-423,446-905
  Gene Ontology: Mol. function=co-chaperone activity; Cellular component=vesicle membrane; Biological process=receptor mediated endocytosis
atgcgcgaaattgcgatagaatttgtggttgtggaccttcaattggccagggattctctcagtttggacgattttatgctgactcgtttgggtctttgcaggtttcaacagacaaacacattaattgctttattttcgatttaattcagcaaggatgagcaactcgcttcttacgtggaatttaatgtgcaaaaattcactgcaaaatgcgccagcggcgcgtcgtcggaggcccgacaaaatgcgttgtccacgcggcgattgttatgccttagcgagtcgtgcatcatagagagagacccgatcagttacgctgtcatttgtgccagatcacttcgaacggtgggataacaaaaataaagggaatttgtggcatcatttttcataagttgtcctgtaatgatgttcattaaattgttatatttaaatcttatgcaaatgatttcattagatagaaaaacttcttcccattccaataattgctaattagaactcaaataattccacaaaaccctcactaattgttcaacgacaataatattactcatggaaactgaccaaatcgaaattattaaatagacttgtagaaaaaaatcacactaaaatttttttgattaagttatataagttaattctatgttgttttccaaataacattcagtctcaagtgacttaataaatccatgttttaaatctatgaatctctaaagttttcgacttttttaatttttcagattgtttgccttgtccgtgatattaatgacccgcaaaaattcaccattgtctacgaatgtggcgttgagcggacattcagttccaatgaacggttttcccttttttatattcattttcctttttatttttcagggattctctgctggctgcccttttggatggaattcgtg

SEQ ID NO: 69256 - DNA, 310 bp, Heterodera glycines
  Genomic contig location: Contig_ID=SeqID_41033; Location=609..918; Strand=-
  SCN-specific regions: Sequence locations=1-127,180-183,206-310
gagcaaaaacgcaaaaaacaaagtgctttccttaaaaaagcattacgtctaaagattggagcattatggaagcagtatagatcggagcgggcaaaagtggttgaggaatacaccgcggctataggtcaattaaatttagttttttttttttttaattttgattttaattacttatttttcagcgatcttgggaccacaagaaaatgtttggtcttcgcctgatcctgacccaaaagtgccatccacaagtgcagcttgggagcacaactacgtgccaatctcgccggattatgcggctactttaatgtag

SEQ ID NO: 69257 - DNA, 462 bp, Heterodera glycines
  Genomic contig location: Contig_ID=SeqID_41036; Location=80..541; Strand=-
  SCN-specific regions: Sequence locations=1-13,49-66,245-282,304-462
atgaaattattcctatttttctttttaattgtattatttttaattattcaaattgaaattggagcggaaaagaaaaaattggaacaaaaaacatttgaagaaatatttggggaaaaatgggaagaaaaagaaaatgaacagaaaaaaagagaaattgttcaaaaattcaacaaaattaaagaaaaaatcaaacaaaaagagagaaaatattcaacaaaagaatggaataaaattaaagataaaattttgaaaaaattgggaacaaatcgaaccaaaatttataaatggatcaaagaattaaatcttcaagaaataaaatcatataaatcaaaaacggatgaacaaaaaattgaaattgtgcaaaaatttatggcaatgaaaaatgaatataagcaaaaaggaagaaaatattcgacaaaagaatggcaccaaaattatgcagaaattgtgaagaaaattgga

SEQ ID NO: 69258 - DNA, 145 bp, Heterodera glycines
  Genomic contig location: Contig_ID=SeqID_41038; Location=1..145; Strand=+
  SCN-specific regions: Sequence locations=1-101,131-145
ttgggcctagttaagctgtcaaaaaaatttggagcgattgaaagagaatagaaagagccaggttcgatgaagttttggtaagccaaaaaaaaatccaaaccatttaaaaatctataaaaaatttaaaaatgagaattcatgcgag

SEQ ID NO: 69259 - DNA, 551 bp, Heterodera glycines
  Genomic contig location: Contig_ID=SeqID_41040; Location=304..854; Strand=+
  SCN-specific regions: Sequence locations=1-145,186-333,357-551
atggcctttgaagccgtgatggtgaaacagaactttccacaaggtaaggtccaagattcattgcaacgtggtggaatagtctgagccagcatttcagttgacgacgatgttaaatttaagatgaacaaccccgaaaacgccctagaaattttttaaatgatttaaaaaataattttattttttatggtctgtaaagtgcataagtaccttttttttagataagtattggtacataaatatttgattgtttttcaaacacacacatatatatgcttcacaggcttttgccttttttgtcgaactcacttgttcaaaggcaaatccgtttccgttatgcaattaaaaattatttttcagaaacattgtctcaaaatttgcaagaatggtatcgtcagccgaatcgacagttcaccagcaccagtctgaatccaataatgacgtgtcgacatttgacccaaaatcagtggaaatattgccgcactgctacccgcaagcgccaaggggggacgtcagagacaattaccacggcacaatggtttgctggtagctga

SEQ ID NO: 69260 - DNA, 913 bp, Heterodera glycines
  Genomic contig location: Contig_ID=SeqID_41041; Location=78..990; Strand=+
  SCN-specific regions: Sequence locations=1-20,42-275,297-552,574 -807,846-913
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccatgtggcccaaattttaggcccccagccacagccccttgcttctcccaggtttaagtcttggatttgtca

SEQ ID NO: 69261 - DNA, 975 bp, Heterodera glycines
  Genomic contig location: Contig_ID=SeqID_8797; Location=588..1562; Strand=-
  SCN-specific regions: Sequence locations=1-739,763-975
  Gene Ontology: Mol. function=protein binding
gattttgcccatcactgttttcgttacatttgtcaaaatgcgttcgaattgttcgaatctgacgaattcttgcaaattgatcagaatttgctgtgtgaattattcgaacgtgatcaattactgatcaacgatgaatatgaactttggcaagctgtaattttaacatatattttgttgtatttaaattatattgttcatttttaatttaggcacttcgttgggctgacgaaaagtgccgtcaaaagggtaatgtgtgttccgccaaaaagcgtcgtgctttgcttggcccggcactattcaaaattcgttttcctctcatctcaccggaggaatttaccaaaaacatcggtaacattttttttaaatgatagaaattattttgttatttttttgcagttccttctggcgttttgacaaacgatgaaattgtttccatttatcaattccattctcaccccaatctccgtggtgtgcccggccttaaaacattgaaattcccatggcatggacgaatttccgattggaacacagccaaaggcaacagggggacattggctttggaaattgagaaattttcggaatttgcgcgagaggaagtggggagcagacgatttagtgattatgaaatacgaataaatggatttggatggaaaatattggcagaaataaagacgaaggaaaaaagcactgatgagaaatgcctgggatttttcctttcgtgcaccgcttcgggaaaaggtgaagtcaaaattaagattttttgattacattacctaattttgattgccaaagatggaaattggagttgcaaatgttcggcaacccttcgaattgtttcacaaaagaacggaacgaaggatttgacgggaaaatatgaccatgtttttaagaaagaagaaaaaaactggggattcccaaattttattattttttcggtgagtttgtagccaaaacaccatttattggcttaataaa

SEQ ID NO: 69262 - DNA, 1753 bp, Heterodera glycines
  Genomic contig location: Contig_ID=SeqID_8798; Location=10..1762; Strand=-
  SCN-specific regions: Sequence locations=1-539,561-609,631-694,739 -742,764-1142,1165-1486,1508-1753
  Gene Ontology: Mol. function=protein binding; Cellular component =SWI/SNF complex; Biological process=chromatin assembly/disassembly
ctgttgtcaaatcgccggtcggcggtgactttgtcgtggaccaatgccgcaaaatgttggtcaaagagggcgtggatattgtgccctattacaaagtggcatccaaagtgcgcgtcttttggcactctctattttcggaagttaaaattttttaaattgcagaaagaggtcaaagaaggcgacgcgcccatttggacaccgcgtgccaatttgccggcggtgacgcaaagctatgaaaattttatgggctcagtgagtagcagggatgggccgaggtttcgcctttcgcattattcgcattttttggcgtttcgcatttcgctttttggcgcgaaatgcgacttttacacccctaagaattggattaaattcccatgaaatttttcaaaattttacctataaattggctaattttcagtgaaaaactgtttataaatgatcaaaatttccaatttttttcccgtagaaaattgcccaaaatcgcaaaatttggtaatttgatgaaaaactgttctcagcggcgcgccaaaactcttatttctcattagaaaaatgatacaaaaatcacaaaatttgatgatttgttggtgaaaatctgtcaacaattttaatcaaattttcaaaaattttcccggcgccgcctgccccctcttcccaaaaagtttttttggaaaaagcgcgcctcaaaaaagcgttttattgatttttaaatttttataaaattttaaaaaaatttttgctttatgattttaactattaaaaagttgtagaaaaaatttcgcttttcgcatttcgcttttttttttcatttcgcatttttcagtttcgcaaatttcgcatttcgctttttatttttcaatttggcccatccctgatgcatacctctatatagatgaacaacatatttcctacatattattgacgattttctggcgcacaaacaataataattctcattaggggtcaattccacaagaaaacatagtaagtacactatttcttcgctctctttttcttttctattttctctcagttaggcgtactatctcttcatttttaaatagaaaaaaacaacatttactcatttacttttcgctgcaatcttccacaaatataccaacaaaaaatctgaacagtgaaatgttttttgggcaaattaaggggttcctaaaaagttatgagctgatgaaatttgtctttctttttctctcgttttggtgtactatttttgtgtctctaagatcatgaaaaaaattttaatcaaaattttagcgaagaaattttgtttttttacctaattattaccaaataaatgtctctgccgtcatcggaatcagcgaatttgtcggatcggatgaaagtgttgctgagcacggccaatggggcggacattcaatttttggtgggagaggaaaaaaaggcaagaaaaattcaaaaagaaaattcattttttcatttatattttaattttagctttttcgagcccacaagcacattttgacgttgagttcggatgtatttgaagcaatgtttcgttttgacgcccaaaatgcaaaaagcggaggtggaaaaagcatttttcaacttctttttttagatttttcataatttttaggcccttccgctgatcagtcaagcctcgtgaaagtgcccgatgttgaagcagcagcgttcaaagtgatgctcagctttatttatgcggatgatttgagcgaattggacggagaaaacgcaatggctgtgctttacgccg

SEQ ID NO: 69263 - DNA, 112 bp, Heterodera glycines
  Genomic contig location: Contig_ID=SeqID_41043; Location=428..539; Strand=+
  SCN-specific regions: Sequence locations=1-112
gcatcgtaatgtcatcaaacttggacaaaaacctggagaacattcgccgaattgaccaattcgcccgcaaagtgatcgaacattgcacccatgcggcactgttcaatttcag

SEQ ID NO: 69264 - DNA, 938 bp, Heterodera glycines; identical to SEQ ID NO: 41044
  Genomic contig location: Contig_ID=SeqID_41044; Location=1..938; Strand=+
  SCN-specific regions: Sequence locations=1-223,251-938

SEQ ID NO: 69265 - DNA, 720 bp, Heterodera glycines
  Genomic contig location: Contig_ID=SeqID_41048; Location=430..1149; Strand=+
  SCN-specific regions: Sequence locations=1-131,167-720
atgcttcacaacacggtgattgaggtcatcgaccgagtgtgcaaagagatggcaattcgccagcacaaggatctcctcttcggagggaaaacagtcattttcagcggtgacttcaaacagtcgctgccggtcgtgcctcatgaaggcttaaccgctcaggtgacagcctgttttcaaacatctccattgtttggtcaattcaccacgatgaaattgaccatcaaccagagattgggcaaaggtcagcaagcgtacttgcaaatgtgccgccaaatcgggctcggagaaaccggagagcacttctggattcctccacagttcatcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgtccactggacatcgatgagatcgagtccgaagtggctgcgttgaaccggcgcacagactcgggcatgcccccgcacagtctccggcttaaagtcagatgcgtcgtcgtccttcttatcaataaaagtgataaggaaggactgatcaatggcacacgcatagttcaggaagaacttggcgatgatcgcctcattggtcgt

SEQ ID NO: 69266 - DNA, 90 bp, Heterodera glycines
  Genomic contig location: Contig_ID=SeqID_41049; Location=355..444; Strand=-
  SCN-specific regions: Sequence locations=1-90
atgacagagatcgaaaaagaaatgaaagcaatcgaaacgctactgggggaaatttctcatcatatggcagattggattgaagaaaagctt

SEQ ID NO: 69267 - DNA, 551 bp, Heterodera glycines
  Genomic contig location: Contig_ID=SeqID_41049; Location=585..1135; Strand=+
  SCN-specific regions: Sequence locations=1-104,126-288,315-327,350 -461,483-551
atgttcgaatttcttttaccgttttcaaaaggtcttgtcgtgcaaaatcggcaaaacgtaaaagttcagcacggagccattcatttccctcaattgcggttttaagccaacaccttaattttcgaccaaaaaatttgatacaataaaggaatgtttatgatgacctcaattattttgtttttccaatttcgtgaatcccaagaattatgtgcaataaaaattattaaggcattaaattatggaaaaccatatttcccccgcggattatgagggttgtttttaaaaaaattattttgagcttcagggatggattctgcccatatttgaatttttattatggtattttttacgagtctgcatccaataatgaataccgcaacataatatacaatctatacagttggcataatcgaagtgttaaatttgtaatttatgtccgtacccctgttcaggcccaatgcgcaatttatgaagctctttttcaatacgagtagtgcttaaattgtctccggcaactgtaaaggtaaagcataatatattttcaaatgcaa

SEQ ID NO: 69268 - DNA, 1469 bp, Heterodera glycines
  Genomic contig location: Contig_ID=SeqID_8800; Location=210..1678; Strand=-
  SCN-specific regions: Sequence locations=1-375,397-715,737-870,892 -958,980-1000,1022-1158,1183-1469
atgccggttgcgtcaaatttgctaaagacagtttctcgtgaaggacttaaggccggaaatcgagtgcttgaagacatttctcagggcaaagcgctccgagagtcaattcaagcacatgcaaaacatggtatggagaatttggttgaaaaactgagacaatgtggaatgggtgccgccaagactggtaaaaaataaagcaggtgctaaagaagccgctcttattaattctagatgaccttttaataataattgatgagaaaaacctgtctgaatcattcatcaaaaaagctcaccatcttaatatgggtgtgattttcataacacagaatttatttgaaaaaaaggtgaaggtagcccgaattaattcacagtacattgtcttaatgtctgctccgaatgccgcgctacaaattcgtaatttaggcgttcaactgtttccaaaaaatcttgcatttttcctaagtgcttataaagatgccactttatcaccgtatggatatttatttttggatttacaaccggcatcaaatccattgctgagaatacggacaaaaatatttaaagagatgaaaaaaaagcattgtatattcaaaatgattaatttacctaaaaatgttcttcaaaacttggattttttaaagaaattggcaaaaacaaaatcttttaaaaagatgcaagaaatatttaaagaagcgtctactgaacaaattggattattaattgaaattagttattatatattaaaggggtacttcccgctcacgaagagacaaaaatatagacttttaccatacgcaaattttgtaagaaaattagcaaaagttagactgagaagggtgcaaagaaagtttttcaacaaaacggtggtggttttttcgttaatttgtctcctttattattaccagtacttattgctgcgttaaaatatggagaatatatttattcttgttccttccgacttgtacaaaaatttattaaacctgagtctggcgagattaacgttgaaaatgctaaaaataaattgtcatcacttttgaagcagagaaaattagacgctacttcaaaaaatttaatttataatcaggaattgaggcgtttcttgaaactaaggaaggaaattgaagacaaacccgtaaaggttgaactcactgatggatctttgatggtgtttaaaccaaaacagcgtgaaagagatagcaaaataattcctacacaaattgttaatgacgaaggattggatgaaacaggctctattccaacacttgaagacccttacactactgctgaagagagtgatgctgagccaacaacatcaacaccaaagacgagaccactgataagaccaatgcgtgtaggaacaactaaatttcgtcaaaagcaaaagtcttttgtagtcaagaaaaaagttataaataatgaccctgagaaatttggggttggctctagaggacatatactgagagctgatg

SEQ ID NO: 69269 - DNA, 387 bp, Heterodera glycines
  Genomic contig location: Contig_ID=SeqID_8800; Location=2694..3080; Strand=-
  SCN-specific regions: Sequence locations=1-88,110-174,196-257,287 -348,370-387
cagcaaatcgaccgagcaaaacaactgctggaatacagacgtaagagatttgccgcattggaatttgaggcaaagaaacgtgatgaacagcagcaacagtcctccccgttctcttcaccaatctcagctgcattgaccgctggagaggcgttaaaggagcgaataggtgccgctcaagtgaaggagacagaaaagtcggatcaggataataataattcgatggaaaaaccaaaaacccacgctgaggttctcaaagaaaaaatacagcaacaacaacaacaggagataaccacggcaactccaacagaattgcaaatgacggtggcaaagcggcaacagactaaaaacccatgccaagcttctaaaggagaagatagaacaaaataa

SEQ ID NO: 69270 - DNA, 805 bp, Heterodera glycines; identical to SEQ ID NO: 41059
  Genomic contig location: Contig_ID=SeqID_41059; Location=1..805; Strand=+
  SCN-specific regions: Sequence locations=1-246,268-537,560-805

SEQ ID NO: 69271 - DNA, 131 bp, Heterodera glycines
  Genomic contig location: Contig_ID=SeqID_41063; Location=446..576; Strand=+
  SCN-specific regions: Sequence locations=1-131
atgcagatgttatacagtttagcgcagaaaatggactcatacttattggaaacttgtaagttcttaattctaagctttaatttgaaggttttaatttgactatattgtttgcaaggtttggaattgtttga

SEQ ID NO: 69272 - DNA, 333 bp, Heterodera glycines
  Genomic contig location: Contig_ID=SeqID_41066; Location=489..821; Strand=+
  SCN-specific regions: Sequence locations=1-214,236-333
atgcggtcaggttcaccaccactgactaacttttgcagtaataatggaaatccgccgtcacttccgcccaggccaaactttggcacagttcaacagcaaagtcagcagcaactctttgttggccaacaaccggcatttgtgccgtacaatgccagtggaatgtacaattacaatttgtgtgtattctgtggcgtttttcgacattgaattaccattttcaatttcagttatcaacagagtgctgctcccttcacaaatccatggcccgccattcactcgaaaaataattttttgttggcagccgaaggttttgataacattaggataatataa

SEQ ID NO: 69273 - DNA, 601 bp, Heterodera glycines
  Genomic contig location: Contig_ID=SeqID_41067; Location=343..943; Strand=+
  SCN-specific regions: Sequence locations=1-88,152-188,210-282,322-492
atggcaacaattcaatttttgaaaagcttaggcaaatgtatggcaaaggtgagttagggaatgccaacaaaatattatgatgataatgaaatatttacaatatttatttcttaatatttttaattatttctacaatttgaatttttaaaatgtccaatatcaaaaggcaaaaatccaaaaaaaaacatttaacattttaaaaagatcaacaaatgcaattgaccagcataatatgtgaagcggataaaatgtattgcattttggaggcaattaaaacggaagtaaaaattaatttattataattcatataaattttaatttctcaattaaagaaaccaatttgttgcaatttggcaaaaagtgatgaatacaattttattaaaaagcgtatcacattaattaatcacaatgatccgccgttgagccaagtgatggacactttaattgttacactaatgagccttaaaaaggcaatggaatcgggtaaaaagcaaataatatttttattttaataaaaaaaactcctattattttgataatttttaatataactttaatttaaagttaaaataattttttattataaaaaaacaaatttaaa

SEQ ID NO: 69274 - DNA, 1088 bp, Heterodera glycines
  Genomic contig location: Contig_ID=SeqID_41068; Location=72..1159; Strand=+
  SCN-specific regions: Sequence locations=1-12,34-372,400-744,766 -901,924-1088
atgggaacgactatagaaaaaatattaactcatgtttattatgatctccgttcgccggcaagctatgcaggagttcaaaaaattttacttgaagctataaaaaagaattcaaatataaaattaaaagatgttcaaaactttttagaaaaacaacgcacttacaccttgtttaagccaaaaagaaacaaatttaaaaggcttaaaactgtacctagtggattacacactgattggcaatgtgatctatgtgttatggatactttgaaagatcagaatgacggattccgttatattctcgtatgtattgatgtgttaagtcgaatgttatatgtttcgcctacgttatccaaaaagggtgatcacatgattgaagcatttgaaaaaatttttaaaaagtctggtgttttgcccaataaaatgtatagtgatagtggagtagaatttcagtctaaacaaatgcttaattattgtaaggaaaaggatattataaaaaaatgtaatgtacagccctcatctacatgccggcgttgttgaaagggcaaatcgtacaatcaaggaacggctttataaatattttagcgaaaaaaatactcttagatgggtggaagccgtcgatcaaatagcaaaaaatattaataattcggttaatcggataacaggtctaaaacctattggtgttaatttcaaaaatgctgtagcattacaacaaaggctatataaaggaaacaattctgcaaatatgataacacaacagataaaatttaaagtgaatgatatagtaagaataacaaaagaaaaaggaaaaattttcaaaaggttattacccaaattatactgacgaactttttaaaatcgaacgcgtaaataacacaaatcctgtcacataccgtttgagtgatttaaaaggtgaagaaatcaaaggaatattttacaaccaagaattggttaaaaccacagaacagaccacccatagggccgaaattttaaaaactcgtattacaaagggtgtaaaggagcattttgtaaggtggataggtcattcagaaaaacagaacagttggattcctgattcaaatcttattcattaa

SEQ ID NO: 69275 - DNA, 852 bp, Heterodera glycines
  misc_feature (845)..(845): n is a, c, g, or t
  Genomic contig location: Contig_ID=SeqID_41069; Location=70..921; Strand=-
  SCN-specific regions: Sequence locations=1-171,194-852
aaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgctactttccaaacatgcacgcgttttgcgctcgagctatttatcatcgggcttgtcaatccaaagcgaaacaacaaagatgctgttttgaacgaataaagggcatagtttattttgaagaagtgtccaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaatccaaagcgaaacaacaaagatggtgttttgaacgaataaagggcataggttattttgaaaaagtgcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataatcttcacgattcaaaccaattttcgttgctctaattaacctcgataaaaacattcgaatcaattaaatagcttctgagataataaggtttatcataaaatttcaattanaaataaa

SEQ ID NO: 69276 - DNA, 679 bp, Heterodera glycines
  Genomic contig location: Contig_ID=SeqID_41071; Location=216..894; Strand=+
  SCN-specific regions: Sequence locations=1-125,152-513,536-574,598 -651,674-679
atgacaatttcgttgcatcagacaaagggcgatgtgattgaccaattggtggacgctttgaagaaatgttgtgacaaaatattaaccgcaacggaagaatacaaataccccgtaaaaacggtgggaaaaaataaatattaaaaatatatttcgtttgtttatgttttagaatgtgattttcggcatttccgccgctttcgccgaccgcgatatttcgcatttgttgcccaatttgttcgtcgatgcgctttactccacgccgacttcgccccacggggatggcattcgaaagcggacgttgagcattgaggggcggaaactgtcccaactgcaagtgagcaccggtacgtttcacaaacaaatggtgaagcactttggcatggagagggcaataaatgcgagcctttggcatttgaaatggatgattcgcttattaattgcagcgggactagcggcactccaagagcaattcgggcacgagtacgcgctgacctccttccaagcgccgccggcggagaagcaaacccaaaaggaggaaggggcaaaagaagagacaccgaagacgaacccagcggaagatgaggaggaaaagaagacgaagacgaactcacagtcagcggaagagcaggaaaagagtacgaagacaaagacggaggaggaaagggagggagggcaatga

SEQ ID NO: 69277 - DNA, 132 bp, Heterodera glycines
  Genomic contig location: Contig_ID=SeqID_8802; Location=1108..1239; Strand=+
  SCN-specific regions: Sequence locations=1-132
atgaccttgcgcaatgatactccgatgcctccggacgaagaattgagagtgcctcatgagatttcgctgtcttcgccttggctaagggctgtggcggtttatatgggaatcgcctgcgagaaggaggccaaa

SEQ ID NO: 69278 - DNA, 511 bp, Heterodera glycines
  Genomic contig location: Contig_ID=SeqID_8804; Location=835..1345; Strand=+
  SCN-specific regions: Sequence locations=1-30,53-267,289-511
atggccccccaatccgtcgtctctcccccgctgccctctcgtccgtctcccccatggttgggcccgtcaccggcggaagaagtgaccgaggagctgaacatcgtaacaacgcccaaagtgatctcgaataattcgggcagttatacgggcggtcggccgaacttcggcacaccgccgatgccattgcatcacatttctctgccgtcgccccaggagatggcaccggtgacccgacagattccgccggagatggaacgcgagacgaatcggtggggcgggggaaatcgtacgaaacgaattcaaaaccaacgaaaaaatggaaactttggaaaaggaacggcagaaaatctaacgctttctaaaatgcacttttatgttcagatggcgtcagtacgctgctgctgtgctggtccatggccgcaagggaatgccaccgaaaagtttggacgaatacgaaaatgaggaggacgacgaggagttcagaggacgacggatgaccgtcacttaccgg

SEQ ID NO: 69279 - DNA, 572 bp, Heterodera glycines
  Genomic contig location: Contig_ID=SeqID_41072; Location=26..597; Strand=-
  SCN-specific regions: Sequence locations=1-102,229-572
atgaaattatttccgctactattagtaattatattatttttaattgtcaaaattggatcagaaaagaaaaaattgcaacaaaagtcatttggcgaaatatttggagaaaaatggcaagaaaaagaagaagaaaaacgaaatgaactcaaaaaaagagaaataattggaaaatattataaaattaaagaaaaaattaagcaaaaagggagaaaatattcaagaaaagaatgggataaaattaactcaaaaatagcgaagaaattggggacaaatagttgttatattcaaaaatggattaaagaatttggtcttcaaaaaaagaaaagttataaatcaaaaagtgatgaacaaaaacttgaaattgttcaaaaatttattgaaatgaaaaatgaatataagcaaaaaggaaaatattcggaaaaagaatgggaccaaaattatgctggaatttgtaagaaaattggcgtaagctatggaacaatttgcagatggaagaaacaatttggcattcgctgtaaaagaataacggagaaagaaaaaatggaaaaaatgaaaaaatattggaaaataaa

SEQ ID NO: 69280 - DNA, 278 bp, Heterodera glycines
  Genomic contig location: Contig_ID=SeqID_41073; Location=256..533; Strand=-
  SCN-specific regions: Sequence locations=1-124,152-278
atggattttacgacaatcgaagttaattatgtgagaaaaatgccatacttttttccattaatcattttttttctaatttcagaaatcgccgttttttgccctccctttttaccactctgagcctggagtaaaaaaggaatcctgggccactttccatgtcgaatttttcgacccaccggaaaatgagtttaacatttctcttctgcacgactcacccgaacacagcgaaaaaggcaagacaaaactttgaaaagctgagcaattaatggattaataaa

SEQ ID NO: 69281 - DNA, 519 bp, Heterodera glycines
  Genomic contig location: Contig_ID=SeqID_41074; Location=185..703; Strand=+
  SCN-specific regions: Sequence locations=1-192,216-519
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcgcgaaggattctgactccccataaatctaagggcatcggctcggggggactgccccgaaaactaaatattatcgtttttttctggtgtccgattgggg

SEQ ID NO: 69282 - DNA, 104 bp, Heterodera glycines
  Genomic contig location: Contig_ID=SeqID_41075; Location=862..965; Strand=+
  SCN-specific regions: Sequence locations=1-104
cgcatccaattccttctacaatcgcctttatacatcccattatgaacgctaaaattatcagagtgccgaaaatcgcatgtgatctaagccctagcaaaaatggt

SEQ ID NO: 69283 - DNA, 389 bp, Heterodera glycines
  Genomic contig location: Contig_ID=SeqID_41077; Location=343..731; Strand=+
  SCN-specific regions: Sequence locations=1-389
gcttaaaagcattgtactgcataattaaaagcgaaaataattttcgtatatttttcacaattatttcaaaaagcaaaaaaaaatgattcaattttgaaacgaaatagtgcacaaaagggaaggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaaccgaaaataattttcgtatatttttcacaattatttcaaaagacaaaaaaaaa

SEQ ID NO: 69284 - DNA, 225 bp, Heterodera glycines; identical to SEQ ID NO: 50965
  Genomic contig location: Contig_ID=SeqID_41080; Location=1115..1339; Strand=+
  SCN-specific regions: Sequence locations=1-225

SEQ ID NO: 69285 - DNA, 1258 bp, Heterodera glycines
  Genomic contig location: Contig_ID=SeqID_8806; Location=620..1877; Strand=-
  SCN-specific regions: Sequence locations=1-263,285-413,435-540,563 -577,599-1258
atgcgtggagcggaccaaccaacaattttctatggtaaaaaaggcggtgaatatgtgtgtataaattgtgttttcaagcttaaatgcgcatggaatcgcttcaaattgggttcagaaaaaccgcgttttggctgtgtgcgaatttccgggctcacatactggacaagaaatcgcaaaattgctggacaaaatcatcggtgaatggcaaattggtgatgagaaaatacattgttttgtgagcgattctgcggcgaacatgaaagcggttgatattgttttgttttcaattatttgctattttattttaggcattttctgagacaagggctgaggaacgaggcctaatgaacccacttttaccatttgcaaatgtgagctgtggtgcacatttactcaatctcgtcgttcaaaagagtatcaggcttgagaaaattgccaatttgctcaaacagtgtcgaaaagttgtctcacattttaaacattcaaacaaagcgttgggcatgctgcagaacattcagtcaattcttgagttaccggagcattcacttttacaagtttttactaaaaactttttgcgtctaatatttgtatttaggaaatccctgtgcgttggaattcggcgttggcaatgatttcacgtttgttagagcaaaaagatgctatttatcaatatgcgttcgagaatcggagttttgatttgacattagccgaagaagaatggaaacttattgaagaattaatttctttgcttcagccaatttaagaagcttcaaaaatgctcatgaaatcacctttgtcgggttaacaaaattttttaattctaagttaaatcgaatatttttagcccaaattccaattgctgtgacactccacagcaagttatttaatgccaaattgatgaacaaagaaatcgacagtgttcgatgctcgttggtcaatgagatcgaaaaatatttctttggcctacgcgaaaaacggttcataaacacatatttatttagttcattccaattttctgtgttttagtgttcattgcctatcaacattttttgacgttcggttcaaggacaaatttttgctggaacgtagaaacatctttctggcaaaaattttgacatggataaaagaagaaaatgccgtgttcattagcccgccaattacggaaattgatgagcttgactgtccaccgccgcctataaaaaaacaaagggcttctctgtttgacgaactcaatgaaattgcgtcatcaagcaataaa

SEQ ID NO: 69286 - DNA, 484 bp, Heterodera glycines
  Genomic contig location: Contig_ID=SeqID_41086; Location=201..684; Strand=+
  SCN-specific regions: Sequence locations=1-33,60-384,407-484
  Gene Ontology: Cellular component=cytosolic ribosome (sensu Eukarya); Biological process=protein biosynthesis
attgaactgcaaattgctctgaaaaactacgacccacagaaggacaagcgtttcagtggaactgttaggtaaatgatggccggcctttgttggtgtcagacagacccgaacccagggtctttaaaccgtctggggaggaaacaaaaagtggcaattcggtcactgtttccgttaaaaatggttcaaatttctggtgaaagtttgtttttgtctttttttttatccggattggtttattcaatttgttcagcatttgctttttagactgaagcacatccctcgtccgaaaacgaaggtttgcattcttggcgaccagaaacactgtgacgaggccaatgccaacggaattccatgcatgacagcggacgacctgaagaagttgaacaaggacaagaagctgatcaaaaagctcagcaaaagctacgacgctttccttgcctccgaatcactcatcaagtttgtgaaatgggttaaggatttgggg

SEQ ID NO: 69287 - DNA, 385 bp, Heterodera glycines
  Genomic contig location: Contig_ID=SeqID_41088; Location=259..643; Strand=-
  SCN-specific regions: Sequence locations=1-165,188-219,241-385
atggatattgccgctcaactgtcacggatcccaccaaagcattatcgttcagttgatctgatgaaccgaatcattgacgatgaagatacggaggaaatgggggcagaggacgaaggtaatcttgatacaattgatagaggaacctttatgctttacaatttgtttgtgttaatttttattttaagagcttgctgagtcggttatcaatgatcaaaggtctcccagcgattcgccagcactgcgaaaatctcctaccgattctccaattggccaaagagttttttcgatttcaccggctgagggtgcttcgtcaaacagtgttttgacctcaactgttcagcaacattctccggatgatgatgaagtatttgagacagctagctga

SEQ ID NO: 69288 - DNA, 395 bp, Heterodera glycines
  Genomic contig location: Contig_ID=SeqID_41090; Location=700..1094; Strand=-
  SCN-specific regions: Sequence locations=1-72,94-395
aacgaattaatcgaagaagttccatcatatttgactgatttttcaccaattgaacgtgccgaaaaagaaattaaaattctggcagaacaaaatgccaaaaatggacacattgaaattgagaaagtgttgcaaatattggcaaaattaattcttaaatttgatctcgacattttgataaatgagttcaatgccaaactttccaaaacaaacaatgtgaatgtgttaaacagaattgggcacaaatttactgaagaatggcactcaatttgtgccaaaattgtctcagaaaattctgaatattccggcattgaaaaagaattggagcaaaaaatgaaaaatttactgatcatggagcatgaaatttcgacaataaaatttgccaacatcatggaaaa

SEQ ID NO: 69289 - DNA, 499 bp, Heterodera glycines
  Genomic contig location: Contig_ID=SeqID_8809; Location=690..1188; Strand=-
  SCN-specific regions: Sequence locations=1-67,89-499
atgacaaaattggtcgctgtcagctgcgcaaaaggtatgttttgcgatggatatcgttactataaacacaaaaagaccaagaataaaatatggtggaagtttgagcttaaccattatggatgtaagggttggggttatgagagcaatggcgaatttattagcacgcgaagacataatcatcagccagattctgtcttacttcagatcgagagggaacagtagattttatattcgcctgaggcatgaattatatgttgctttttttaatgaacaacaggtttaaccaagcgcgtataaacactattagtgtccaaaacttcataatttacgatgttaactcataatacgtatttaacataatttacgacgttaactcataatacatattcgactatctcgttgaaccactcaagcaaacgaaattttgtcaaattaccttttttttgaaagtcaaaaattttccattttttggttaaattaatataaaaaatacaataaa

SEQ ID NO: 69290 - DNA, 1517 bp, Heterodera glycines
  Genomic contig location: Contig_ID=SeqID_8810; Location=427..1943; Strand=-
  SCN-specific regions: Sequence locations=1-438,460-553,575-1517
atgactttgatgaaaaaaaaattcgaggcacagcttatggacttactgaagttggacccgaacactccgctcaactcacacgaggcgggttttgaagcgacacaaacaaaccgattagtcaaataatggaaattctttttcagttggccattgcttcactcatgtgtcagtattttttgggctttgccgtcggtccttttgaaaatcttcgtttagcattttccgaggatgtcgcttcgttcgagaaagtgggcggctgttcttccattttggaacttctgaggcagaaagttgttgtccctcttcaactggcggccaacaagaccactcttccgtcgttgctgtacagtgcgccgaaaggtcgcctttgtcttatgaaattggaccagtaaaaatgagtgcataatgaatgcttttaaggaattcttctttatggaccaaatggttgtggaaaaactctgattgcgcgtgccattgccaaagaggtggatgcgtgcttcatcaattttggaacttcgctcgtcggtcggttgtggattaaaaacaacaatttaattgcaataattttatttttcagattttgtcaacggatcatccgttactatgaagtctctgttcactttggtcagtctttttttgaactttctgccaatccttccttttccaggcagagaaaattcagccgtgtgtcattttcatcgatgaaattggtgtgtttttcatgtttttgcaattcgcttttgttcttgtctcacagatttgctgttccatcgcagtcggaatgactttcagctgctgaagacgcaattcctcgcgcaatgggatgagtttgtgcgctgctattccgactgcaacgtgatcgtcatcggtgccaccaatcgtgtgctcgatttgggtgagaatgccttcaccacatccttcgctcttttgtacaatttcattgttttgtagatgaaacggtgttctgtcgcttttcactcaaagttcatgtccctttgcccgacgaggaatctcgcgagaaactccttcgtatgcttttggcacaagaaaatgtggatgttggcttcgactacgccgaggttgttgaggtgacgaaaaagctgaccagctccgagctgaaggaagtcatccgtttcgcattccttttgcgttaccaccatgtcgcactgagtcggctcaatgcgtgagttcaaaccgattctatagcttaataactaaatacccatttttcctttgctttaaggccagcttcactgcttgctgtgggggctcaactcgacaaccaaatcaaattgtcatctgaagacgtcatccaagcgtttcacagtttcaagaattatgcgatggcaccgttttccgagtcagtagtgacagaagagatcgttgaggtggattgatgctgttaagttttacggatgaatatgaccctatgtgttactctatttccctcatcaattcatttgatgtatctgtaaagtattttgtagtccgatacacgttcttttaaattaaataaa

SEQ ID NO: 69291 - DNA, 387 bp, Heterodera glycines; identical to SEQ ID NO: 52041
  Genomic contig location: Contig_ID=SeqID_41095; Location=319..705; Strand=-
  SCN-specific regions: Sequence locations=1-82,116-138,160-387

SEQ ID NO: 69292 - DNA, 327 bp, Heterodera glycines
  Genomic contig location: Contig_ID=SeqID_41095; Location=896..1222; Strand=-
  SCN-specific regions: Sequence locations=1-219,288-306
agctgctctactgctaacaaccccctgaccagtagtcaccttgtatacaagtgattttgcgccccgacgttccaccatggctcacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcg

SEQ ID NO: 69293 - DNA, 544 bp, Heterodera glycines
  Genomic contig location: Contig_ID=SeqID_41099; Location=230..773; Strand=+
  SCN-specific regions: Sequence locations=1-125,163-328,350-431,453-544
atgatggtttttaagtatcgacccagcaccgaccgaacgactgacggctccggtggttcagctacagaaaacagcggacagcaggtgaacaaaacaccgaacattgtttgttttaatacgatctcggaagaattaatttctttgaaatttaattttagaaagattcatttttagcatcagctccgccacgagcagcaaattgtcgttgcattagttggagtgttgcacgggcgcggaccgggacgaggtgcgcggggcgggcactctcgtggcaatcactgtgcaaagtttgacgctgatcgagaacagcttgggcaatcttaaatattttaataggtcaattaattaagttttgtgcgccattttccattgcaccacgggcagctgcgaattgtctccgtttttgttgctcccgtttatgttagaaacagtggaaaatttatcatttaattatttcataaaattccgtcgtttagtgaatcattggaataatttttaaacatcacaaaacatttgcaattttccatttatccgatttgtaaaa

SEQ ID NO: 69294 - DNA, 51 bp, Heterodera glycines
  Genomic contig location: Contig_ID=SeqID_41101; Location=520..570; Strand=-
  SCN-specific regions: Sequence locations=1-11,39-51
atgacgacattccatgtcctcctgttgctgctgtttgtgggaatgtttgtg

SEQ ID NO: 69295 - DNA, 1971 bp, Heterodera glycines
  Genomic contig location: Contig_ID=SeqID_8811; Location=1..1971; Strand=+
  SCN-specific regions: Sequence locations=1-468,491-776,818-874,897 -1179,1201-1788,1810-1971
  Gene Ontology: Mol. function=phosphorylase kinase, intrinsic catalyst activity; Biological process=embryonic morphogenesis
ccattcaaaaaataataggtggcttttttaaggggcagggcaacagccgagcggtttttaccgtacgtacgagccaaaagaggtgagtgtgtgcaaatcgtaacgaatccgatttgattacaacacggaatcggccatcgtcaggtgatcggccggggactcgcttcggttgtgaggcgttgtgtggagaaaggtgatttagggagaaccgctcgaaagcacatcttaacaatcgccattttcattttgaagagtcgaggaaggaatacgcagtcaaaatcgtcgatctgagcaccgaaagacagtccgaaagggaagcgaagcgcctaagcgaagagactttttcggaggttcgcctcctcaaattgttgtcgggccatccgtccataagtacgttcttacgccttcgtaaatttcctctgatttttctgcgtttttcagtttgtttgcatgagttctttataacgccaacatttgtatttgccattttcgagttggcacgctgcgaattgttcgaagcgttgaacaaatcggtgacattcagcgaaaaacggacgcgactcgtcatgcgacaactgtttgttctgattactttacataaagttgaaaattgtcattacgtttcaggtttgacggtgtccattatttgcactcggttagtcatttacaaagtgacgagaaaaaataaacgcgatattattttaatgatccaatgatgataaataactaatgatttctaaattttcagaaaagtattgtccatcgagatttgaaggttttatttttaaaagtcatttaaatttaaaaataatataaacgtcgttaaaacagctcgaaaacattttgtgtgttgatgacaaacgcgttgtgatcagtgactttggttttgccaaacaattggagccgggccaaaaactcaaaggtggacactgcatcaatttgcataactaatcagtgttttcattaacaaaacttttaagatctcttcggcacccccgggtatttggcgcccgaaactttgcgctgtcaaatgtatgaaaacgcggagggctacgggttggaggtggacgagtgggcacttggcgtaatcatgtacacactgctggcggggtacgcccctttctaccacagacaacagttgcgaatgatgcgactggtgcaggagggacgttacgaatttgacaaggaacactgggaaaacatttcggaggaggcgaaggatttggtcggttttgggaagtactcctctcaccaacaataattctcacaatccactcactaattgtgagaatatcttgtttttggaatctcaaaatttacgaaagtgcctgtatttccagacagtgaaagtcccctaatcatggctgatgattcacccacctgctttacaattagcattgatttaatttcaactaattgagtggtctttcgtcagattcggcgtctgctcatggtgaatccgtcagtcagaatttcgagttgcgactgtttgtcccatgtttggatggccgcttgggtcggcgttcccccttcccccgctcgaatggtggaacccacaccattcaaacgctcccctgaacaaatccgtcgccttttccgtgttgcacaattttctgtctgttttatggtgcggcttcggaacttcaagcagttcaaactcaaattcgatagaggttatcataaaatccggccaattgaaattgcagaacattcatttcttccattttcagctgcgcttagaacgcggccctaccggtccagggaaatacggcacgaagccgaaagtaaataatgcttttcataatttttaaaaggatttatctattgttacaggcgcttccttcgccatctacggacattgggtcaaccgcggctttttttattccagggatatgctttttgcaaacaaacctcgacctagatatgttaaaatgaacaacggaagtcgtgatagtaaaagccctcaaaaaa

SEQ ID NO: 69296 - DNA, 87 bp, Heterodera glycines
  Genomic contig location: Contig_ID=SeqID_8812; Location=215..301; Strand=+
  SCN-specific regions: Sequence locations=1-87
attgaaaactaccttaattgatttagctctacaccttttttcatgtcgtgtaaatatctgaataaaatatcttaatgcttttaaaaa

SEQ ID NO: 69297 - DNA, 2270 bp, Heterodera glycines
  Genomic contig location: Contig_ID=SeqID_8813; Location=1..2270; Strand=-
  SCN-specific regions: Sequence locations=1-284,306-666,688-759,782 -1364,1386-1521,1544-1741,1763-1765,1788-2067,2089-2245,2267-2270
  Gene Ontology: Mol. function=Rab GTPase activator activity; Biological process=signal transduction
tattcatttaagcgatttgttggttaatggattcactttaacccattttcgctttccttttagacccgggggttcaacaacaaatggccggtcaaaagtccaagtcactcatcgcattcgtgtgccggtgtcgattaaattcgagaccgtttcacattcgcacttcgcatcaaaaacggtccgtgtccgtgccaaaaacgtctcgtcaattaatcggtccctccctttcagagggcactctctcatcttcaatcgtccttatcgattctgatggtgttcaacagttttgcttttcgttctctcttgagcagcattgtttctcctttctgaagacgttggaaggcgcactttccccacttttcaaaatcgacccaccattaaattccattaaaatcgaatgcggtgccacaggtcgtctactaattggaattcggttttacttttccatttgtttttttagaaccatttgccgttgattcgacaactttgtataaagcgactgattgttctcaccaaaaaggacctctcgttgaaaagcccggttctgaattggtatttcgcattatttccttcgcttctccgagttttgaccagaaaatgccgttagaaaagcaagtgccaatgggaaagttcataaaattcgaccatttaaaaaagttttagtcgtccattttcgcgctcttccacgcaagaatcggcaaaatgcgaaggacaacaaccgaagatttctttacggttggccgaacatttaattggattttcttttgtctttaataagttttgattatgtgttatccatttaacttcagtgaatcgctgagcaatgcgaccaaagcgatgcaaagtcaaattttggccagggcattcctcggatggctcacctactcacaacacttgcgcaaaatccgactaaacttggcctccattgtgaccatcgagagatttatcccaaattcggacggaatggaaatgccggtgaacgaagcattttggcggatttgtcgttctgaaaaaacagtgagacaattaaataacacaatcagtcatttgctcacgctttgcagattgtccttttcaagcagttcctcaccagagtttacttttgtggcattgagccaactttgagggccaaagtgtggccgtatttgctgcgattgatcgaatggcacgaggattttggacgtcgcgaattggacgccatcgacgagacgtacagaaacgatttgaaagagtggacagaaatggatgcgaaattaatagctgataatgagcagagaaatggagtggatgaggaggaagaaggtttgtcatccgaaattacttttttacatcatcccatcaacagcactctccgactcattgtcaacccaccaaagtgaggaagacatttcccggcatttccctcccattggggctattggctcaatgaatagcgaagtgtttgaagagagcgacgtttatttggaagagaaaaggaccaccgacttttccaagaagagaaaggtgatggtgcatttatctaaatataaccaattggcacttttcctcctttaggcattttctaaggaattcgccaacaatttgctcagaatcaaaaaggacgtcgaccgttgcgatcgaaccaccaaattttactcatgccacgacaatttggacattttgcatcgcatcatttgcacgtacattttccgtcgactgaagttggacttggaggacggttacgtgcagggaatgtgcgatttggtggccccccttttggtggtatttcggcacgaggctctgacgttggcttgttttgagcgattgatgctgcgactgcgacggaacttcccacagagctcccaaaacaatggcggaatggaggaaaatttgaataattttgtgagtattttcgccgttcatatttttcattttgttttaatttttatcctttcagcgttctctggtcgaagtgatggaccccgagctgtactgtcagctaatgcgcaacatcgactattccttcgtcgttttctatcggtggcttttgctcgacttcaaaagaggcatcagaaaaaatgaattattcccaaaacaatggctaatttcctttcagaattggtttataaagaagtgttccaactttgggaagtgatttgggctgcggaaatgagctgttctcgtcatttcgaactgttttttgggctggcgctgctcagccaatacaggcaaatgggaaaataaaggcaaaacaattgccgaccaaataaataattatttagagatgttct

SEQ ID NO: 69298 - DNA, 1077 bp, Heterodera glycines
  Genomic contig location: Contig_ID=SeqID_8814; Location=43..1119; Strand=-
  SCN-specific regions: Sequence locations=1-86,108-349,371-532,554-1077
atggaaaacccgcgccaaaagccatcaaaagtattggcagaaatccgtgcaaacaccaaggacgaaacctttgtttccatgggcactgacctcgcactggtggcagtaatgagaaggttcttctcttttgatacgtgtattcctctttcactcttatttcaaaatttttaggcagaaaaggaagatttacggcaacatggaccgtgtcaaccctttgagtgttgtcttacccgatgccctgcttattaaggatggcgaaagcacattgttgtatgacagccgagcgcatcgccaaggagaatcggatgtggtcttggtctttgcacacccgaagttaagttcattcatttcatgttcaatttttcgcttttgttttcagctgttggacgttttgaagcgggcgaggaaaatttcagttgatggaacattcaaagtgtcaccagccgcatggacgcagtgtttcgtgatcggcgcttttgtcaaccggcggctcgcattatgtgtgcttttagtgaatttggaccatgtttatggtaacaatttcatccaattcggcatcccttcacctgttccatcaacgccaacaacccaatcgtcaacaattgtttccgtcgtgccgcgctgggagctgccaattgtgcgtccaccactgtaccctgtgcacttctggaatgtccacgaccgtgcgaagtcagcagtggagaaaacgaacaatgctatggaggcatcacacctccaattttcggttgtgcgatttttagtgcgagtttaatttggtttttaaaacttaagcgtggtctagtccatcacccatctttgtcagactttctagcagctattctggatgatgttgacaagcaggtggacatcgcaagatctgcccgagtgttcccgtacaaacgccgcatcaaatacattttgaaggagcaattgatcggagatgcattggacgaggcggagtacaacgccgacgaagacgtcatgaacatcctttcactgctgagtctgcagatgcaaggatatgtgggtggcctgcgtgcaaaaggggctcaacacgaacatgaggaccgtgaatga

SEQ ID NO: 69299 - DNA, 60 bp, Heterodera glycines; identical to SEQ ID NO: 52045
  Genomic contig location: Contig_ID=SeqID_41102; Location=786..845; Strand=+
  SCN-specific regions: Sequence locations=1-60

SEQ ID NO: 69300 - DNA, 401 bp, Heterodera glycines
  Genomic contig location: Contig_ID=SeqID_41104; Location=295..695; Strand=+
  SCN-specific regions: Sequence locations=1-32,59-71,152-401
atgtggacggaggaacagatgaagcggatgatgaagcggcggcagcggcggtggctgacaaatgaagcaattgacgatgatgaagttgatgatgatgattatgattgttgttattattatatgatgagacagagtgatgatgatgatgatgctgctgcggtggcggaaacattcgcggcggacgcaaatgaacggacattggggaaagaagcgcggatgatgccggaggcggtgatgagaacaaatggtgggcaaccgcaggcaaaccgagcggattttgaaacatcagtgccaacgctgtgaccgcttggagctggtcctgcgcataattggaacacacagttcagcttaattgtatccgcatatcggtggggggaggtcagttagttccgtctgacaaa

SEQ ID NO: 69301 - DNA, 249 bp, Heterodera glycines
  Genomic contig location: Contig_ID=SeqID_41106; Location=715..963; Strand=-
  SCN-specific regions: Sequence locations=1-249
taaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaac

SEQ ID NO: 69302 - DNA, 505 bp, Heterodera glycines
  Genomic contig location: Contig_ID=SeqID_41107; Location=183..687; Strand=+
  SCN-specific regions: Sequence locations=1-422
atgaaaccaaaatttgtatataaaaaacaaaatgaaattgaaggaccactaattattgcggtgaattgtctaatcaaaatttcgaaattttattttaaatcatcttcgaatgaatattatgaagatcaattaaaaagaagtattcgaaggttagttgatccaaaactgttgaatgaagagcgattgaattatgaatttcaattaaaaaacgaatcaaaagtgccaaataatgaacaaaaaatgctaattaatgaaatgattttgcaattaataattgatccatcaaatgaatgccaatcaaataaaagtttagacggaataattcatataatttattgtatttccataatacttaacctgtgaaataattacaattaaacttaaagtcaagaaacaaatttaacaaaaaaaaatgtattagcaaaaaaacaaaaaaaaatagaattattagaattttattaaatatttaatgaaaaatttcagaaaaaacaaaaaatttttataa

SEQ ID NO: 69303 - DNA, 580 bp, Heterodera glycines
  Genomic contig location: Contig_ID=SeqID_41108; Location=206..785; Strand=+
  SCN-specific regions: Sequence locations=1-8,30-223,245-332,354-580
atggggcgcatggaattggacttggaccaaatggtcaagggaaggcccaatttggtggaggaggaggctgcgtatgggcagcgaaagcgcgagatcactgcctccatcgccaacatgttcgagcagtacatcgactcattggtgagtggattcaaaataaataacagggctcttggaccggtttcttctggtattctcaaaacggcatattttcagtcgcaagaaatactaaataaacaattctgaatcagaaatacagattttttaaacttttttgaatttatcgtttcgaactctacaattgtattaaactgaatataaacgagtatcataaactgaaactaattgtaaaatttcaaaattaagaatcggttgcgccctttgagcgtgaaatgtgtgctggcggatgacgaattgaaaaggctgaaacgacgacggcgcgtgatgggcatggacgacgacgacatcggcgaacagctgaacgctgttaaggtgggaacattcaaataataattattccgaacattgggcaaaggatgaaaggaacttttggctctattgcagttcaaacgaacaaaaa

SEQ ID NO: 69304 - DNA, 675 bp, Heterodera glycines
  misc_feature (664)..(664): n is a, c, g, or t
  misc_feature (671)..(671): n is a, c, g, or t
  Genomic contig location: Contig_ID=SeqID_41109; Location=183..857; Strand=-
  SCN-specific regions: Sequence locations=1-285,327-486,508-675
atgccagaacaaagtgtttatgaaaaatttgacgacctccaaaacagaggttacactgttacgttcaggaacacactacaaaatgccagagtttggacatcagtgatgtaggcaaaatgtcattattagaattttaatttttttgccatggttttgctaaacttgtcatgatcatttggtcatttttcggatttttaatccaaatttcgtggttttttgatccatcttttatctcgccattttttttttgtccattaaaaaacattggcccaaaattactaaaacttaaataaataatttattcttaaacaaataaaaatttatatgcatttaagcttcactgttgtggctaattcaacccaagatgagaacctgagaaatctttcttctctgtatggtgccaaccgtcaacattcgaatactctaattagtccaattttgtaagttaatatgcctaattaatgcgtttcaattcgtgaattattcaacaattttttatttagcattgaactcaacaaagttcaaccgtggtattatggcctgttggtttaccgcattggcatgaccggcaatgatggaaatgaaatccaaagtgaatattttgtgccatataaagatggcatttcggcagttaaagcggtaattagagaatttataatcatanaggttgngtaa

SEQ ID NO: 69305 - DNA, 534 bp, Heterodera glycines
  Genomic contig location: Contig_ID=SeqID_41110; Location=251..784; Strand=+
  SCN-specific regions: Sequence locations=1-111,133-202,224-267,304 -325,347-399,443-534
atgtcatctttcacaactttttcatctgcggacgaattttctcctctccaacgtaaatactttgcaatcctaaagaatggggatccctattttaacttctttttttcggctcaaaaccagtttattgggttttcaagtgatgacattttaaaaattagtaagtgcaacaaaggatgaacatagagagagcggatttctatgcacaaaaaatgataattaagcacttaattcagcattcaaaaatgctaaataagataggaatgaatgaaaaacttctttggctttttaacaatttttacaaaatgatcataatttcattttctgctttttggattaaaaacaaaaatttcttaaacaaatcttaaatatgagtgttcagaagcccagaaaagccccgagattatttttttttatattagaaaatgtttttacaaaaaaattagggaaaaaccgaaaattttgactttatttgaaatttcatgttataactgcagcaacaacagcagtcaaaaggtgggaacaatttaacgaaaa

SEQ ID NO: 69306 - DNA, 277 bp, Heterodera glycines
  Genomic contig location: Contig_ID=SeqID_8816; Location=32..308; Strand=+
  SCN-specific regions: Sequence locations=1-48,70-277
ggcttcgccttcaccgccccgctctcctccaattgcttttctgtgctggccaaacactgcatcagcccaatggaagaacagcatcagcagagccccaatttgttgtaatgctgaagaaagtgccgggcaaacagaacgccaacaaatcggcacaaaaagcggacaaagtgaacaatttgaaattgaagggacgaaaagcatttataaatgatgacaatgttaaaaaaggtgctgaaagtgatcactgctgagcaacagatcgaatatcagcccaaaa

SEQ ID NO: 69307 - DNA, 1822 bp, Heterodera glycines
  Genomic contig location: Contig_ID=SeqID_8817; Location=1206..3027; Strand=+
  SCN-specific regions: Sequence locations=1-114,136-618,642-1029,1051 -1102,1125-1370,1392-1495,1517-1822
  Gene Ontology: Mol. function=transketolase activity; Biological process=fertilization (sensu Animalia)
atggattctaaaaaatttctcccccttgaacttatttacgaattggttaatgcactgccaattaaccaccattgggcagctcaaagggtttcctccgagttcgacaatttggtttttgagagacaggctgacttgataaaaattattttgcaaaaggtatgggaaaatggtgacccttgaaaaatcagaaaaataaacaactaaacaaaatgaattcaaaataacattttcgtgtaattcaggcaaacgtgtccaccgcgcagtcgtacatcacaactatggtccaattggcaaatgcggatgaacgaatagtatttttgacggagtatgcaattttgaggaccattttgggtggtaatctctttttccattgtcattctgtcagattcacgccctcccaacatgaattctgtagcgaggcggtgacacttggcaatcgattattcaattgcgctgaaacaaaacaaagcattgttgaccattccgttgtgatgactttctgtggccgtatgccccacgtttggtaactgcagatgatgcactgttgaactttttacttttttttgtaatttttagccttgatgtctcttcattctcccaaatgtctccccaacaattcgccttggccgatggcgcctcagcaaatgtccaatttgtcggctgttactctggaggacaactgcttatcaatgatttggcactttttggtggtttgcaaaacagcgttgtcctttgtccgtccgacgcgttctccgctgagcgtgcgactcagttggccatgacgcacaacggaatcacttacattcgaatttccccatatcccactccggcgatttacggcagcagtgaccacgacaaattcgaaattggcttgttcattgtgaggcttttcaattatagaacggtgaatgattaattaacagtggaaaactaattttttggtgaatgttaaccgtctcaaattagcggtataattaggtatttaagtgagtccacgaaattcgcctttctgattaatcattaagaaaatttgtccagtttttgattttgatgggtatttatttgccataactctttttgattaaactaaattaagaatcgacatcaatcgcacaaagacaaagttgttctcgtcggaattggagctgcggtcaatttgtgcgagcaagcatatcgtcaactgttgaatgaaaagattccggtgacggtcctcgacatgttttcgctcaaggtacgtaatcgcaatcagttttttgagtgtttttttaattcttcagctgacgcgtgagtttgctgttttatcgttggttagcattctaaacgtcggtcgagtcgttactgtggaagaaggcgttactcccttttgtcttccactcgcttcatcaattctcagttttatatctgaaaaaaaactccaagtgagagtaattcataaaaaagtcaatcttccatgcaatttgaactattcaggtttctgtgcgaagtctttgcacttgcggtatgtgtgtgttgtctaagtgaaattgtttaatttgggagaatggggcttaattagacattcaatatttcagagtaatccttttcaaaatctctgaggatgaaaattagcgaattaatttgagttttcaattcttccatttttttaagaagatggcttttctgcggattccattgtcgctgctgcgaaagcattctcaaagcgttaaacgaagaacgacgggcaatgctttgccgttttgttgacaaattctccttttgttacgataatttgttgaaacgttaaatgttaagttgagcagatctcttacgtcttttgttttaa

SEQ ID NO: 69308 - DNA, 243 bp, Heterodera glycines
  misc_feature (84)..(84): n is a, c, g, or t
  Genomic contig location: Contig_ID=SeqID_8817; Location=3580..3822; Strand=-
  SCN-specific regions: Sequence locations=1-126,148-243
ggattgggctgtcggcgtcatcgctcttctgatcgtgctgattttggtcgctgccttcataaatctgatccgctgcatctttgntgcctgatccgtttgagtacgtcggatgaaacaattgaggacaaagcagtgaaattgttgtaaattcaattttcaattgcaacaaattctgggatctttttttccatggcacttaattttgtttttctttgagtgattccatcaatacattttttcatt

SEQ ID NO: 69309 - DNA, 262 bp, Heterodera glycines
  Genomic contig location: Contig_ID=SeqID_8818; Location=19..280; Strand=-
  SCN-specific regions: Sequence locations=1-2,24-262
atgcttcggccgccacatttcccattgcttttgactgcgattgttgtcgtcatttgtttactctccggcactgcaaatggcgacaaaaacctgttggacgagctgcgcgatttggacattttccagctaaagttggtccatctcaaagccttttttggcacaattttcgccctttgttataggagcggcgtttcggcgtgtccattgctcgtcggcgagcgatgccccgagtcgagtccgctttactacttcaaaatgtgcg

SEQ ID NO: 69310 - DNA, 621 bp, Heterodera glycines
  Genomic contig location: Contig_ID=SeqID_41112; Location=181..801; Strand=-
  SCN-specific regions: Sequence locations=1-305,331-548,574-621
atgagagcatttttgctgataaaaatgtttgccaaagtcttgaccattccgtttacctcttcaaatcattcattcattttcgtccaaatggattcgtcgtcctcagaagaaggagaaattcatgaacccgtcccacaaatccaagcagtccaacccaatccacaaatcccaccaccccctgctaatctgcaaccaaatgaaaaaatcttctttgtttccgaaacaactcagcgcagagaaattttattggccgacgggttcgagtatagctttgaagctttaagccgaattgcagatggttagtctgatgtattttattggcattttccattgcattttacgctccaatagagcattttggcgtccatgatcaccctctatttctatgactagggatgcaatttatagttttttagaacctaaaaactaacgattttggcggttttagttactgtaaatctcatccatacttatggcataactaagtttacttttgattggacacctcaaaatgcatttggccagtaaaatgcatctaatgtcttgaaaatatttttaaaatagaaatttactgtcggattgtccactgtcggattgtcccagtcacgacttgaaattaaa

SEQ ID NO: 69311 - DNA, 60 bp, Heterodera glycines
  Genomic contig location: Contig_ID=SeqID_41114; Location=81..140; Strand=-
  SCN-specific regions: Sequence locations=1-60
atgcgcagaaacgacgaagaaacagaaggcaatgagatgaacgaacagcaggaggattct

SEQ ID NO: 69312 - DNA, 723 bp, Heterodera glycines
  Genomic contig location: Contig_ID=SeqID_41115; Location=1..723; Strand=-
  SCN-specific regions: Sequence locations=1-168,278-602,624-677,699-723
  Gene Ontology: Mol. function=protein tyrosine kinase activity; Biological process=feeding behavior
gtaaaacactacaaaatacgaccgcttgacaacggctcgggtttctttatcaccgcccggaaaacgttcggaaccgtccgggatttgatcgaatattattcgagttagtttcaaatttgaacgcaaacgtaataatataagttatttgtaatctcaataactgatggcttaaaataattttttgaaattttcttataaaaaaatatgagagattttttttgtaatagaaaatctaaaataaaattttgattgattatttatatattaatttatttttcaatagaagaatcgggtggcctttgttatcatctcacttatccggctccaaaaattgctccggttcggcccgatctgagctatgacacggccaaaaattgggaaattccgcgagatgaattgctgttggaccggaagttgggcgagggcaattttggcgaagtttggcttggacgatggagaggggtcattgaaggtgagaaagaatgatgagtttactcaacaattccatctcataccaattttgtttttcataaacgtttttttttgtctcctctcaccgccaccaaaaaattgactaatctgaaaaaaaacagttaatttttagcgaattttagtcggggcctaattttacagtaacctaatagcaaaggaaaaaaatgaatcgacttacaattagctgttaagaatgtgaaaaaaattttctatacaatttttttttcagtt

SEQ ID NO: 69313 - DNA, 1335 bp, Heterodera glycines
  misc_feature (1244)..(1244): n is a, c, g, or t
  Genomic contig location: Contig_ID=SeqID_41117; Location=1..1335; Strand=-
  SCN-specific regions: Sequence locations=1-156,178-195,217-818,842 -1123,1149-1335
catgaattgagcacacttcgagacataaattcggaccttatcgacggttggaggacgcatatgagacgatcagagaactgagcagcaaaaggactaaggacaaagtctgtcggaagaaaaaatggcattttaaagatttaattttacttaacaatgtattaaaattttcaaaaaattactcccggcggcgactatcggaaacgctggacccccatttcccctattttttgaaatttttttttgcgaacaacggctacaaaaaaaattttatgcctacggcttgaactcaaatttaaatggtaaaaagggacatcttaatgatcatttgccattcagatagaccaaggagcacaaattgatgatacttcgatgattgaacatatccatcaattgcagcaggaactgatcgagtcccacaccaaaaaggcaaacattttttggacctgaaaaaatatgggaacctcgcatttcaaggctgatttggagaacactgcgcgagagttaaagaaccgagtccaagagctcgaatcggccaacaaaaggcttaaggaatatccgccggatgggggcgttgcggcgattcaggaggagctaatccaagtgaaaatgagagaagcggaagcgtcgctgtcgttgaaggaaatgcgccaaaggttggccgaagttgagcagcactggacgaggtgtgttggtcttcacattgtgcccaacttctgtttgcttaggttcatgaacctccgcggagtcactgctgcccaactctccgcttctccgtccgtctctttggacattgctcagtcgccgccttcctcttccatggaggaggagccaccgcaagagccatgccaatcgccgacacagcaaacaacaaaccagcagaacacgcatgcgcaacagtgccaaaacccatcggcacagagtgcgcgagcgcgaattgccaaactgaccgccactttgatgggcgcggttgggagcagtgccaattcattggcgagtgccgaaaacggtgggacagcggaagctttagagggatggagtcaaagagagttggaggaccaattcatcggactgaaaattcgagaggcggacacaatggcggagttgaaggaaatgcggcagaaggtgatggagatggagacgcagaaccacgtgtgtacgaaccaactgaaaaggcaggacgaggagatcagacggctgcgtgaagaacgagaaacatttgtgcaggtcgaacagagtggaagaanagaacgaaggaataaaagagaccgggggaaggaggggaaaagagaaggagcgagcgagatatcgccacctcctctcccccacccccccccc

SEQ ID NO: 69314 - DNA, 196 bp, Heterodera glycines
  Genomic contig location: Contig_ID=SeqID_41118; Location=1..196; Strand=-
  SCN-specific regions: Sequence locations=1-196
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccac

SEQ ID NO: 69315 - DNA, 620 bp, Heterodera glycines
  Genomic contig location: Contig_ID=SeqID_41119; Location=579..1198; Strand=+
  SCN-specific regions: Sequence locations=1-330,352-377,401-427,449 -507,545-593
atgatgtttaattctatttctaaaattccttttattatttttattgctaatcattttttaaatccattttcaaatgctattccattggtgagttaattaattagagaaattaaattaataatccatttgaattaattagggcgaggacaatatgctaattgcaattatgaaggcgatcagcaaattcaaatcagtgaatattcattgcaaaaatatgaggcaaactttggcattgtgttttttatgttcgaaaatggaagttacaaaatttgtgagaaatttgatgctcacttttcggaatttgtcaaaggatttgcgataaattttgacaaatttttaaagatatctaaagaatattcaaattatttatacgatttaaagagaaaagtatggtgatgacctcatgagcacttttgggttattgaaattgagaaaatgatgaagcagatcttggcgttatgcattgatgcgagagaattgacactgtaaaaaaattggaacggaatttaaagaaaaatgccaaaaatattgaaaatatttggatgttttatatgaatactaattcagcttgtatgttgaaggtttgtatgatttttggattaatttaaatttttcattta

SEQ ID NO: 69316 - DNA, 565 bp, Heterodera glycines
  misc_feature (458)..(458): n is a, c, g, or t
  Genomic contig location: Contig_ID=SeqID_41120; Location=376..940; Strand=+
  SCN-specific regions: Sequence locations=1-4,76-565
atgccctgctcgtcctcctcctcctcttccgccgcttcgttttcctccgttttccccgtccctttccccgcttcccatccatggaatcctttcgcttctgccgccccttttgtcatcgcaattggcagtggttctgtgtgcgtcaaaaatggcgaatgtcgccagtacaaccaactgaaacgacaccaccacgagtcagcaccggtcgcagcagaagtgccatcagtcgacgagggaatgaacgcgacggacaaaaggagaaagaaacgcggaccgtcggcactcgcaactctttccgcccttttgctgcttggcgtggcgctaattgtcagtttggcattcgtcgcgtggacaatccatcggatggtaaacgaaaagaaaaggccaaacgatgccagggaaagtgggaaaattgaattgcagaacgaacagcacaaagaatgtgcggaagcgatganaacacaagcggaacgaatcgaagtgttggaaagtgcggtgacaaagcaaaaacggacggaggaaaaggaaacggaagagccaaatgacaatgggaaagaaagccatg

SEQ ID NO: 69317 - DNA, 169 bp, Heterodera glycines
  Genomic contig location: Contig_ID=SeqID_41121; Location=813..981; Strand=-
  SCN-specific regions: Sequence locations=1-135,157-169
aaatagttcactggaatgccaaaaatggaataataatcttcgacttgtacggatcaacaacttgatgaatgtatcggaaacctggtatgtatatgccaatagtgtcactgatcaaaaatgcgttgatcaagtattcatggttaatgagtttattagtgacaaatggtga

SEQ ID NO: 69318 - DNA, 462 bp, Heterodera glycines
  Genomic contig location: Contig_ID=SeqID_1173; Location=861..1322; Strand=-
  SCN-specific regions: Sequence locations=1-26,48-55,98-320,342-462
atgggagttctaaattgtggaattataaaattcatgaattaaaattttttccttctttaaaaatttttttatgagttttttaattttttaaaaatttcaaaccaattttcagaaagttttgtccatattttcgtgtttttttgtccatatttcagcatttttgttcatattacgtccatattttgcaattttttcgtccatattataatccatattatggatttttttgtccatataaatccggtttttgtcgaattattttgttcacaatttcatttgtttggcagccatttgctgtggcaattgccaattgcaaaatcatttcattaattggcactttttgatcatttttcaattctattcataattcaatctctcctcgttcaataattttggcttaaaatgataattgaaaaattctttaatttatatattcatattgttgtccttggcgaaaataaa

SEQ ID NO: 69319 - DNA, 3057 bp, Heterodera glycines
  Genomic contig location: Contig_ID=SeqID_1173; Location=2852..5908; Strand=+
  SCN-specific regions: Sequence locations=22-217,239-344,368-522,545 -697,719-850,872-1383,1410-1848,1881-2070,2131-2144,2184-2195,2217 -2224,2246-2351,2373-2389,2411-2598,2620-3057
  Gene Ontology: Mol. function=cathepsin K activity; Cellular component= extracellular space; Biological process=proteolysis and peptidolysis
ccattatgattaatttaatttttccattattcatatatggtataacaatgctttccgaattggccgaccacggtaatttcaaatttatttaaaaaaaaacccaaaaaatatattatctaatatcaactcaatattctagaaaatgactttccgacatctcttgatctacgctacactcggcgcggagaacgacgtattccttatccacaaaatcaaggtaaattcttgaatgaaaattttgttgaccaacatagttcggtgccactgtttccgtgccattgcggatgaagaatccttaattttttctcagttgaccaattttataaatttgatttatatcgacaaagaaggccattttaagatatttctaagcatttaaaaacattgtcaaaagttgtaacaaaaaacttcaaaaaaagtttaaaaattttgagttctctggcacgaaacgttggcacgaaattgaaactagaaaaatttaataggaatcaaggccaatagatttgttataagaacctggataagaaatggaatttaacatagtaggtcggattagggtcgagtccgacctgaattctgggtcgggatttggtacgcaaaaaacgatagcgataggttctgacgacaaacttgttctgcacccttttaatttttggtattctgattacggagggttcgcctattacagatattttggaatttttccatttccgaaaatttctagagcactgcggtgcctgttgggctttctcggcggcccttgttcattcggcagcagtttttgaaagccgagtcggcgagcgtgatcgtcttgtcctctattccgctcaatatttggttgattgtactattcgtaagaagaagaagaagccttcagaagcttgcaatgggattgccgtcatgaaagcattaaagttcactaatttttaattaaaaagggataaattgtgagggtttttgaatttcatggttttggggcccgacatttttgcctctaaatttgtaaaagcattatatctaaattcgcggctttttttcaacaattcgcaacgaatgcagtcaaaactttataatttttaaatcattggaaagcttaacatgtttcaaagctgcttctaactattgcttctcgattagacaattactaaaatagctatatcagaaaattaatttgaaatatttgaagtttaaagtttttcttccttaattttaacaagctaaaaagcttttcgaattttgtaagggtaaagaaaaggtgaagcgcttttgaatgatcacaagattattagatttggttgacaaaaaagtatagtcaaaaaacttatgttcgcaacgaaacgtctgcgctatacgacctaaaatccccgtaaattttgaaacgtgatccaaaaataaacaatttaacttaatttttacttatacatgtttcctattgtaaattacgaaattccagtaggctttccactgatggtgttccactcgacgcactttacccgtacttgagtggcaaaacaggtcagaaattttattgtacccacaatcattgggtttgatgtaaataaaatccaagaatgcctaattaatgcccttgtgctaagttaagccatttttcggggtgatcacgtccatgaaataggtacgcagaacgagtgcggagttgcaggagaggtggcgcttgtccggaccaaaaagcagggcctcttgtataaagcagagcccgggcaattcggatttgttcgcgggctaacggcgcaaatgacctatttgacgacgtacagactgccacttgcagcccgtatgttttaaaaaaggaaaagccattaatattaaatatatcaaaacatgaggatattttttaattcttaataataaaaatttttcagcttttgtcgattttaatttatttttgattaatctgaacatttttaggtatgtatgccccggaatcattcaaggcaagcccgaacttttagtgccaggatgctaggggctatgtaaaatatcattttaggaaaaatagtagtttaatttttaaaatttacataaagaaaacctttttttttggttttctaaaattaataaattttaaatgttccttttaaagtttttaataaaaatttgtaaatttatctcatctaaaataaacatattgagaatttctaaaatggaaatttggttctaattttattgtatgattttaaatatgtatttatttagaagccttaataaataaatgggtaaaattctggtttgttccccccttttcaagaaaaaataaaagttttcaaaaaagcatctagcacaaatagggatctcgaggtcgctgatcacgaatctgaaacccatttcgaccaattttgaaccccggaccccaactcgaacaaaaaacgggaattaattttaaccaaaattcacttttatgttcgaacctcaacagaatttaatgtccggggttcgaattggggtttagattcgtgatcagagcgacctctaaaaccctaaaaaagtcgattttttgaaaaattttatttttgaaaaggaggggaacaaaccaaccgattaccaataaatgtttccaaatttatacccttaaaaaaatcattttttaagctttaacggtaaaaaaagtggtcaaaataaatttaaaatgtgcctttaaccgagctttctaaaaaatagcataacttttcttttaaacatgatttttttgaaatctaacagtcgttagtttttttcgaaaaaagatactttacatcctctgttaccccaaagtcccgggactcaatattccatgcccacttcaagacttacaaaagcaaggaagtctacgacccttcccctgaggaatgcaaggccgcggaagaggaccctgacaactcaatgcacatcattagcatagtgggctatggcgaagaaggaggcaagccattctggctgatcgttaacagttatggccaagagtggggtgacaatggtgaggccaaatttgttagaggcaacaatgcgtgttgcattgaggattatggatattatgtcaaaagtgtagagcattattga

SEQ ID NO: 69320 - DNA, 195 bp, Heterodera glycines
  Genomic contig location: Contig_ID=SeqID_1173; Location=7410..7604; Strand=+
  SCN-specific regions: Sequence locations=1-195
atgcttactgctaatgaggccgttcaaagagaccaagatgagaaggaagtagaagaagaagagtcgtgggccaaacgttttcctccatacagtgcagaaacggaaattgaacagcttgacgaatttagtttgcttcatcaacaaattgtggccggccgtgttgtgccgtgttgtgtaaatttgccagaaatcacg

SEQ ID NO: 69321 - DNA, 866 bp, Heterodera glycines
  Genomic contig location: Contig_ID=SeqID_8819; Location=306..1171; Strand=+
  SCN-specific regions: Sequence locations=1-11,106-466,490-763,785-866
atggtcggctcgcagcagcagcaacagtaccatttgctgccaacgcaacagctcaaccacaacaggaacaagcagtacacgacgcaacaacagcagcagcaacagttcacctcgccgtacgccacctcaaactacggttaccacgagctgacccatccaccggcctacagtatgagcatggtcggcggcggaggcacggggcaacgacgatagacaatgggagatgaaccaacaaagaatggaagccagaatgaacaaccatgatcacacagttattttcatgtagatatgaggagttggagcctatctcttgccggaaaattggaaattcattgtctggggtatacaatttcccatagccaggaactttgaaaacgcccgggttagggcacggatttccgagatgaaccggaacagaattccggattgaagtactgttttaacatgatctcctccggtccaaagcattttctaaaacatacagaactctgagccagcacctaaaatactgtaaatctttcggttatttcctgacagagtatttttccgattagagccgaaaaccgaatgaattgaatttttgactaaccgacccaaagaaaattcaacataatgctttcaagaacaccatttattcagaatccattctccgcctttttgtatcgggcagtttctggagatttaaacaatgtccgtcccaacgtcccattcctcttaaacgaaatgccatttaaatttctttatgttttttatcattgcttattttttcattttgaatgattatgtaaaaaaaaaaaataatgaatccaagcgctgatatgtatgtaaattcttataaaatcgtgaaataagcataaatgctgtaa

SEQ ID NO: 69322 - DNA, 831 bp, Heterodera glycines
  Genomic contig location: Contig_ID=SeqID_8820; Location=407..1237; Strand=+
  SCN-specific regions: Sequence locations=1-90,114-313,336-367,393 -539,561-686,708-831
atgactacttcactggcggacttggatgtggaatgggagacgtacaaaacggaattcgagaaggcagaggtgggcacacaataataaacaaatgacagtcatcaatctttggaaaagtatcgaaaattatccaggccgaacacggtgcatacaatgcgcgtcagcgcgcaaatgtgaacaaattgtaagtgtttttgttttctttgccaattgaattaaaaataatcttcccctttgcaacaaggaagcaaaatttggctctgttttctgggaagatcgaccggtaatataggaaatccgaattttgagggggagtgggttctttccatgatgagaattgttaccttactgtaccacaaaaaacgcattaataaataaataaatagccaacaggctttactaaggatgactctaatgcagttcgtgcgtttaattagctgctcaaactgtgacaaaatcagtttaatttcgaacgaatacgatttgaataaaaaaactgaaagttcacattttcgtataaaatcggcttaaatacacggaaaaaacggagacaacaaaaaagcgaaatttgaacttttcttcattttcttcgaattcgggtccgggttttatgattggtcgaaatgactctcattatcaagatcagtgaaaccttatgatagtgtttttatgacttaaaatgattaataatatttaatgttttcgttggttttcagcttggaaaggggcgaactcagcgacgatgacaaacgcggattggaagcgctgaagacacaggcggagcaaatgcacatcaacctgtccgatttgtggcgtgaggaggtgttttaa

SEQ ID NO: 69323 - DNA, 540 bp, Heterodera glycines
  Genomic contig location: Contig_ID=SeqID_41122; Location=213..752; Strand=+
  SCN-specific regions: Sequence locations=1-25,47-87,121-389,411 -446,473-540
gtggtgatcgaggcacgggacaccgatgggcttgttggccatgctgttgtgttggtccaagcattggccgcagaccatctgccatcaaaagctgctttttcctccccctcctcttccgctgctcgcgcttcgctgttcggcagtggccaagttccggtcattgctgatcatcagccatttccgctttcatcgtccgcatttgtgccaccattagcaaaagccgtcggcgtcggcatacccccggcgtcaccaccgtcggcacaaatgtcctcctccctttctcaaaatgtgccaccagctgcgggttcgcagcagatgatgtcatcggcactgattgcgtcctcggccggtgggtattggcagccgattagcaacggcggcaacaacaaagcaaattccaaccaaaagccgaacccattttggcgagttgatccaacaacaacattagcaacaccagcagcagcagtgaagttgaatccgatgcttataccattcgcaactaccacaactgccgtaccaccgccgccaaatcagttcacg

SEQ ID NO: 69324 - DNA, 369 bp, Heterodera glycines
  Genomic contig location: Contig_ID=SeqID_41123; Location=50..418; Strand=-
  SCN-specific regions: Sequence locations=1-369
atgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagacccagatacgccagctctgtccgtttccacctcatcg

SEQ ID NO: 69325 - DNA, 86 bp, Heterodera glycines
  Genomic contig location: Contig_ID=SeqID_41124; Location=1251..1336; Strand=-
  SCN-specific regions: Sequence locations=1-86
ttgaattaacgcgcaaaatttacgccaaatgcgctatttggcgttatgagcaattttgtctgacactggcgcgtacccatagtgct

SEQ ID NO: 69326 - DNA, 282 bp, Heterodera glycines
  Genomic contig location: Contig_ID=SeqID_41127; Location=175..456; Strand=-
  SCN-specific regions: Sequence locations=1-37,60-120,142-282
atgattcccaatgataccttcattttgcttcttctcctctccactgtttctgtgtttgttcaatttgcagaagcccaatggaagcaggaaggagctggtcagaaaatcttttcacacaacattttttaaaatattttttatgcatcttctacgcaacgtgcagctggcaaaaaacattcgaagacggcgacagcggtgcgcaagatgaccgccaacaacaactctgagcagcagcaacatggtcatggtgttgaacgtgtgcgtaaccgtcactcgaacaag

SEQ ID NO: 69327 - DNA, 128 bp, Heterodera glycines
  Genomic contig location: Contig_ID=SeqID_41131; Location=698..825; Strand=-
  SCN-specific regions: Sequence locations=1-128
tttggtcatccttgatttcgtgattaaatatatacgtaaattgtatcgcctctttctctatttctatccccaaatggtcattcgttcattcagctcacaattcctaccaaatctgcacatttaaagag

SEQ ID NO: 69328 - DNA, 1983 bp, Heterodera glycines
  misc_feature (33)..(33): n is a, c, g, or t
  Genomic contig location: Contig_ID=SeqID_8821; Location=1916..3898; Strand=-
  SCN-specific regions: Sequence locations=1-664,687-774,797-1102,1124 -1356,1378-1686,1820-1852,1949-1983
  Gene Ontology: Mol. function=sodium:hydrogen antiporter activity; Cellular component=integral to membrane; Biological process=sodium ion transport
cgccattctcgcgtattatcatccccaattacnttaattgcttctcctaattgcccttccttcgcttttcattagcatcgtcgcctgtggcattgccatgaaacagtacgtcaagggcaacatgagccacgacgcgaacagttcggtcaaatattttgtcaaaatgttggcacagagcagtgagacaggtcatttggggctttgaattgcgatgttcaaaatggcgcaatgttttggcattcagtcattttcatgttcctcggcttgtcttccatcgccagcaaacaccactgggacactctgttcgtcgcctgcactgtgctcatctgtttcgtttaccgtgtcatcggtaccgaccattgcccattcttaccgtagtgtccaaatggtaccgtaatcttccccaccccaaggcgttctcgtgcagtgtgcctttctgaaccgtttccgcaaaataaagttcagcgccaccgatcagttcgtcctctcctacggggggctgcgcggtgccattgccttcggtttggtcgtttccctcccggcgattattgaagcgaaacgaatgtttggccatttgaaagccaacggacgaattgtcggtctttttaggttcgtcaccacttgcatcgccgtcatttacttcaccgttttcctccaggtgtccttttctttgttttgctgtttttattatcctccgccgttgttttagggcatcacaattcgccctttgctgtctttgcttaaggtggagaagcaggacatggaatacgaggagatgatggtggagaaggtgcctttccaccccaataataccgtattctatcggggttactgtacgcttttgtcaaggtgtacaacaaatactttgactacacaatggccggtattgaggacattgttggtcagcggggcaaacacttcttcagagacgcgtcagtcaattggccaatggacgacggcacatttcattttggaaatttaagtttcgaacggttcaacgccaaaattttgaagccattgctaatgcgcaatatgacacggaaaacattcgacgcaacagacattgtgcgggcgtacaacaaaataacgctacaggaagcgctgaaaattgcgcacattgggcgaaaaatgagaaagtaaatgggtcaagtggacgggggatcaattaagacgaattaagagcaattaggaaaaaggaaaaatggaagagggaaaagtgccaaaattgacagagtgaaagaaaagcaaccgaacacaatgccaaagacagccgaagcacatcgaagggaggaggagcagaacgaaacaatgacaatacgaagcagagaaatggaattgggacaagtgggcgaaggaaagcaattaattcattaattatggtaattacttattaagtatatgtctaatcgggataacgcggaattgctttatgcgatgttctctcgtctgttggacagaaaaattgaagaaatgcaacggaggaaagagacgagaaaccgatcggaggatgacgacataaaagtggccggggaaaagggggggagaaagttaataaaggcaatgaattaaggataattacatggacattctgaacacgagttcggcatcgcaaagcaatgtaaaatttgcggaattaagcatatttttaaagtgtcgaaattttagcaacgatcagcagcagtagcaaaggaaaaagagaaagtaaataatgtgagagagagagaagaagcattggaaatggaaagggggacaaacggaagagaaatagcaaacaatagaagcaaaggaaaagaggaggagaaggaggaggaggaggagagcagcagaacatagtcagcggaataggaggaagagaaagagaggaagaagaaaaaaaggaggagagagagagaaagaagaaagaggaagaaaggaggagaagaggaagagaaagagaggaagaaagaaaaaccttcgccggggaagggggagaattggcacatc

SEQ ID NO: 69329 - DNA, 792 bp, Heterodera glycines
  Genomic contig location: Contig_ID=SeqID_41135; Location=6..797; Strand=+
  SCN-specific regions: Sequence locations=1-221,245-265,289-730,755-792
atggacattttccccttttttgaccatgctcaactcagcctcaaattggcacttctttcgccctgtttcgatgcgctggtggacaaacattttcaatggcaaaacgaattgacgtaagtttcaattaaaaaaaacataatcataagaaaaattgcaaaattttctaaaaattttcatttttttttgagacttacaaatgaaggcctctattttttcacttctttttgcttttgaacataaattttgtgtttaatccatatcgaaatttttggttaaatttaattcatagaaatgccgacttatcaaaaaattgcaccgaaataaaaattttccaaattcgacatttttttcttgtaaagcggatttttaggcattttgcacatatcatttttagcctttgcgattttataatttttattacttttttcagcaagtgcgcaacgacacttggtggccttttcccatcttttgaccatgctcaactcgggctcaaattggcactgctttcgccccaattcgatgcgctggcggacaaacattttgatggaccaacgaatttttgtataaattcggcaagttttttttgggttttctttttgtttttttggtcatggccccaaaaatcttaaccgccccgaattttcaaaaatttctgaaatttttttttccaatttcatttttttgtaaaagtaaatagtttttttttgtttttttgaacgtttttgtgcacaaaattttaatggcctcaaattatcaaatggctctgaactccaattttcaatatggctcata

SEQ ID NO: 69330 - DNA, 125 bp, Heterodera glycines
  Genomic contig location: Contig_ID=SeqID_41137; Location=15..139; Strand=-
  SCN-specific regions: Sequence locations=1-125
tgccggacggggccgacggcaccaccacttttgtggtgcccttcctgcagatgggcctgttcaacgtgaaccaggaagttgagttgctcagcaaattgttcagcagctgcaccacaaccagcggc

SEQ ID NO: 69331 - DNA, 1187 bp, Heterodera glycines
  Genomic contig location: Contig_ID=SeqID_41139; Location=51..1237; Strand=-
  SCN-specific regions: Sequence locations=1-159,182-307,330-335,357 -446,469-666,688-818,841-1187
atgcgtgaaaatgccttccaattatatgagaaaccaaacaatgacacgggaaaggatgaggcatcaatagcagctgatacaggtgccggtatgtaacacggcaatcctgcagaatgggggtttctaatgtatcttttttttggttgaaaattggtacattgggagttttatggggtgctggatacaaatctaacataaattctgaccatttcctagtccctaacccgaactcgatcaaaaactcgaaaaaattgaattttcgatgttcaagttcaagttagggatttgttcgcatctcggaaaactaacccacatacatataccattctcgacccaaaagaaaaaataaacgccccattcttcaggatttccggtaatactatcagtggtttaggggtctgaaactacgttaatgtccataaaaaaaaatccacaaaaaaaaaagtagtgcaaccttgcttaaaagaggaattacattgctataatttaattttttaccgttgattgataaaaactctcctcatcagaactattatttaaatagttcaagtttctaaaaaaaactgaaaatttttagaaacaataacattttcccttccgggaaaaagttttctcgggtcttcggaattggcccgaatgggttgttaacatcatatcagatcaaaaaacatgtttttgtgctaaatttgactttggtattttcaggagagaaaaagctgcctgacgctgaacaaaaacagacgacggacacaaaggagcggaagagtccgataatggtcgacaaagtatggccattcattcaccatttggccactctttccccgcattccctcctcccctttagggagtgcaagtgatccccgaaaggacaatcttcgcctcgccctctttcagttcatcttttcgcactcaattgccggcctctccaattttgcgtacggccaaaaaggaacagacgtcgagtttggtgcttccattgcgggatgcgagcaatcatgaaaaactttcctttgattgatggaccgataaactttgccttttatttgtcgttagtctcgcattacaattagtttcaatagtaaatttctttataatttggttcatttatgtatttcattccaacacttttaagctcagaaaactagagttcggcgggccccgaattgaccgaaatggatattaataaa

SEQ ID NO: 69332 - DNA, 143 bp, Heterodera glycines
  Genomic contig location: Contig_ID=SeqID_41140; Location=197..339; Strand=-
  SCN-specific regions: Sequence locations=1-143
atgacgctttgcccgacggcaaagccctgccgaactcttccttttgcgaaagccgcgaacaacattggatttgctgagagcaaaaccgttggcaccattgatcagagacgaggcgatggaaaagcagttcaatcgccgttttg

SEQ ID NO: 69333 - DNA, 785 bp, Heterodera glycines
  Genomic contig location: Contig_ID=SeqID_8824; Location=369..1153; Strand=-
  SCN-specific regions: Sequence locations=1-19,46-57,79-104,214 -253,275-785
atgaaattatttccgctactattattaattatattatttttaattgtcaaaattggatcagaaaagaaaaaattgcagcagaagtcatttggcgaaatatttggagaaaaatggcaagaaaaagaagaagaaaaacgaaatgaactcaaaaaaagagaaataattcaaaaatattataaaataaaagaaaaaataaagcaaaaaggaagaaaatattcacgaaaagaatggaataaaattaactcaaaaatagcgaaaaaattggggacaaatcaaacatatattcaaaaatggattaaagaattaggacttaatcaacgcatgcaaaaaagctacaaatcaaaaactgatgaacaaaaaattgaaattgtgcaaaagtttattgcaatgaaaaatgaatttaaacaaaaaagaaaatattcaagaaaagaatggcaacaaaatcataaagaaatttgtaagaaaattggagttggttatgacacaattagaaaatggaagaaacaatttggcatttgctgcaaaaaaataacggagaaagaaaaaatggaaaaaatgaaagtttattggcaaacaaaaaaagaatatccgaaaatgaatgacaaagaaattgcgaaaattatgaaaattaatcactttaacgtttatcgatggaagcagataattggagaaggaataaatgagtaatgcaagaacaacgatatggagactttacgacattcagtattttatttttcagtcctccttatttttattattaattttcgttttttatcagtaataaa

SEQ ID NO: 69334 - DNA, 497 bp, Heterodera glycines
  Genomic contig location: Contig_ID=SeqID_8826; Location=162..658; Strand=-
  SCN-specific regions: Sequence locations=1-206,244-244,309-390,412-497
atgttgagaacagtttatcaatataagcaacgacatcccgagctggggcaggaaaaaattgtaaaaaaattattgccaatcagtttaggaacatttaaaaaatggaaaaaatcgctgacgttggacgccgatggtatacaataactcttacaaaagaaaatttatacgatactttaaagaagtattaaaaagatataattagattaaaataaagtttttatcttttgaaagaattgatttttgctttattagtaaattttttcaaaaaaaatttttttgaatttttcataagaaaatttctataaattcacaaaaatttcaaaacaagtaaaaaaaacaatgaaaaaacataaacaaaaatttgaaatatgtagaaaatatgagccatataacttttatttatagaaaattcaattgatgatttgcaagatgacattgaggaggagcctaaacacatgggaattgagtaattcatttttaaatgaaaattgaataaa

SEQ ID NO: 69335 - DNA, 307 bp, Heterodera glycines
  Genomic contig location: Contig_ID=SeqID_8826; Location=2700..3006; Strand=-
  SCN-specific regions: Sequence locations=1-8,32-187,217-307
tatgaggatgaaaaacaatttgaaaagaagatttcctcaattaaagaagaacacttagatgaagataattttgtcaaacaagaactcattaacatagataatggaccaattagcattaagcaagaaacaattaccattaaaaacgaacccattaacggcatagatgaacaattaagaattggtaatgataaaataaaaattgaacaaaatgaaaatgaagaatcagaaatggatgatagtgaaagttttgaaagtcacagttctgatcagtctatatctacggatgatcaggattcagacgaaatgg

SEQ ID NO: 69336 - DNA, 671 bp, Heterodera glycines
  Genomic contig location: Contig_ID=SeqID_8826; Location=847..1517; Strand=+
  SCN-specific regions: Sequence locations=1-65,87-426,449-671
atggacaaaaaggcaaatttggcgatggacaaaaagtgcaaaattgctaaatttcaaaaaaatttattaagtttttcaaaagttatgacaaattttccagtttttggcttgaacttttgaaaaacttaataaaattttttgaaatttggcaagctaataatgcaattcaagggctatcgtatgataccaagattgtttgcaatttggttgtgtctgagaagagttttgagttgatttattcaaaaatttagcaaattttgcactttttgtccttcgacatagcaccgatttttcacaagggttaggatcgactcaaattagtcatgtagctcggcgtcagtccggcgcttttttacagtaagaaaaacggtttttacagccttatatatttaatgagaccgtttgattgagaaattcttaaaatgcttgaattattttgatttaacttacagaaaatgctgtcagttttgctaattttctccgatttccattccttcaatgtgctttggcccatcttcagtttcttagctattttagaatcgctaatttttggattgtcacttttaatttcggaatattttttcatcaacatttccttgtctttttccgaatacgttttgttgactaaaacaaaaaagaagtattaatgtaggaaatttcataatgaaaaa

SEQ ID NO: 69337 - DNA, 675 bp, Heterodera glycines
  Genomic contig location: Contig_ID=SeqID_41142; Location=911..1585; Strand=+
  SCN-specific regions: Sequence locations=1-38,61-101,124-382,405-675
atggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaagaaaaagctggcggtgcccgagctgacactcattgagtcttaagccacgtgctaggccaagcacgggccctaccacgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccaacacagccgttaggtcgccccacgagcgtgcaccccacattggcgcagcgaaccaaccaagcgaggcagcccgccaccgacacattgccacgcagcagccatacacaggctttaacatgtgcagcactgagcggtataccacagctccaacgtatggaagcaccccaaaagcatggctcgtgaggcagctgccccgtaatgttgggcagcgtccacaagtcagctcgaacgacctgtgcccgtcagcggacgggggcatttggtggtgccaacgctag

SEQ ID NO: 69338 - DNA, 177 bp, Heterodera glycines; identical to SEQ ID NO: 41144
  Genomic contig location: Contig_ID=SeqID_41144; Location=1..177; Strand=+
  SCN-specific regions: Sequence locations=1-177

SEQ ID NO: 69339 - DNA, 414 bp, Heterodera glycines
  Genomic contig location: Contig_ID=SeqID_41147; Location=606..1019; Strand=+
  SCN-specific regions: Sequence locations=1-12,39-133,156-180,202-414
atgtacaaatttgggttttttctgcttcttcttgtcctctttctcatcgtcgtcaagagtcggtctgaagaaccaagggccgagaatgttcgtccaaagtttgtaaagtgtgaaaaagggaatggacagcagaacgaagaagaagccggtccaaatcagactcagaagctgtgcagacacactcagaatgacgatgtctttgcagtaccttaagggaccgcagttgtggcgaatgttaaagcttttttactctccaaacgcattcggatcgttgaggtccaacccagcatcgaccagctgattacgctcattccgctcggttttcatctgagaaaatgcaaaatttatgacaaagcatcattaaacttgtgcccaaaaatcggtaatccttcggaattggtgtcccgaccaaaa

SEQ ID NO: 69340 - DNA, 394 bp, Heterodera glycines
  Genomic contig location: Contig_ID=SeqID_41147; Location=539..932; Strand=-
  SCN-specific regions: Sequence locations=1-126,148-172,195-289,316 -343,365-394
atgaaaaccgagcggaatgagcgtaatcagctggtcgatgctgggttggacctcaacgatccgaatgcgtttggagagtaaaaaagctttaacattcgccacaactgcggtcccttaaggtactgcaaagacatcgtcattctgagtgtgtctgcacagcttctgagtctgatttggaccggcttcttcttcgttctgctgtccattccctttttcacactttacaaactttggacgaacattctcggcccttggttcttcagaccgactcttgacgacgatgagaaagaggacaagaagaagcagaaaaaacccaaatttgtacatgtgagacgatgaccaattgctgttgttgtttttgtttcataaactcccttataaacacagagaaaaa

SEQ ID NO: 69341 - DNA, 707 bp, Heterodera glycines
  Genomic contig location: Contig_ID=SeqID_41148; Location=53..759; Strand=-
  SCN-specific regions: Sequence locations=1-570,592-707
atggatttatatttggatttggatgatttgcattatgacaacaacggcattttccagccaatttggaatttttttgctggtgaaatttggcccattttcgcgccaaacattcgccatttgactggccatcatttgggcgatttgcgtcgtcaaatttcaccgacaattttcaccgattgcaaccaattgaattcaattgactccgataatttgttgcccgcgtctattgctgatgatgggccaaatgcaacttctcgtcaagcattgaccaattggttgcacactccgacaaaaaatgggcatccgccgaagcaattgagttgttgtgattatacgtcagaaagcaatgaatggttcaacaatttcaaaaaggtgtgccaatattttcgtaaaattttggatcaaatgccatttacttttcgtttcccattttttaggaatttctccgtgccaactcttctgccagttacataatccaattcaaaacttacaccacaattgcgcagtttgaattggtgaacgaacggactaaagaaaagctgacattgaaggcagaagatgattatgatgtatatacacatattaattttgtgttggagcgatgccaaattgtggcgacaattcaatggcggcaagacaaaaagacggacaatttgaacaatgtcgacattacaataatgtgcgtcatgtttttgctaaaacattag

SEQ ID NO: 69342 - DNA, 334 bp, Heterodera glycines
  Genomic contig location: Contig_ID=SeqID_41149; Location=926..1259; Strand=-
  SCN-specific regions: Sequence locations=1-334
atggtcattttcgagctaggtattttgatggctgacttaaagaaaatgaaaagagatatagaggtagagaaaacaagagtaaatagagaaaaattaggactataagaatataatacagctccaacttcgtgtatcgagttggagtagtacaagctcagggttaatatagatcaggtttaaaggcatattcggattttactgatctaaaatttacagaaaactttgttatatcaggtttagtattgatcataaaaaattcgagaaaaattattggaccaattttcaactttggcatggtcgggaaaaaattctgaaaaattgacaagcaaataaa

SEQ ID NO: 69343 - DNA, 931 bp, Heterodera glycines
  Genomic contig location: Contig_ID=SeqID_8828; Location=262..1192; Strand=-
  SCN-specific regions: Sequence locations=1-116,142-173,210-257,279 -512,549-681,704-726,751-751,778-881,913-931
atgcttttcactgggtttgaccgactgattgtattaatttttggtgaaatgtagtttcacggtgaccagatggtcaccggttgctttgttgattttttcagggtaaattaaatgacataaaaaataataaaaaattatttagtttgtgtgtcaatctcccgtttaattattattttgctgatcatcataatgactttaattatttatttgcttgttggaatggtgataaaatttaaatgacgggttgcttaagcttaattacatcattaaaaataattactcctaatttaggtttgccctcggccaaatcgattaatcatcgtgtttttcgagctctttgttgtatcatcacagtgaatgtttgaggctatttaatctgtgtatgttttattactctgatcaatcaattaattgcctctccgatcactgcttggtttctgcaagtaatcactgcaattctgttgaacattggcgccgcatcgaatggacccattttatattttacaaggttcttttaaattaaataattaattgatatttttattttagcacggaatatcggaaagcctttcgagaccaatttccaataatatttaaacaaaatttaaatgtaattcaagtttcgccacagcaaaatggaagctaattcgctgcaagccctcaggacacgaacccaatctcataaattttttaattgtataataaccttttactctttttataaggtttttattatattattttaatttacacaaaggaaattattaaaattcatttcttatttttcttttacaaaaaaactatcgggactgagtttgataatacattatatcaatttgattatttcataacaaaaaatcattcaaccaaagtgtaaaaggatttatatgttttttaaatttattattttatgtaacattaaatgaataaa

SEQ ID NO: 69344 - DNA, 569 bp, Heterodera glycines
  Genomic contig location: Contig_ID=SeqID_8828; Location=1268..1836; Strand=+
  SCN-specific regions: Sequence locations=1-493,523-569
atgctgcggtaaatataatctttgtggccaagcgatactcaattaaagtttgtccagaaaaagcgacgtaaacgaacaaaaaatggccagattgttgaagaatttcaaaaaaggagcaaacgaagaaaatttttcggtttatttcgatttttcggtttttttgaatttgttattttttttcaaaaaagcaataaactattctattaatagaaaaagcaaaaattcctctgagtaaaattgtagagctattgaaactctattgaatggtgtactaaaggtttgtaaaatgatagaaaaggcagccaaaaaacatgtgtttgctccttgattctaaaaaaaccacaaagattagttttagcgatttggtgccttttttggcgttttttcccgaaaaattccattaaaaattcaaaaaaatcggaaaaatacacccctaagaaatgatctaaaaaaattcagagaatatacctttatgaattgaacgccaaaattcatatattttttttttgataaaaaattttaggtttaaaaatttccttattgaaaaacattataaaattgaattatca

SEQ ID NO: 69345 - DNA, 419 bp, Heterodera glycines
  misc_feature (55)..(55): n is a, c, g, or t
  misc_feature (87)..(87): n is a, c, g, or t
  Genomic contig location: Contig_ID=SeqID_8829; Location=56..474; Strand=+
  SCN-specific regions: Sequence locations=1-57,85-359,381-419
atgacaattgcacctatgagatttgatgaagacgattggtaatgcatttattacnccaataaaattttaaaattaaaattaattctntaggaatgtgttcatgggcaagaactcatcgttgggtcacgcatgcttttcaacgcaaagggactactgcaaacaaatgcaaaaaacattgtgtcctgctgtttcaaattgtgtccgttgaatttgttaaacagcggtgcctgcggtgccattctccgctcgtccaccttttgcgtcaccaaattgaacgacatgtgcccggcataattagcaattgcctaaagaacggaagaactaattgtgagaaaaacccctattgggatgttgttaactactaattaatattaattaatctatgattaaatccatgtgtttgatgagtcatatttcaa

SEQ ID NO: 69346 - DNA, 207 bp, Heterodera glycines
  Genomic contig location: Contig_ID=SeqID_8829; Location=154..360; Strand=-
  SCN-specific regions: Sequence locations=1-207
gcaattgctaattatgccgggcacatgtcgttcaatttggtgacgcaaaaggtggacgagcggagaatggcaccgcaggcaccgctgtttaacaaattcaacggacacaatttgaaacagcaggacacaatgttttttgcatttgtttgcagtagtccctttgcgttgaaaagcatgcgtgacccaacgatgagttcttgcccatga

SEQ ID NO: 69347 - DNA, 344 bp, Heterodera glycines
  Genomic contig location: Contig_ID=SeqID_41153; Location=473..816; Strand=-
  SCN-specific regions: Sequence locations=1-67,89-101,123-204,239-344
agttttgttataatgccgaaatcctacgaaaggctacgttaacagatgtcagacggatgcgaaaagatttgtttgacaatgatttgcccaaaaaacttgatgtaattgaatgttttgttaaacaaaattcggaatttcaacgcaacaacaacaaaaatttattttaccaaatgaaggatgaactcattttgtatcggaccgtattttttaatgagcaatttgaaattcatttggaaagcattaaacaatttggcgaaaattatggcaggagaattcatgaaattgctaaactgctagaagagatacgcgaagcaaggaatcaaattgaacaacagcaaatgtaa

SEQ ID NO: 69348 - DNA, 803 bp, Heterodera glycines
  Genomic contig location: Contig_ID=SeqID_41161; Location=383..1185; Strand=-
  SCN-specific regions: Sequence locations=1-194,216-228,250-397,426 -459,490-511,533-803
atgaattctattcgtcttctgcttcaattggttcttccaggcacggtgatcatcagtgacgaatggcccgcatatctgaaaatgtctaattcgtcacaaaaaacaactggtggtggtttctcaaaaatcatcacgcttccaaacgggactgaattcaatgttaatacgaacaaatgcgaaggaatgttttgttgcattttaattataattttaatgattaatcttgttaaatctaataaaatacacattaaaattgcatgaatgtgtaaattttggtgaaaatttacgattttcgactttttgttcgaatccgggtccggggttcgaaattggtcgaaatgaatgtcatattcgtgatcagcggccccgaaagcccccggaaatgtattttcatgacttttttaaaaaattttcaaaaaggacaactttttaactagcgccgtaatgtctaaggtgtcgaaaatttgtttaaatattttttatataaaagaaagatttaaaaacggcttagaaatcctaaaattgttattttgagcaaaatccttcaacgaatggcatcctatttttgaattcatgccattctcatttttggtatactctctccacccccatggcgcataaagtagctcaataggttagactcgaatccaattagcgccgtggtgcactctttttttaagtggcgcgaaaattggggattcaatgaaaaaatattgaaatatttaagaattaagcccaaaattcgacaaattacgtccgcttttgcccacacagacccaaaaaatgacagatgaaccaataaa

SEQ ID NO: 69349 - DNA, 1975 bp, Heterodera glycines
  Genomic contig location: Contig_ID=SeqID_8830; Location=359..2333; Strand=-
  SCN-specific regions: Sequence locations=1-184,206-361,383-1152,1175 -1869,1893-1937,1960-1975
cttttctgatcatttcgtccgttttgggtgtttcaattctcggcgacgttcgtcaaacgcacgcgttgttctgtgttagcgaaggaaaagacagcaaaaaggtgcttagtgaggcgcacatcgaacgcattcaccagggaaagagggcggccaacgacatttgcgcgtggggcggacatttggcggagtgccaattggcggacggaacggcggagagcattcggtaaaaatgccaaaatgagtctcagagtgtcagtccaacaacccctttcaggctgactccaaatcggcacattctgtcccttgccacttccgcattgagtgaccattccattgaggtgccattggaaaagcctttgcactttgggcccaaaaagttccctttggtcgtttgcgtggcaccaatgtatacggtaggaacacggacacggtaggagagtgcccgaccaagatgcctttttgtacagtacaccgaatggcaaattatggtgacgggcatcgaagtttggctggcattgggcgcctccaaaatggttttcttctgaaactgtgcctattgtcctcaatttcccccccccccccccttaaggttttcccaattcaatccgcttcggcagacacaattcaaattctgacggagtatcagcgcattggtcaaattttgtgctaaatcttcatttaaaaaccaattaaactaatgtcaggcattgtccatttgcgcgtgtggcccaaatggccggtgctttccgatgcgaatcccaacggattggtcctttcccgaggcattgaagagtctcacgtcaactgtctgcactttgtcaagccgttcgccgaaatggtggtcataacggacatcgacgacatgtccgtctgccatcgatcgcattgatcgttttttcttttccttccgatcagtcggtccctttttgctttttcaggttgatgccattggacccaatgaaagttcggccgggaataaacgtggacatactcaaggtcaaaagggcaatgcttttactccctgtgaatgctttttaatgcttccgtttgttccctttgttaggatctgttccatcagcatccaaatgccggctctttgctcttcgaacatcgcgatgtccaagtgcgtttttcgcttcctttgtttacctgctattccttaattatcattgctaattgcttttaattattccgctatttgcttcattagcccccactttaaagttcgttctccccgacccatccactcaaaacactttgcgcagtttcaatttcgaattcctcgcccactccaaatggaagacgagttgcaaagtgtggcggatgaaaacgcgcgtggcggtcaatgcgagtcgcgtggacacagtgggcaaccaattaacgaccataattaggatgccgtttctcatgcttgtttgcccattcgaaggtgaacatgcacgaatcgggcatccatcggtttggcttcgtccaggtcagtcccccctcctttcagtccggtcgtccaattctctttctaatctcattcccatctccccgtttcttcgcttttaggtccgtgtgccgtgccgacaagcgcacttttatcacctgcgccactcctacaaaaacattgccatcaacgagtggcccattgacatgtcaaaactccgccaaatgctcaacgaacggtggcatttccgtgccgagtccaatttttcttcagaaatgcaatcgaaaatgttggcacgctcgtcggtggaaagctttgaaggtaaaagcaaaagcaacggccaaaagaggcaaagccatcggcgggaaaaaggggggggggggagggaagccgcggcattcgattggatttcggaatataataaaggtggaagaagtgttttaagattttgacaagtgcatgagtgccatcaatgaggagcactggcgactgcgcgtgtcgcgctgtctgacaccccacgtgtgcttctctcgcctggccaag

SEQ ID NO: 69350 - DNA, 558 bp, Heterodera glycines
  Genomic contig location: Contig_ID=SeqID_8832; Location=955..1512; Strand=-
  SCN-specific regions: Sequence locations=1-318,358-472,496-537
  Gene Ontology: Mol. function=glucosamine-fructose-6-phosphate aminotransferase (isomerizing) activity; Biological process=fructose 6-phosphate metabolism
atggtggacaaagacaaatgcattgtgatggtcatctgcaacgacaatgtgtacaaggtgggacggaccaccgtactaattgccccgttgatttaatttattattttcacgttttttagcgctcgctgaacgcactgcagcaggtgaaagcccgtgacggatgtcccattgtgattgcggatgagtcggtgccgtcgtctgaacttgccgatgttgagcatgtgctgcgagtgccacggactgtcgactgtctgcagaacattctgactgtcatcccactccaactgttggcataccacgtggccgaactcaatggatttaatgtgcctgttttaatttttggtcttttttaaaaggaatttcaaggttgatcgcccgcgcaacttggccaaatcggtgacggtggaatgagacgaaggaatcccgcaaatcgtgatgccaaaactacccatggacttaattttcgactttgattataattaattaatttattttgttaggattgttcttccgactttgacattgcaattttatccattttacttgtaattaaataaa

SEQ ID NO: 69351 - DNA, 124 bp, Heterodera glycines
  Genomic contig location: Contig_ID=SeqID_8832; Location=15..138; Strand=-
  SCN-specific regions: Sequence locations=1-124
atggcagaagtcggaaactcgtacagaccgccgctaagcgaagagaaacaaaacgaactccgcgcaattgctcagaaaattcttcagccgggcaaagggattctcgctgctgacgagagcacag

SEQ ID NO: 69352 - DNA, 169 bp, Heterodera glycines
  Genomic contig location: Contig_ID=SeqID_41163; Location=10..178; Strand=-
  SCN-specific regions: Sequence locations=1-82,110-169
atgaccagcacaatccgcaattttgggcgttttgctggacatgccaatgtagataggtaattaatctaatgaatgaattatctatatatttataaattaaattttattaccttcaagctttaatcttaggaacgactgggggaatctaattatcattgattataaataa

SEQ ID NO: 69353 - DNA, 433 bp, Heterodera glycines
  Genomic contig location: Contig_ID=SeqID_41163; Location=441..873; Strand=-
  SCN-specific regions: Sequence locations=1-142,219-352
atgcaagatttgagtctcgccatgagtttcaagcaatggagatcgatgtgagagatggattatgggacagaaaggtggttgccctgagaagcatggttgcacttccgccgaatttggaacggcttcgagtacagccttatacaaaataaaaaatatttaaattattatcacaaacattaaaaaaaatttctttataaataattaaacaaaaattaaaacattcattagttaattgtttgtttattttgcatttttaggtacccaaatcgctcaaaaactaggggatacgccctcatgtggctcaaatgttgaccagcaaaacatcaaaaaactcctcaccgaactcggctacataaattatttaaatataaatgagacagcagcggtaatttctggaattaatcattttaaatataaaatgaaaattaataaa

SEQ ID NO: 69354 - DNA, 222 bp, Heterodera glycines
  Genomic contig location: Contig_ID=SeqID_41164; Location=285..506; Strand=-
  SCN-specific regions: Sequence locations=1-127,149-222
atgcgcgaattcgtaaccagaaatgctagtcttatgaagcgaaaagtacagttatatttttctgatagtgttagtgagaattgcaattcaaacattatttatcatatattctagcattttttaggaattaaaatatttaggaattcttgtagcatcctattcctacatgttgaaattgagtcgaatacattgtgacatttatgcattattgtaaaaaataaa

SEQ ID NO: 69355 - DNA, 600 bp, Heterodera glycines
  Genomic contig location: Contig_ID=SeqID_41166; Location=285..884; Strand=+
  SCN-specific regions: Sequence locations=1-600
atgaaaaaatggatgatggatctgtcccattcagttgttaataaattgcgttcggtgagaaatgaaaccataaaattaattttgaatttgcgtcactcattatttgggattaaaaatgtttggcgatccgtccgtcctcgtctctgcccactttagctgttgcgtctgcttttggttgttatttttgtccatgtcactctcgcgcccctcgccgccctctctttgcgccattgtcttttcactttcttcgcttccctttctttttccactatttttctgctgtccttttccgtttttcagtggcataaatcgcccgtgctgatcgcgtttcgcattgtgtacagtgagcgacaacagatggtgctgatcatcgctttcgagcgcatttggtgagtggtttctgtgtaccgtaaacatttcaattttgttactgtcagtttcactcattttccattctgatcagtttcccttgctggtgtaacacgcctccctttttgctttaaatatcaatgtttcagcttaccccgtcgatgggctgtacgtgtccgacccctggtagcccgagtcgcgtgtggtcttcctcgacaaattgttcggtaa

SEQ ID NO: 69356 - DNA, 320 bp, Heterodera glycines
  Genomic contig location: Contig_ID=SeqID_41168; Location=521..840; Strand=+
  SCN-specific regions: Sequence locations=1-65,87-92,186-320
atgcgcttgcatatggttgcaattgcatttaatcgagctcatgcagtgcttttcccattcaattttgcgcaaaaagtcacaaaaaggttaacaaattattaatataattaattttttaaccgaacttattttttctttgtgtttttgatttaaaaaaataaattaatttaaattaattttattaagatttcaacggctctcaattcccgagtcgagaaatttctcgggctttttgggtctcagttctcgtaccgtttctcggggtcatttcccggttctcaattttccgtaaaaaaaaattagcttctcgcagattccca

SEQ ID NO: 69357 - DNA, 645 bp, Heterodera glycines
  Genomic contig location: Contig_ID=SeqID_41169; Location=330..974; Strand=+
  SCN-specific regions: Sequence locations=1-192,216-358,380-645
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatattaaagcatcagagtgctaaaattaagttgtaaataaaatttggtgcgctttagagcactttctgaaaaaaatatttatgaaacaaaaaaatcgattttttcaagtgtccatttggggtactcaaacatttatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatgggggagcaaaaatccaacgcagaaataaagtacaggctatagggaagctattccccgaaggattcggtctccccataaatctgggcgcatcgcgttcggggggactgccccg

SEQ ID NO: 69358 - DNA, 728 bp, Heterodera glycines
  Genomic contig location: Contig_ID=SeqID_8833; Location=1002..1729; Strand=+
  SCN-specific regions: Sequence locations=1-101,180-210,246-353,379 -425,462-482,504-594,705-728
atgagaaggataatttcttggtcaagtttcaaatgcgaattccgtcgccaaaaagtgacgggtaatgttggaatttggtccgagtagggggccgttttggtactgaaaatgtagtgacattaaatttacattttaaaatcaaattagctggtttacttttaaattttctttttgtataatcatgtctttcctatcgacaaaatatgattcttaatttttttaattgtattttatcattttttaaagaagctccgtacaaattgagcctagtaatcccaaaaaccagccttttttttgttgaaaatctgttaacaaattacacccaaatttcgtaaaaacttttttagaaatagttttaattttaaaaataaaattaatgtgttgcgtttgatagcccgtgaaaaaactttatatttggtgagttgaaattttttattatttttaaatttgaaataatattagacatcgatgaattaatttaccccaagaatatttttattcttgtgcgctacttcctgacaggatggttcagttgactctatacatttcttgatttttttaaagatcaatttattaagttagttaaaagaacggattttaattaaaaattatatttgctattataaaattttttcaaattatctaaaaaattatatatgaatataactgatgaaaaataattataataaataaaattattttttcagctagctaattatttttgtaaa

SEQ ID NO: 69359 - DNA, 1126 bp, Heterodera glycines
  Genomic contig location: Contig_ID=SeqID_8834; Location=99..1224; Strand=+
  SCN-specific regions: Sequence locations=1-133,160-224,257-319,341 -384,418-611,633-705,727-778,800-817,840-905,1101-1126
atgtgctatcgaatgatacatgaaatatttatttggttgcaaatgaaccaagttatgaatttatgtcttacattttttgttttcctatcacttggcggtttttaggaaaccacccagcacgtaaattttgatgttatattattataatatttaaaatatcacatggcgagttgtgtatagtctgtgtaaatgtcaacagcttcgtatgatatagatattgagtcttatcaattaaaaaatatatatatacaaaaagcgaaagacgaagcctctaatttgttgaacaacttgatttaatgtaaaattgaaaagaaatgtttacatttcaattaacaaaatttatatgaaattctaattatattgtccttgttttctgcaattttcaataaaaatatttataaaaaaataatttaaattcgacaggagattcccgagcggctccggagaaggaaaacttctacgtccttttcacttccccccccccccttttcgattcccggataaaattcatctttggttctctttcccactcccctccccgggccgtccctcaggattctcctcttttcggccattttcactaaaggaacacttagaactcggaccatttccattttcaccaatttctcatttacgtaatcttatttttcaccgattttcatattaaaatcacaaccattctcacatttaatcacaaccattttccattattttaaaataaataaagcgatcaagttaaatggataatggagaagtaaaaagaaaggatatggaaattataaaaagcggagaattattttaagggatttagacaattaaatatggaaaattggggaaaatcacaattatcccggggaacccaaactcgggaaaagttgtactttcggcctggcacgttccctttctaaattaattaattaagaaattttaaataattttcatcttgcaaaaaattaaaagttaattattttaataaatacaagatatttaattttctactaaataatttgaaaacaataatacaaatattttgtgataaaccttaaatatatatagaaaaaaatacatgcatttttatataaatatatttatcttttaatgcttatatagaacgagttaatatcaa

SEQ ID NO: 69360 - DNA, 749 bp, Heterodera glycines
  Genomic contig location: Contig_ID=SeqID_8834; Location=1286..2034; Strand=-
  SCN-specific regions: Sequence locations=1-87,112-379,401-473,528 -696,719-749
atggaccgaaagaacaaattgacattaccaacaaacgggaacagcagagacagtctgaactgctggcctcactttcctcgtggtaagaacaaattttctttttaaaaatatcataaaacgattatttagtcgacgactccgtctcgaatatgaagatggtcattcaacaaatgcttcaaaagtgacattggggctcaaaaatgcttttttaaattgggtacacatgatttatgggtcggtctgagtgcttatttatagactctcatactactagatatttctgatggtgctctgggcgctttgcatttacgagaatggggcgaggaagggcagcgaagcccgcggtggacaaagtgtcggtctgcgacagaacaatggcggcatcggtgaccaaggaggacgaggcggcagccgtggcggtgcccagcatggcggtccccaaattacttaacgaaaatgcaaaaaccgaaaacaattaaataataaaaaaaaatatacagaataatttagtataaaatgtttttttacagttccctatataagaataatataccccagtttcaagcttaaaaactaatttaagactttttagcgcgttttatgggtcgggagtggtatcattcgataaggttttggactggctataagggaaaaatagtgcggtttcgatcggtttagaactgttcgaactgtgtttgaaaaatgactcaaaaaatcaaacttttttgaatgtttttgtgactattaaa

SEQ ID NO: 69361 - DNA, 292 bp, Heterodera glycines
  Genomic contig location: Contig_ID=SeqID_41173; Location=177..468; Strand=+
  SCN-specific regions: Sequence locations=1-292
gaaattggccgacgatgcctttcaaatattgcctttgcccgacatcgacccgagcgtcacttcgactccggcggtcgtcaacaatttgatcgaggtttggcacttaagttcttggcacttactttcccgtctcttttaggcggtcgagtcgctcgactcgcggatgcctttggcgttccaagagcagcagcaaatcctgaaaatgcagagcgaaatgctgcaactcggcgtcagttgcaaggaacactacaagaagatacatgagcagtccgtgatgcgttacaatctcgag

SEQ ID NO: 69362 - DNA, 953 bp, Heterodera glycines
  Genomic contig location: Contig_ID=SeqID_41174; Location=117..1069; Strand=-
  SCN-specific regions: Sequence locations=1-595,633-751,774-901,923-953
atggcaactgaagcgtgctcaaaaagtacacttcagtaccaggtgaataccgcgccagggtttgatctgagcggggggtggtcagcgaacttattgtagagatttgaaagctcgattttttgacattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaaattttggcctcagcgggacatttgagtcccgggcccataactcgtcaggggttggttttatcgaaaaaactccttagggcaaaattgtagagctttttaaatgctatcgaatggtgtactacatgttcgaaaattttcaaaatttttcgagctaggccccctagaaattttcaaaaattttttttgggttgaaaaagggggtcaaaaatatttttctggggtattttgaggtgctgagcacgaatatgatgtttgttttacgtttcagaatttttggaattttttaaaaattccaaaatatttttaatttttttggtccttggaaatttggtcgaatattcgaaaattcataactcaatggaggactggtcaatttaagtgaattaaagctttaaaaatagcaaaaaaatcgggagaattttatgggatttatttggaatttctatcttcaaatgaaaaaaagttattccagaatttctggaaaaatccgaattttcagaaaaaaattcttaactcccttctgaaaagtcattttggaaaaataacatactacaaaaatccgcaattttttgctctaccaaataaattttatttggcatttttatcacatttttaaaaaaagatacaaaaataaa

SEQ ID NO: 69363 - DNA, 895 bp, Heterodera glycines
  Genomic contig location: Contig_ID=SeqID_41177; Location=155..1049; Strand=-
  SCN-specific regions: Sequence locations=1-134,160-224,246-745,767-895
  Gene Ontology: Mol. function=structural molecule activity; Cellular component=focal adhesion; Biological process=cell adhesion
atgagtgtggacaagaagactaaggttggttgtgccaaaaccgttcccactttgcgctattaaggtagtcagaaaactttggccaatggagcaaattcggagatggaccgccggtccgaccacttttaacattgtctgtttgtctgtttctgtctgtttcagtaccgcgtcgcctttcggcgacttttgcaggactttggcgactaccaagatgggtattactccgtgcagaccaccgaaggggggaaaataaagagtttacttgctgagttcgtcgacgtgatcatttggaagaagaaactcgtcgacccattcggattggagggcgacgaaggtgccattatgatcgaggactttgtacttcgggctcgttctgtgccggtgacctttgatgacgtagtcgaagaggaggaggcgacgccgataatgtccaagtcacacccggcagcactgtccacgccaacaattctgggacccaaagagcgaattgtgcatcggcatgattcaacgaccaattaattggcacttttaaggcatttccggcagattcggaccgattccctcgcccatttggcagtccatcagccactctacccaatgagttcccacggcagtttgacccatcggcgcttcaccagctccaaatgccggacgaagcccccaaactaatggcacttcccgtaaaagcagaacaatacgaccaattgccattccaagaagcaccgccaattgctaccaaatgttaactcacttttgaacttcaaaagtcatttctgcttcagttactcctccaaattctccgtttcgacaacaaattgcgcccgttcaattacgaccgaatttgcccgatgagtcactttctccgccatttccgccgttgtcttattgtaataaa

SEQ ID NO: 69364 - DNA, 83 bp, Heterodera glycines
  Genomic contig location: Contig_ID=SeqID_41178; Location=365..447; Strand=-
  SCN-specific regions: Sequence locations=1-83
cttggttaggtggatagagcaccaatgggttcttaagaaaaatggttttattttctgccaaatgagcacgagtgccgagttat

SEQ ID NO: 69365 - DNA, 194 bp, Heterodera glycines
  Genomic contig location: Contig_ID=SeqID_41181; Location=766..959; Strand=+
  SCN-specific regions: Sequence locations=1-194
ccgggactcaaatgtcccgctcaggccaaaaattttttctatttccgggaaaaaatcgaaatttttccaaaaaaattaccaatcgatagagctcgaaaaactatgttttggaagtggtcttcgtttctctgggaaaaatcgttaaaaaatcctaaaattcaaaaacccgaaaaccgatttttaggcctaactcg

SEQ ID NO: 69366 - DNA, 655 bp, Heterodera glycines
  Genomic contig location: Contig_ID=SeqID_8835; Location=622..1276; Strand=+
  SCN-specific regions: Sequence locations=1-117,139-443,470-655
atgaaaaacagaaaaggtgaaataatggagctattaaagtttctttgcagtttttcaaaagaatgcttggtataccgtcaatagaagtattgtttttatccttaagtttacataatgaaaaataaatttcagcatgtgttatagtaaaaaaatccatacttttttccagagattttttggaaccagtgggttcgggttcaatgttttgactagtgaaaactgagaagaattgtttagccaaggcgtcagatttatccttattggtaaaagcaacctttgaatttttatcgtttttaaaaacaggtatgctattgctttttgttttgacaaatgaattaatatagccaaaacgtttctttgcagaggtcgaatttagtaatttgttctccttgttcttataaaacttcgaggtttcaaatgtaattttcttagaaatttcaacatatttttcccttattctttcttttttaatgtctttccaaagtaatttccgataattaattaatttctgaatgtgttcaggcaatttgggctcaaaattgctttggactaatgggacatattctctaattaaaaacaacaaaaattgattaattttatgaaacattgagtcaatctcagtgcaatctgaaaagaaaaaattccagttaatcga

SEQ ID NO: 69367 - DNA, 1483 bp, Heterodera glycines
  Genomic contig location: Contig_ID=SeqID_8835; Location=1..1483; Strand=-
  SCN-specific regions: Sequence locations=1-105,133-393,420-724,746 -1139,1161-1483
tcaccgacaagagggaaaaatttttcttgatcttctatttacaaataataaacaattaatatcaaatgtgcttgttggccctccctttaacattgtgatcataacagtatttcatgtgaaattaagctaaaaacttctaagaaaattctaaaaaaaggtttcgattttcgtagagctaattatttagcgattaactctgttctttattcgattaactggaattttttcttttcagattgcactgagattgactcaatgtttcataaaattaatcaatttttgttgtttttaattagagaatatgtcccattagtccaaagcaattttgagcccaaattgcctgaacacattcagaaattaattaattatcggaaattactttggaaagacattaaaaaagaaagaataagggaaaaatatgttgaaatttctaagaaaattacatttgaaacctcgaagttttataagaacaaggagaacaaattactaaattcgacctctgcaaagaaacgttttggctatattaattcatttgtcaaaacaaaaagcaatagcatacctgtttttaaaaacgataaaaattcaaaggttgcttttaccaataaggataaatctgacgccttggctaaacaattcttctcagttttcactagtcaaaacattgaacccgaacccactggttccaaaaaatctctggaaaaaagtatggatttttttactataacacatgctgaaatttatttttcattatgtaaacttaaggataaaaacaatacttctattgacggtataccaagcattcttttgaaaaactgcaaagaaactttaatagctccattatttcaccttttctgtttttcattaatgtgtggcaaaattcctacaatatggaaaaaatcgattgtttgtccaatcccaaaaattccgaatcctgctaatcccattgattttcgtccaatttctttgctctgtacaatgtcaaaaattttagaagaaaatatagctcgaaatataagagattttgttgaaaccaataagattttaccttaatgtcagcatgggttccgtaaaaatcgatcagttatcactcaactcttagaagtagttgatgattttagccaagctttagaagaaaagaaagcaattgattcaatttattttgatttggcaaaagcttttgatacagttccacacaaccgattaatctctaagctcaaaaacattgggataaatgattcattacttaaatggattagtgattacttgtccaatcgtaccttttatgtaaaagttggctcatctttttctgatgagtataattgtttgagtggtgtaccgcaaggttcgatcctggggcccttactatttttaatatatatattcatgatattacggatttttgtcacacggaaaaggttgaaattaagctatttgcggatgataaagaggcctaatttctgatctccaacttcctaaaattgat

SEQ ID NO: 69368 - DNA, 869 bp, Heterodera glycines
  Genomic contig location: Contig_ID=SeqID_8836; Location=475..1343; Strand=+
  SCN-specific regions: Sequence locations=1-12,46-221,256-259,310 -358,380-385,417-630,652-869
atgaatttgttgtatttaatatttattataattttctttatttttgtaattgactccgacaaaattcgaccaaattttgatgaaatatttggcaacggatgggacaaaaaagaaagtgagcaaacagtgaaaattgaacaaaatgaacgaaatgagaactcacaatcagcagcagttgatcaaatgggtgaagaaatgggaaatgaccgaaatgatcaaatgaaaaatgatcacaaaaagagagaaataattttgaaatttgaagcaattaaagaaaaattgagagaaaaaggaaaatacaaatggaaagatcaaggcaaaattgagacaaaaattggaaatttattaggaattggtcgtcataaaatatacaaatggaaaaatgaattaaatctaaataaaaataaaataaaaaaggaattttatgagatgaaaaagagtgaattcattaaacgatttgatgaatttaaagatttatatggccaaggcaaacagaaagaatttgcgaaggaattgggcatttccaatgacacattttggaaatggaaaaaaagaattggtgccgaattaccataaaagtcaaagtagaatataattttagtaaagttaaatctaattttaatttaagagcaatttaccaatgaggacaaactgaaaaagatgaagcaatattttaaaataaaagaagcaaatccaaaaattattgacgaaataattgccaagaaattgggaattggaagtgcaactctgaaaaaatggaaaaaaagaatgctctcatccatttgatcagtgattttttatttgattctaaactataaaaatattttgtagggcatctaaaactcgccagtttttttagcattagaaaa

SEQ ID NO: 69369 - DNA, 650 bp, Heterodera glycines
  Genomic contig location: Contig_ID=SeqID_8837; Location=95..744; Strand=+
  SCN-specific regions: Sequence locations=1-53,76-223,249-650
atgtcaaatggacaagtggaaagatttttcgacacatttaagagagcattcagaaaattaaaaggggaggggaagccaaacaaggaaatcatcgacacttttctgatcacctatcggacgactccaaacgacacacttcctgatttgaagtgtcccgctgaattgctgctccgtcgaaggccaaggacaacgattgatctccttcggccaccgccacaccaaccatttgaaagtgatttggagatggaaaggcatttcaaccgtagatttggcaccaaaaatcgaaaatttgttttgaatgacaaggtttttgcacgccatcgctcctcgcaaaactggaaattggagtgatcagtggcacatttggagtgatttttgacgtcaaatttcccgacggatcattcggccgttttggcgccaatcaattgtgcgacaggaaaacagccgacaattttgatcagtccttggccatattaaatgaggcatttgatttgccattgcctccggccccgaataatgcgccacccgaagaagaaaatgccaatttagggctcaatcaactggaagatgaggctgcgattcccattcaggacaatttggctgctccaattgaggacgtcccaattcaacgacgcttctgttctctccgt

SEQ ID NO: 69370 - DNA, 946 bp, Heterodera glycines
  Genomic contig location: Contig_ID=SeqID_41183; Location=143..1088; Strand=-
  SCN-specific regions: Sequence locations=1-11,33-217,240-304,326 -332,371-406,429-447,470-505,527-946
atgccattattcaattttcttcttccattggcattgtgttgtagtgccattttggcgattggtattccaaatgatggccaaatcgtagaacatgacaagaaactgttgccaaaatgggagcaaacgccgtcacccagcgcaggcacagatgtggcacagatgaggcgtaagctcaaagcatttagtgaaggaacagatttgagacaaaattcacgacgaaatggcaacgggaaggatgtacaaaacggacaaatcggtaatcaattgtgggtttattataatttgattgttttaaattctatttttatgcttttttaaattaaaggcaaagctttttttaaatttattttcaattgaaaaaaaaaataatgtccaaatatagcattgttttttacctcaaaattggtttaaaaattttaaaaaatattgatactttctttttgtacatttttgggggcccgcttttttcaaaaaaattcttgtgatagtcaccgccaaagggaaaattttgcatttttatgcctttctgtaaaataggtattaatcataaaatttgtccaccctcaaaactcagactcattagcttataaattcagtacccattccggacaagaagaaagggttgttgagatggcagaatatgtcgcccagcgcaagtccaacagtgacaaatatgaggcaaatgctcgcggcatgggttgacaagacaaattcgagacgaaattcccgaagaaatgccagcgaaagggagcaacaatcgttgtacggatattcgaattacttggatttgtcggcaaactcaagcccagcggcgtcagattttgctttgaccccgcagcatcggtgggaataaaaattataattatggcatttaggcatttacattcaaaacggttttttatttaggggcggaaaattccaattaaggggactaaaaagcattaaa

SEQ ID NO: 69371 - DNA, 494 bp, Heterodera glycines
  Genomic contig location: Contig_ID=SeqID_41184; Location=167..660; Strand=-
  SCN-specific regions: Sequence locations=1-249,272-451
atggctttgctttgtgccgccgagcccgactgtatggtgccaattggacagacgattaagtgcgtttatatgcccactcctccgaacttgacttgccatcgacaggaccagagtctgatggaaattctccgctacaacatggaatatcgacagcaaattgagggtatgtttaaaaatcggagtgccaatgccgacttttttggttttcggcacttctatgcccggctttttcaaaaattcctgtcgcattcttattttcaaaataatttatgctttttttaaaaacagacccatcgtttgtgacccaactcgagccctgcccatccgcgcagttcgaaccgaccgttgcaatcgacggggatcagcggatttttcaaattggaccgtcgtcaaaattttaaaggttctgcagctgaatggcgccaaaaagttcagtgttgctgatggacacttttattttttattatttttccaaaatttatattgaaaataaa

SEQ ID NO: 69372 - DNA, 782 bp, Heterodera glycines
  Genomic contig location: Contig_ID=SeqID_41188; Location=63..844; Strand=-
  SCN-specific regions: Sequence locations=1-782
ctctttcgcgccacaatcggggtcatcggtacctgtcgttgcggttgatgtcctatccaaacgtctgtttgttgtaccgctgagaaacaagagagccgaggagatgttggaggcattcaagcaactcatcgatcaaatgcccatggcgccccaccgagttttctccgacaagggcaccgagttcaagaacagattgctcaaggatttttttgaggagcgggaaattgagaagcacgaacccgtccattcgacagttaaagcatcaattgcggagcgagcaatccggaatgtgaagcagagattgtataggtattttgcggaaaaggagacactgaattgggtggatacagtacagaaaattgtggacggaattaacagctcgccctcgcgtgttcacgggatgcgtccaatatttcaaatgctcaggtgtagaagcgaatgtaccgaccgcaatcatttgacagaaaaactccccgcttccataaagataaatttgtacgcatgagcagagataaagggcaattagagaagggatatttacaaaattacggggatgaaatactggagattgatgaggtgctggaagcggtgcacccaattcggtacaaactactggatgagcatggcgagaaattcaaagaaagcttctatgagcaggagctggcgcgcgtaagaaaggatgcagagacaagctaccgtatcgagaaggtgttcagaaagaggaaaagagatgatggatcaaccgagatgcttgttaaatttataggatatcccaatcggga

SEQ ID NO: 69373 - DNA, 822 bp, Heterodera glycines
  Genomic contig location: Contig_ID=SeqID_41190; Location=581..1402; Strand=-
  SCN-specific regions: Sequence locations=1-15,39-206,229-534,636 -653,675-740,771-822
atgaaacagtgagtcataaaaattattattatttttttcaattgattttgccaatctttctttaaatttcattgtgttatttttagtattgccttcatcgggttggctgaaaagcagcaccaaatttcgtttgacgaaacaattcattgcggcacggcgatttacgaatatgcaagcggcggttatctttggattagcggatcatcgagaaaatcaaatgccaagtactcttttggtgtcggtgatattgtcggatgcggcgtcaatttggccattcgacaaattttcttcaccaaaaatggacaccttttgggttggtggaaaataagtatttccattttcaattatcaattttcaaggagtgtttcgagcattttacatttagtttgcttaagaatatataaagtacataaaattagacatattacaacattttatatagttttgaaatttttaattctgtatttctcaatttgtatgaattattgcgattcttaacatttgctacgactgaatgactatttaaattaatgttttttttaattttccttttttttctttttttagcttcttccaaattgttcgttcctcctcctcctcctgcttcgtcgtcttcttcttcctcttctgtttttgatcttccgttggttccatttatttcattgttcagctttgatgatagaatcgaggcgaactttgggcccaatttcaaattcgatttttcaattctttgatgattcaaaaattttaattttcatatttaattatttgtgacaaatttgtcacttaattatctttgtatttatcgaatattcaaataaa

SEQ ID NO: 69374 - DNA, 1552 bp, Heterodera glycines
  Genomic contig location: Contig_ID=SeqID_8838; Location=94..1645; Strand=+
  SCN-specific regions: Sequence locations=1-380,402-903,925-1120,1142 -1303,1328-1408,1449-1552
  Gene Ontology: Mol. function=transcription co-repressor activity; Cellular component=cytoplasm; Biological process=small GTPase mediated signal transduction
atgtccaattccgaaagtgttccaccttcgcccacttcgtcatccgctgggggtggtgatcctctgacatattccgctccagtgaaccaacgaagcatggctaggatttcggcgtccactcaagcggcgagtgagttaaagaactttttgttgttttttcaagtctattttagccatgatggtcaattccatcccggctggtcttgctgcgccgcaacaaattccgcaaacttcccaagtaattgccgcaactgttattagtgcgaccggtgcttctggcgttttgcaattgggtcagcaaagctcaaattctgaatttctgtcagccttcgaatgtcccgtttgtcttggtcggtacaaattaaaaagtaattcctaatctttatttttcaagattacatgcttccgccatatctgcaatgtccatcgggtcatctggtttgtggaaattgtcgtcctaaagtcactgcttgcccgacatgtcgaggtttgttatttgatagtcattcctttcttctaaatgttaaatacttctaattcaggtccaattccgagcataagaaatcttggaatggagaaaattgcagcaaggtttgcgaattcatgcaaaagacattcactttccttctcacaatcagcctgcaatttccatgcaaatttgctcattccgggtgcacccaattcttttatcatcatgagaaagttgagcacgaagagatttgcgagtttcggtatactcaaataatttggaaatttattacttgtttttacttagtccttaccaatgcccttgtcctggagcttcctgcaaatggcaagggagtctggcagatgtgatgagccatctaatgaaattgcacaaatcaatcacaactttgcaaggcaattttaaattcccatacaatattttgtctttctttcattgactcccaattctgttaatgcccaaccaacaggcgaagacattgtttttctggcaactgacatcaacctccctggggctgtcgattgggtaggctttgtgcctgttttgaatgtccaaactgcgcttataaggtaatgatgcaatcgtgctacaacgcctttttcatgctcgtcttggagaagcaagacaaacaagagttaaatttatttactttttcgcgctgatttacacaattcagacaatcaggtcaaagctaccaaatgttctacgcagttgttcaactaattgggaccaaaaaggaagccgaaaatttcgtttacaagtattcatatttattaggctagtacataattttattcaaaaaacatatttcaccactttttaaactaagaatttatttaagattggaattatccaacaatcggcgtcgactttgctgggaagccagtccacgaagtaatttaattgacatgggttattaccaaatggggcacaccagacaaaaaacaagcaaatttttatttaacaggtattcacgagggggtcgctgccgcaatttctcaatcagactgtttggcttttgacacaaatcatgcgaatttttttgctgaaaacgggaatttggga

SEQ ID NO: 69375 - DNA, 1915 bp, Heterodera glycines
  Genomic contig location: Contig_ID=SeqID_8839; Location=517..2431; Strand=-
  SCN-specific regions: Sequence locations=1-230,262-1250,1282 -1470,1492-1915
  Gene Ontology: Mol. function=prolyl oligopeptidase activity; Cellular component=cytoplasm; Biological process=protein metabolism
ttgcgtccagccaggcgatggtgaatttattgaggaggacaaacaacgaaaattagagagagcatggccagttgacggcgacaaacttctcgtctgctacttggaggatgtgatgcattcgactcgaagcaggttctgggtgttaaaagttaacgttttcactgactaaaacaaattttcaaaacaggttttctacccacgcgatgacggcacaaaagtgagtaactcgaactttaaaacattttgaacattaataacagattccgatgttcattgtccaccgaaaaggcgtgaaattggatggcagtaacccggcaattctcaacggcttataagcatgatccatgttcgcagaagtacgtttcctttatttgtctattcaagttttggttatttgtaatttcttttattagatgtgcgattcttccggaagagaagaatattttttttgtaactgcccaaattggcaatgacccgaccaagcagctattttatatggacacaaagggacaagcaataaatggaccgatacctcttgtgcctttgttcaataaatcagatgccaaataccaagtaaccgatcacttactaattctaattgtttttttctttttgaggtgatggattcggacgaacattcggctctcattttgacaaaccacaacgcaccgatgttcaaattagtgcgtgtcaaacttggcgaacatggcgttgtcaactcgaacgatcaatggcaggttgtgattgaggaggacaaacaacgcaacttggggtgggcgtgccctgttgacggcgacaaacttctcatctgctacttggaggatgttaaggtaagttgagtgaccgtttatgagaatttcgaaagcagtcataggacaacggcttaattgtttttagaacgcgctctacgtgcactcactcgacgggcgtgagctttacaaactgccgttgccgatcgggtcggtgggcggtgtttttgcggaaaagtcaaagtccaaaatattcatcggcttcgagtcgttcctcgtcccgttcatccttttccatggcgatttctcaaaatgtccgtcccgcgagtcgcctctccaactgactgagacccgtcgcgtgaatgtgcccgggttggactgtgatgcattcgactcgaagcaggttctgggtgttaaaagttaacgttttcactgactaaaacaaattttcaaaacaggttttctacccacgcgatgacggcacaaaagtgagtaactcgaactttaaaacattttgaacattaataacagattccgatgttcattgtccaccgaaaaggcgtgaaattggatggcagtaacccggtaattctcaacggctatggcggcttcaacattgctcagactccatatttctccgttactcgcctgatgctcgctaaacattttggcattgtatcagtaattgcaaatattcggggtggaaggtattgatgatcgcttgttttttggtttattgtttcaaattcagcgaatatggggaaaaatggcacgaggcggggatgctcggccgtaagcagaacgttttcgacgacttcattgccgcggccgaatttctcatcagcgaaaaatacacgaacaacaaaaagtgagttgtggcgctttatccgttcgtaaaactcgcaattcctttttcaggttggccatccatggcgggtccaacgggggattactgacggcagtctgctctcaacaacggccggacctcttcggggccgtcgtcacccgtgttgggtaagtaagcaataacagcagatttgctatttattatgaactttttttagcgtccttgacatgctccgtttcaacaagttcaccgtcggcgctgcttgggctaccgaatatggcgaccccgacaaaccggacgacttctccttcatttacag

SEQ ID NO: 69376 - DNA, 210 bp, Heterodera glycines
  Genomic contig location: Contig_ID=SeqID_8840; Location=5..214; Strand=-
  SCN-specific regions: Sequence locations=1-210
aacacgctctacgtgcactcactcgacgggcgtgagctttacaaactgccgttgccgatcgggtcggtgggcggtgtttttgcggaaaagtcaaagtccaaaatattcgtcggcttcgagtcgttcctcgtcccgttcatccttttccatggcgatttctcaaaatgtccgtcccgcgagtcgcctctccaactgactgagacccgtcgc

SEQ ID NO: 69377 - DNA, 915 bp, Heterodera glycines
  Genomic contig location: Contig_ID=SeqID_41192; Location=90..1004; Strand=-
  SCN-specific regions: Sequence locations=1-37,59-103,125-185,222 -270,292-522,544-591,613-814,836-915
atgatcagtggcaagcgttggattgacaaaggacagccctccggggaaaggaacgcagaacaatcgaccgcgaattggaggagtccaaaccctcaaacgtcacaacaccaccaccagcggggtcacttcaacaataaaccgcatcggtcgtcatctgggtacagccaacatcaacagtcccgaccatatcagaatcaatacaacaacaacaaccaaactccatacaaaaacactggcagtagagcctcgaactacgaagcgaatgcttcccataacatgaagtaagcactttaattcgacattagtgaagtcaatcatattttatctctgatagaaacaaatccgacgtaaccaatgagccgagagtgactacaccgtcgggaccaatcgcaaaaccattcgctgaaccagttgttgcagcgaacagcggttgcccatctcagcaagtccaattgcacagggaggaacagcaaaccccacaacaaattccacccgatccggaaatcatgggaaaagaagtcaaaagtgagaaaggatcagaagggactgaaaacaaccagaaggaggaaacggcactgattattgaggagaaaataaaagtgaaggagggaagtgagaatggcgagcaacaaaagtaaagcatttagcatttcacaccttccactttcgtctaatttcagagagaagttcaaaatgaaccccgctgccgccccatttattccaaagtcaaaggatctcaatacaagttcggctgttgtcactgcaaatacgagtccgctaatgtccaacccaattcctcctttcatccaattgcctgcttcaattccaacccaggttctaaattttgtacatcaaatgtccgtttaagttataacgttaaacaaaatattccatgaatttttgagacagattaaa

SEQ ID NO: 69378 - DNA, 121 bp, Heterodera glycines
  Genomic contig location: Contig_ID=SeqID_41194; Location=1114..1234; Strand=-
  SCN-specific regions: Sequence locations=1-121
cctgtcgctgtgctttgtactatcatttccttatcaaatgcctcccccaatttcctctcacagcccaaaatatgagaaaaacgagttgcacacacagaacaaaccgtcgaatgctgttgag

SEQ ID NO: 69379 - DNA, 684 bp, Heterodera glycines
  Genomic contig location: Contig_ID=SeqID_41196; Location=416..1099; Strand=-
  SCN-specific regions: Sequence locations=1-17,50-101,135-227,249 -354,376-684
atgagaatctcaatcatttttgcaattttcttctgtattttttctgttgcgcttcgtgactcgtccattttggcaatgcaaaacattcatggaagtgagtgtaaattaaattactatttaaataattaatatttcttttcagccgaatgcaaacggcacattcactgcccggacaagctgttttgcctggaaggattctgtgttagtgcgcaagaattagctaatgaactgcatcttttctcattctccgtcgcacaaccgcgcaatgatcgaatgcgacgacgaaaataaaaacggacgaaaaattcatggaaaaatatttttcaatattcgttttttaagtgaaattccaaaaaggctgataaaatttccaaatgacctacctgctaatgaagtgaattttcctcactttctaaaagtgattattagggcggcaaattatatgtatattttttcctcgactgtttgaggcttaaatgcatgaaaaatattttttagcttgattcaagcttctaggaccaagttccacatgcatattttgtatttttcgcgatttaattattttttaagtgcaaaattatttttattttctcgataaaattaatcaaactgtaactttcattgtaaatatgtgccaaaaatcagtccaaaatggaaatttcgggtttttcttaaattaataaa

SEQ ID NO: 69380 - DNA, 257 bp, Heterodera glycines
  misc_feature (248)..(248): n is a, c, g, or t
  misc_feature (250)..(251): n is a, c, g, or t
  Genomic contig location: Contig_ID=SeqID_41196; Location=1..257; Strand=-
  SCN-specific regions: Sequence locations=1-49,76-118,140-208,230-257
aacaaagcaaaaatatttattggaaatgaaaaattggaaatattttaccaaaaaataaaatatttaataaatattgtttagccttgctttcattaatccatgctgctttttccacttctttcctctcctccttttccatgaaaaattcaatggaaaatgtttttggcagccgattttgtgccttcaggcaaagtgtccacatatttcatgatctctttcaattagtgctgaatgactttccctgctgncnngtcatt

SEQ ID NO: 69381 - DNA, 1701 bp, Heterodera glycines
  Genomic contig location: Contig_ID=SeqID_8841; Location=644..2344; Strand=-
  SCN-specific regions: Sequence locations=1-32,69-844,866-905,929 -1393,1415-1701
tgccattttcgtctttttcgccgtcccttccactgcttttgctgtgctgcttcttctctgcacttctcctcggctccgtcccgtcgttgtgccatttggtcggccgtgccgacggcgacagcgacgacgaccctcgcctgtcgctgccgtttcttctcgctgcaattacgacgtgctttttctcgctgaatctgttgtcccccgtttacggcgatcgcgcagagatcgaatcgcacattcgagaaggtagaaaagtgtttgagcatcaaaatgagacagagttggagccgatgtcgcaacggatgggcgacgtcttcgaggcgtttggcttcttagacttggccgagtcgttgctgcttttggaggcatcgctcaaaaatgtcggaagggacaacggacagcagcagggtatggcacgactaaaggtggttctactggggaatgacatttcagcattttgcacaaaaaaaagcaccgcggttcgccttttcggcactttagtcaaaaaaagcaccacggtggccatattgcaaaatgccattgaatgtgctcttggtgtcatctccattttcttaatttgaaatccaattatctgatggcaggcacttgtaaatgcatgcgttgacaacccgtattaccacgatttgagcggtgctctgatcggattcatcaccaacatgaaggacgaccgtactttgaagaacaatcataataaattgagaaccatcccaaacagaatgttcagtttgctgctcttcgacagaatttacgggacatttgaacaacaaattgccgaaataatcgaccaaaaagtccaattgaaaaattacgcaaataaaaatgccaattttgcaaaatgccattttgttttctttaagattcattctccatgtgatgtgagtcgcgcagaatttgccttaaaatggctgaaacaaatgcgaaaagagatcagcaaacggtacggatcagtccaagtcaaagcgcagattaggggaaacatccgggattttgaacacatcccattgaaattgaaagagagtttctaattttcagttttcctaccgaaacttttggaaattcatttatttcgcaatttgtcattttctttgcttcttctaccgcctcttttattagctaagattgatcgctcgagcatatttcactctcactttgtattggatttaatgttttccatttctatggaaattgtttcagtcttcccgaaaaagggtcctttatctgatcacttactccatggggcccatccttcggcgggagtatttggtggaaccttccccaatttgcccaatttcccttttgatgatccgattgaaaattcagttacgagctgaatgaagcgaagatgaagcatctgttgacagagaaaagcagagatttggagggactgatcaatcggacggaaagcgaacggaaagagacgagagaacggctggggaaagcgttcacacggagaatggaaaagacgcgtgacaaatcggcacgaaatgaggcggcgaattcgcacttgggccaattgggcacggtggacaaaacgcacggagaaacgtcgcaacgattcggcgaggcaatgcaaaatggggacgaaattggccgaatcattggcgaaatgggcggcacgggcgattgggtggtgacggtggtgcgggcacagatcaaactcagtctggcgatcaacgagca

SEQ ID NO: 69382 - DNA, 302 bp, Heterodera glycines
  misc_feature (5)..(5): n is a, c, g, or t
  Genomic contig location: Contig_ID=SeqID_41202; Location=554..855; Strand=-
  SCN-specific regions: Sequence locations=1-252,279-302
caaancagcagcagcgacgcacctgctgcatttggccgtgcattcgcgctttgctggagggccaacaccaacagcaaaaacagccaaacccgcaactgcaggcaaattcattcatgtatacatacattggttattttttcaaggtcctaccgatgggaatgcagcaaatccaaggaagtggaggaatgtgatccttcagcagatggaagaaattcatccctatttgctttacacattgtaaaacagatcagctatttattattttataataatttaaaccgaataaaacgaaaatccgcgaa

SEQ ID NO: 69383 - DNA, 891 bp, Heterodera glycines
  Genomic contig location: Contig_ID=SeqID_41205; Location=1..891; Strand=-
  SCN-specific regions: Sequence locations=1-378,407-486,509-534,558 -653,695-891
gttcaccaatgcttccgctgacaccagcaaaaagattcgtctccaaaaagcattgtgtcgattcaattcgatggctctctctccaaaggacgacttttgcgaagacaattccggtggtttttggttcacttatcaaatgctttctatttccttaatctgggtaaatgccattcagcccggtccgcttctgttttcccatgtttatttgccggaacggacgccggacggacagccgcagcgcaaaccgtccgaacacccggactttatggtgagtacgggcgaacaatcacttcccttctgtggtggcatttgacaattgaaacctaaaaattgtcttttttctgtttattttttacctttgctgtcgcttaatttcccaaaatctaacatttttgtaagttttctacaaaaatggcttttttatcaaaaacttaatattctacggaattaagtcatccggcggtgccgataaataccgactgtgaatttttctaaaatttaaatttttcttgaaattaaaaaaatgggaaacgaaaatttagttttaaaaattttttccagctgggaaaatagttcacccattttaaaaattgcaccaactatagaagcgattttagaaatacgatttcatggcggatcccgaatttgaaaaaccaccgccgccggtcgaactttttcttcttgaggatataaaaggtatttcggaaatacatatacgaaaactttgtattaaactatagaccttggcgaaaagtttgacattgtcaaagtgtccgccgaagtcgcgcgttgggatttgctgctgaagcgaagggcggtgtacgcgtcgccgttcaatttgaaatattacgaggggaagagaaaggcaacaaattgtggagggacattagg

SEQ ID NO: 69384 - DNA, 216 bp, Heterodera glycines
  Genomic contig location: Contig_ID=SeqID_41205; Location=982..1197; Strand=-
  SCN-specific regions: Sequence locations=1-216
aatattcctactataaacatggtcaatggaagattggaatgatgaagggacacagcaaaatgtggagagaacgccgtgaagaaatcttacgctgggacccaaatgccgacctgtggaaatattagagaggaggacgaattggacagacttttcgatcggacttttaggcgccactgatttgatttgttctttaaaaatgataaaaacaattgtttg

SEQ ID NO: 69385 - DNA, 590 bp, Heterodera glycines
  Genomic contig location: Contig_ID=SeqID_41208; Location=26..615; Strand=-
  SCN-specific regions: Sequence locations=1-417,455-590
atgacatccgctgaaacggttaaagaagagccggggcgcgagtttatgtcggcagttaaaggacgacgtgagcaggacagaaaggaatgggcagcctattggaatattcgatggaaggaggtggaggttggtcagtttgggggaccaattgaaaggcgttgcttctgtgtcctcttcactgatcatttctgttttgctcagaattcattcgtcggcaaatactcttattacacaaaccgttttttggattggccggtcacttggttccgtgagaacattgtggagcggctgcacgacaagcacaagatgccgtattaccatcgcaaaatcagcagagtgcccgaaatcgacgaatgcggcgtcaacgaccgagttggatgccaatttggggggggggaccaacgaaggactggggggtattataaatgaaatttttatttaaaaagaaattattgtcggaaagtgcggtggcaaaaaattataagcttaaaattataccggcacttttttaaattgtcctttagatttgtctcttcgaagctgaagaacaattccgactggacaaattggtggaacagtacattcgcgat

SEQ ID NO: 69386 - DNA, 766 bp, Heterodera glycines
  Genomic contig location: Contig_ID=SeqID_41208; Location=855..1620; Strand=-
  SCN-specific regions: Sequence locations=1-766
  Gene Ontology: Mol. function=DNA binding; Cellular component=DNA -directed RNA polymerase II, core complex; Biological process =transcription from Pol II promoter
ctttctgcaaacaaaggcgaaattggcgacgccacccctttcaacgacacagtcaatgtgcagaaaataagtgctttgcttgagggctacggctaccaattgcgtggcaatgaaataatgtacaacggatttaccgggcaaaagttgagcacacaggtcccagaaaaacaatgcgaatgtttgtgatctgtggttaatccatttcctcatgataacaggtgtttctgggcccaacttactaccaacggcttaagcacatggtcgaggacaaaattcactcacgcgcccgagggcctgttcaggggatgaaccgacagccaatggaaggcagggcacggtaagaagtgttaaacaaaaccatgaacacttcaatgccttaagtgacggtggactgcgatttggtgaaatggaaagagattgtcaaatttcacacggcgctgctcaatttttacgggagagactttttgaggtgtccgatccatacacagtttatgtgtgcaatcaatgcggattggtggtgattttcaatcaacggacgaacactttcgagtgcaaagtgagcagcatttgccttcctaatcgagtattcatgctttttaattacgaatttatttaggcatgtcaaaataaaacgcaagtgtcagctgttcgaattccttacgcgtgtaagctgttgttccaggaactcatgtccatgtctatcgcaccgcgaatgatgaccaaatagtctttgtttttgtttgttcatttttttatttttgaattg

SEQ ID NO: 69387 - DNA, 1124 bp, Heterodera glycines; identical to SEQ ID NO: 41210
  misc_feature (97)..(97): n is a, c, g, or t
  Genomic contig location: Contig_ID=SeqID_41210; Location=1..1124; Strand=+
  SCN-specific regions: Sequence locations=1-116,138-465,487-1124
  Gene Ontology: Mol. function=glycerol kinase activity; Cellular component=mitochondrial outer membrane; Biological process=glycerol metabolism

SEQ ID NO: 69388 - DNA, 419 bp, Heterodera glycines
  Genomic contig location: Contig_ID=SeqID_41211; Location=635..1053; Strand=-
  SCN-specific regions: Sequence locations=1-419
aggtacaacagtgattaaaagaggtacaacagtgattaaaagaggtacaacagtgattagaagaggtacaaaagtgattaaaagaggtacaaaagtgattaaaagaggtacaacagtgattaaaagaggtacaacagtgattagaagaggtacaaaagtgattaaaagaggtacaacagtgattaaaagaggtacaaaagtgattagaagaggtacaacagtgattaaaagaggaagaacagtgattagaagaggtacaacagtgattaaaagaggtacaactgtgattaaaagaggtacaatagtgattaaaagaggaagaacagtgattagaagaggtacaactgtgattaaaagaggtacaaaagtgataaaagatacaaaagtgattagaagaggtacaaaagtgattagaagag

SEQ ID NO: 69389 - DNA, 2708 bp, Heterodera glycines
  Genomic contig location: Contig_ID=SeqID_8842; Location=82..2789; Strand=-
  SCN-specific regions: Sequence locations=1-70,92-101,123-195,218 -523,553-553,583-800,844-908,930-974,1000-1284,1306-1326,1359 -1485,1507-2133,2155-2382,2404-2708
atgacccgacaattgaagacttttatcggaaggaaattgaggtttgtttgtcttcaagactttcaatgaaatttaattaccttcaagcaattactaattggttttaatagatatgatttgctcgccctgaggcaaattgccaattaactggtccttcgaaattgtataatttaattggcccattaatatttaactaaaatattttggcattttaagctcacctgatgagacgaattagttcataccttattaggtaatcaattgaattttcttttgcgcattaagacgtgttaattgtttggtttttgcccggaggcacattagcaatattagcattagtttgcccaaataatgaacttttgatccattaatagtgaaaacgaatgattttcgccattaagcagttctttcattaagtaacggtccttccttaaataatgccatcgaaccggggcgataatcaatcattgtgccaattttgcaggtcgatggacagccatgcgtgttggaaattttggacacagccggcacggagcagttcgcctcaatgcgcgacctgtacatcaaaaacgggcagggctttttggtggtctactccatcaccaaccagcagagctttcacgacattcggacaatgcgggaccaaatcatccgggtcaaggtgtttgttgagccaaagatttaggaactgatctggctgaatatgtaatagaaatgccatttcgccaccttttggtggcatttgcttcccccttttggggtcttttcacccattttcgcccattttatgtaaaaaagggattaaataaatactatgtttaaatttttttaatatttttaatagtttctattttttgcgtgtattttaaaaattcccactcctttttcaactaattaaaaaaaatcactcctttttttgcctcccccccccttttttttttcttgtggttacttatgaagtatggataagttggttaaatttatttatttatttggcccggttcaagcccaatcgtctgaaaactttaaaaaaagtcttaacggattgaacatatggccctggcgcctaggacttttcgtaaaacccaccgccttaggcatttctgtaaaattcgccaattcttttttcaacataaacttgccataactttgctaaacccgaataaatttagcattcttggtaccattttgacacttcttattttctttattagtctgcaaaattttaaaaggttcatcgtcttaactaaaagaaaaaaatagcacggaataattaattaaatttgtaagatatgtaaaatttatgcataaatatccaatagagagaaattttatttatttataaaaaataatttttagggtactgatcaagtgcctattttgctggttggcaacaaatgcgacttggcacatcaacggcaggtactgcttgctgttcagctgttatttgtaaattggccaccccagcttttaatgcatggaggcggggtgcatttttctttgaaaatctaagtgacacttccggcgtcaatcagtgaccttcctcagtttcttaggccataacttttttcatactagctcaatgcttatattcttgatgtcaaatgaaagcttaaactctcatgaatttataaatataaaaagcaagcaaatgctgccattaaaaaagaaactaaaatgagaaaagacaaaaatgcattatttcaattatatttcagggcttctttttgtcaattgcatttagctaagaatttagttttatttaaaaaaattcatactccgtgggctttaagcttttgtctgataccaagaatgtaggcattgaaaccaatcaagaaaaaagtgatggcctatgaaactgaggctgttcattgattggacgcctaaagtacaaaagagccaaatatttggcccaagcgccgttgggaattgcccttaatcaatttcggtctcaatcagtccctgtaaaaaaatatttctcgcccacacccctgagttctgtttttgcatttgccaaagaaatggtgggctccgagaggcccatggaaattcggtgcctagttagtagagctcggcatggacctggatccaggtccaggtcattttttgagaacctggatttttcctagacctggattttcctggatttttgtccaggaaatccaggtccaggtcaatttgaaaatccgggtccaggtccaggcatgaaaaaccttcctggataaatttttttcatctttttatggcgaaatatatttaaaatgggtataaaatctgcaaaaaattttccgccggcctctaaaaattattattctcttaaaaaaattggcacaaaatcgccaaaatttgtcattttttgaacaagatcattaacaaatcgcattaaaaattacaaaattttcccggcggcgcttatcggcaccgccgggcttaccgcccctttgttccgcaaaatttttttgaaaaaagcgagccgtaaaaactgttttgaaaagaaaaaaaaggtcgttgcatggcttgagttaacctaagctaaatttgaagattagcaatttttatgttattaatcaacattccacaaattttgaaaaaagctccatgccctgaagcgatttgataaaaatttaaattttttctcaagtatttcaatccaaattgataacaaacgtgtaaagttaggttttggcttttgttcaggtgtcaataaa

SEQ ID NO: 69390 - DNA, 623 bp, Heterodera glycines
  Genomic contig location: Contig_ID=SeqID_8842; Location=2817..3439; Strand=+
  SCN-specific regions: Sequence locations=1-79,107-116,140-181,264 -513,538-623
atgaatgaatttttggcaaaatcggattttcggcactttattggacacaaattgaacagtgagtgccgatttgccgactccgcccgagcccaacacgaccactttgaactcgcgcattcagctgctgctgctgatgctcactactaattatactgtgcaaaatgcaataaattatgtcgacaattttattaattaatttttaaatattgctaaattggataaaaattaaattattaaaattatttttagtaattcaaaaaattgccccaggctatttaggattatgctcaaaaagaaattgattatttttgggagggattgacgtggcagcgacggcggcagaaactttggccttcctccgctgctgaatgttacagctatatgtgactttatgcaattactcatccaatttttggtggtattggcgacattttcagtcttcgctggatttccaccagtactgaattggcaatgcttttaaattcgaaaattggttaattttttttataaaggtgttttctttattttatttgttataaatccggaaaaattcaaattggcaaggtttgaaaatgaaatatattttagtttagattttttcattttttgaatataccttatta

SEQ ID NO: 69391 - DNA, 96 bp, Heterodera glycines
  Genomic contig location: Contig_ID=SeqID_41216; Location=540..635; Strand=+
  SCN-specific regions: Sequence locations=1-96
atgcaatcgtttctccttctcgtaaatattttgctttgttcaattgtgttgctacatttattgtcaaatgaaaatggattggtcaatgccatgccg

SEQ ID NO: 69392 - DNA, 128 bp, Heterodera glycines
  Genomic contig location: Contig_ID=SeqID_41217; Location=846..973; Strand=+
  SCN-specific regions: Sequence locations=1-128
taaaaaaatgagaaaaaagagatagccattttttggtcaagaattttttttgtttgcgtttcaaatatcgtaagattgtttgatagggccagacaaaagaaggcaactgttggtaccaagtttgcggt

SEQ ID NO: 69393 - DNA, 77 bp, Heterodera glycines
  Genomic contig location: Contig_ID=SeqID_41218; Location=56..132; Strand=-
  SCN-specific regions: Sequence locations=1-77
caagagaatgggaagaggtggaaagagcgttggacgaattgattgagcaacgccgccagcggggcgtactgcccgag

SEQ ID NO: 69394 - DNA, 92 bp, Heterodera glycines
  Genomic contig location: Contig_ID=SeqID_41219; Location=150..241; Strand=-
  SCN-specific regions: Sequence locations=1-92
atgtccaacgacaacgacaaaagagatgcatcatcaattccaacgaatgcccttgttaacaaagaagagtctccggacggaaatgaagagaa

SEQ ID NO: 69395 - DNA, 466 bp, Heterodera glycines
  Genomic contig location: Contig_ID=SeqID_1175; Location=475..940; Strand=+
  SCN-specific regions: Sequence locations=1-283,305-466
atggccaatttaatgccgcaatgcatcacaacgacaatgcctacttttacaataccacatgcattgctgaatatgagggcaccgattcggctggtaaatgggcgaccaattaggggggggggataaagccatttggggggtggataaagccatttggggggggggataatgccatttgggggggggggataaagccatttggcggggggggggggataaagccatttctgttgaggagggcaattatttgcccgatttgatcattcttatgatgaagcatccctatttttaattaattttaaaacaatgcttttccttcctttagccgattattactccaaaattcaaaaaggctgcacggcggggagcaacattaacaacaattgcaacagtaatttcgctgttcatcaacaacagtcaacatttgatgcaaatctcagctatcaggccattcctaatcccgtaa

SEQ ID NO: 69396 - DNA, 877 bp, Heterodera glycines
  Genomic contig location: Contig_ID=SeqID_1175; Location=1049..1925; Strand=-
  SCN-specific regions: Sequence locations=1-138,179-685,708-877
atggcctcatcaaaatctcgggaccgggacatggaaggaccaagaatttacggttaggtacaatgctaaatccctgttgatagttgatatgatgattcaattttgagcattttgtttattttaattgatgaattgattgacaaaataagaattttttagttaaaaattttgttaattagcccattagccgtaatttagtgtacgcttccgttacaaatgccatttaaacattctctttgcttttttggtcatttattagtgactttttgcccaccgtttgcacataacatgcactcctcgtctcatacggactgcttgccgactgattgtgagtttggtgttgctgtgggtaatggtgatggaagtggtccatgtccatgcaaaattggtttggcgttgtggacgcaacgccataatgttgcagcgaaacggttgaggaggagggcacgccgttgttcagcgggggctccttgggaaatttttcgtgaaaatgtttaatttttttaagtgcctgaatattataaaaattaatgcaaaatgttcatggaactgtcccattaacggtcgggcgagagaaaaagaggaggccgagagtgagggataagaagagaggagaaaacaatcggaagccgacgagagagttgctgcccctctcgccacttcctgtcaccactcccccaccacgttaaaaccaaaaatttttcaaacagaaacttttttaaaaatccctagaaaattttagtgaaattttttttttaatttctctaacgattttttcaattttatgatgaattactaagtttttttcaataatttttctaaaaaattgctgaaaattttttctaaatttttcatattgaaattttgttataataaa

SEQ ID NO: 69397 - DNA, 569 bp, Heterodera glycines
  Genomic contig location: Contig_ID=SeqID_1176; Location=1..569; Strand=+
  SCN-specific regions: Sequence locations=1-122,146-569
agtaacggtctttgagcccttctcagcaacacatgtccctccacccgggtcaagccaaaccgccgtttcgtccgccgcgtagacatgtgtgtagctgaaaattagtcgtttgaaaaaaaatttctcatttacctacttatttttgtgtatgagttgttgaatatataatatgatgttgatgatgatgtttttgtatgcatcgggttctttttgcgctactgttgtcggtcgacgtaaggaaaatttatgatggtgcatgaatttttccagccatccattactagcctaagagaaaaatgttcaaaaatttttcgaaattttaccgcaaaattttcaatgtcttcgtaggcggcgctcattttgattgcttgcgcagcaatcatatttcgtgtcacccgcactttcttttgtcgcaattcagacacccactggaacacagcttcttcgaagttcctgtttggaactttccttccgcccccttccaaacgttttcgttttgacgattcggccctaaattaaacgaattaaaacattgtgacattacaggcatcttactctttcatcaaatt

SEQ ID NO: 69398 - DNA, 974 bp, Heterodera glycines
  Genomic contig location: Contig_ID=SeqID_1176; Location=840..1813; Strand=-
  SCN-specific regions: Sequence locations=1-349,389-530,576-579,671 -863,885-974
caagcaggttggacaacagtcgatttcctagttaaaacataatttttgttttcagttcgagcgcttcatgcggtacaagggtgacgaactgctgctgaagatcggagaacatcagacattgctcaattctattttcgacagacaatcggtttcctttgatcaacaattgttaggaatcattaattttagatttgatcagttgggaataaaatttggcgccctcgttactcatttttttttataatgttaggcaatttttgtcaaaaatatatgccctctaagaatcgaccaacccaaaaatttcaaaaattcactcctaagaaatgaaaaattttctcaaaaatgcatctaaaaaattaatttatttatttttcttattagaatttttggttttcacaattacgcacctcattactgatttggcttaatttttacttttttgaataaattttattagtttacaccccctaaatttgggctttttagagcctattttccatttttatattagagcctattaaatcgaaagcaaaaaataaattaaaaactttattaatcaataattcaaaataaatcatttaccgtatttcctcgattataagccccggggcttctattgttcaacccccctccaaagggggcttatattcgagggggggcttccaatcgagggggggggcttttattgttcaacccttcatttctacaaattaatgcaattttttcagaaccttcttttattcaactttacgaaaaactacgttgctttttaactttcaggtgccaaatacaaatcattttataattaattatggacgcaacaaaaaccttacctgaatcatcgactaaaaaaagtacctacctattaaaaattcttttcaaaattacctatcttaaggtttgctgctactgcagcaatccttgttctggtgcccaccaatgctggaagtgcaaaaaaccttgccatgcgatag

SEQ ID NO: 69399 - DNA, 1002 bp, Heterodera glycines
  Genomic contig location: Contig_ID=SeqID_1177; Location=72..1073; Strand=-
  SCN-specific regions: Sequence locations=1-1002
atggctttcatatgcgcttggatggggcacatgggaccagcctccgtcttcccttgtgcactatgccgaattccatacaaagctctgggcaacaccatcatcgggacaaggacagcaaaatcgatcgtcggtggcgccgcaattttcagttaccgaacagcagacacgggcaagcacactactcgggactcaatttcatgtggcagtcaaaaagccttgccactctttttcgtggcaccgacaaatgtgattccttcaccatttcacacacttcacagcgccggacgtaaatgcattgacttttttgaaaaaaatgggtccccagcagaaaaacgcaaattacaagaaataatggcaaaatcgggagcaattcgtcatgccaagacacaagaatacactggtcctgatatttcttttttccttttttttcaaaatgatttcaggtgaccaaatgaagcgcctaattctcgcctcaaccgaaatcagatcgatcggaacaccgttttcgatggacattgctgacctccttgacgaaattcgggagctccacatttttggacgtgctgacctcatgacccaagaacaaatcgacaatttctcaaataaatgctcctccattcatggctatttcaaggcaaagatactttttttctgtttttctcattttccccttttcaagaaactttgggaaactcatccggctaaattcgacacaaacaatgccgctggattcaccccaaaattacactggcttctcgcccatggtccagactttgccaagcgctggggatggttcgcatggatcagtgaacagggaatcgaacaccttcaccacgttttgaacaagcaggtggggcaatcaaatttctagagcttacaaatctttttctcttttagtctgatcggttcaagcggtacaagggcgatgaactgcttctgaagatcggagaacaccaaacattgctcaattccatttttgataggcatattggattcctttga

SEQ ID NO: 69400 - DNA, 708 bp, Heterodera glycines
  Genomic contig location: Contig_ID=SeqID_1177; Location=1733..2440; Strand=-
  SCN-specific regions: Sequence locations=1-708
atggtatccacacgcagtaaaactgataagttcaagaaaatgggaaattcaagtactgaagcaaagcgaaagcggtcggaatggcgcaggaaaagtggaagaaaaggcggttcaacaccaaaaagtagtgacattttgaccaaaatattcatttaattaaaaaatccaatttttgcaggccaactgcaaactaaagaagctccattaacaacaggagagggaacatcaacagatacaatgccatcgacattcaatgctgagcctcgtaagtccaaaaaacaaaatttttgagataaattccattttttgaggccaacggccaagtccacggccactgtcaacaacgcctataaggcgccatgtccgcacgcgtccaacaactaccgaccaaacaacggacaccgattttcgagcaacagtcaagtcaacccaaacggttttagaaaccgtcgaaactgccacccagacagaaacaggacgaaacgccgaattgcgacactggaacgccagctacagaagagaacagaagagatgaaccagctaaaaaagcgaccgacggagcaacaacgaaaaaggccaagagagtcagttcattggaggacttgtcaagacagagccggacaacacgcgcaaaggaaatagctcgggacctcagtcatcttttccgaccaggtgaacaattccttctttcttatttttgacaataaa

SEQ ID NO: 69401 - DNA, 408 bp, Heterodera glycines
  Genomic contig location: Contig_ID=SeqID_1178; Location=712..1119; Strand=-
  SCN-specific regions: Sequence locations=1-78,201-408
  Gene Ontology: Mol. function=protein binding; Cellular component =cytoplasm; Biological process=pole plasm RNA localization
gtgccgccaccgatgcaaatgacgcgtcaacaaagtgtgacattgtgtgggtgtaaagatgatccagtacagactgttccgccgccaccgctgccagcggttttgccaccgccaccgcctccaaattttcctccaccgccgccaccgaatttcccaccaccgccacctccgaatttcccaccgcctccgccacccgccgcgagtgaagcatgccccccaccgccatcggcggtgagcggagtgcaacccgtgccgccatcggcggttagtgaagcgaaccccgcgcgaccatccgcggtgagcggagtgaatagcgcgccacccccgcagcaggtgaacgtggtcaactcaacgaccagcaatgtaccatttgctgtaaataataaagacacagcggatcaaaacgaa

SEQ ID NO: 69402 - DNA, 722 bp, Heterodera glycines
  Genomic contig location: Contig_ID=SeqID_1179; Location=103..824; Strand=-
  SCN-specific regions: Sequence locations=1-98,222-310,332-472,494 -567,590-722
atgaatttaatttataatgtcgccctgcttttcattcttggactgtgccttgttctctacccaatgccatcagctgatggaatgcgttagttttaagcaaaattttaaaaattaaatttaaaatgataaaacatttaaattatctctaaaaagtgaatttatttcacaaaaaaaaattaaatgaattttaatttcttttttaatgtaaattttctttttaagcattaaatgagcaaaacaattctccaactgctggtggaaggagccaaagaaaggagcaaatcacaaaagttcggcgccgacgaccaccaaacagtgaacaaaaaggtggcccaaacaaataatatttaagaagtatcgagtgccatttcttaatttatttgaacatattttgcttataagaattcatatataggtatgcaaagtttacgtttttctgaattcgtagtccaaccttttcctaccaatatgcaaaattttagataaatttgtcgtgtcaaaaaaacctttggaaatattgactactaacggcacgctgcttttggcacctcaaattattttccagaattatttttagaaaatggcacttctgctggtggcactgctgggcccaccttagcccgaactttgaccacgcttggagcgggtgccttagcaattggagcattgccaagggcaaattcagctcgatcgcttccaagtccgcaaatgatggtaataaa

SEQ ID NO: 69403 - DNA, 983 bp, Heterodera glycines
  Genomic contig location: Contig_ID=SeqID_1181; Location=75..1057; Strand=+
  SCN-specific regions: Sequence locations=1-37,59-217,274-383,408 -609,633-983
ttttttggagtatttttaatcccgaaattccgtgcggaaaatttgtattttaaagctttttctacaaaaaaacaaattctcagcaccctagtggtgagtaacaaagatttctgcctattttggtcttaatttttgtttgttttttttgtactttttatattcattttaatctttaaagattttatgccatttgaatatcatgcatatttattacagcttaatttaaaactaatttttgttaaaaaacatttaattttaatttatttattttttgtaatagacattgttgatgatgagcagcttgctttggactacacgaaaatgttttcaaaaaatccaacaaatgccaaaacagcggagatagtcatttcattgcgtctaacttttgcaaaaataattaaaaatttcttggccgtttattcctattataatttgcagcttccaaaaaagtccaaagtgtcaaagaaagctgcaaaatttgttgccaaagtggcggaaatttgggaattggaattttgggccattgttttaattcgaattgccaccaaagacagcggagctttggtcatgctttatgacgctctttatgtgctgtcagtgatgctaacattgggcaaaaatggggaatacattaccaaaatgccaacggaactttcgccgcgttcggctgaacggcttttggcggactgtgaaagtacaattcgggcccaattttatgaggaacatacagcaaatatgctaagattttacgagaatggcatgttggcccacgacggtggcaattcgttcagcaactttttggccaagtgccaattggacgggtgcgaccacaaattccgagtgcgcattttttatgctaacggcgagaaaatggcaaatgatcattatgacaaaatggttaccaaatacccaaaactgaagcaaatgctacgcattggttcgtatttttaagattttttctttttttttcttcaactgttcta

SEQ ID NO: 69404 - DNA, 377 bp, Heterodera glycines
  Genomic contig location: Contig_ID=SeqID_1182; Location=80..456; Strand=+
  SCN-specific regions: Sequence locations=1-174,196-257,296-377
atggaagcaattccaatgaaggagattgaccaaaacgaacaccgtttactctccgatttatttgaaaagaaaaatgaacttttcggcgaaaaaattgcgccaaaatattcaaaaaatccatgtgacagggaaaagcatttgaagtttttgtttaatttgcacgaaatcgcaatgaacaaactaatggaggtaaaagatgcatttacgaaacgattggaaggtaaaaaaaagtttatattaaatttagtcaatgaccgaattttttttaaataaataaaataataaaaataattttggagcctatgaaagtaggcatcattttttataagaaggctatttttctgtggctttattatgctaaatttgtagataattaa

SEQ ID NO: 69405 - DNA, 310 bp, Heterodera glycines
  Genomic contig location: Contig_ID=SeqID_1182; Location=674..983; Strand=-
  SCN-specific regions: Sequence locations=1-26,48-55,101-275,302-310
atgctttttgggcttctgttaaatataccattttcagctgttaattgcgttgtaaatggtgatgataataaggacgatggtggtgaatttgatgatgatgtgttttgctcagaaatgttggcatttaaatgtaaatttcgtccaaaatgtttcgaatttttattttttggcaacgcatcaaaaataaaattataattcagcaacaaatgttgaaatacttttgaatcatcacaaattatttgttcaagtcggcttttatcaatttgaatgtctgagttttgttgtgtttatttttatcattcaagcataa

SEQ ID NO: 69406 - DNA, 1893 bp, Heterodera glycines
  Genomic contig location: Contig_ID=SeqID_1182; Location=2403..4295; Strand=+
  SCN-specific regions: Sequence locations=1-3,26-110,132-206,237 -570,592-812,843-911,937-1746,1819-1893
atggaatttgaagatttggatgaaaatgactgcaaagatgcgcgttacctgcagtcatattttgatgtcctattgtccagtgctaattacacattgacagttaatgttttttcagtcatgcaactcttggaccattctccacaatttgtgcaatttgtcaacgacaattgcatccaatttggagcgattggcgccaatgaaaactgtataaattatattttaaaatatatttaattcttagttttctaaatcgtgaccggaaaatgcgtcagtagaaaatgcgtcagtggaattaaaataaagttcggtaaatatggttcatagggcccagactcaaaattaaacaaatgatatatcaatcgatagctctcggtctgtaatggaagaatccgaaagaatttttggcaggaaccaatcaataccatccctggcgagttacagacccgggactgaagtggcaaaatggctttgggactgaaccgtccactgacctaaaacgcatggaacaaacaaattagataccaatcgattcccctcggcatgtaaagcatgaatccgagaatttttggacaaaagagaaattgacaaaagttatgggtgctcaaaagccccaaatgagcttaatataaaaaataatttagttgaattaaaaaacagcttctggatacagattcgtgatcagtgacctataaaacccaatgaatttgtttttatgacattaaaattttcactgacgcattttccgggtgctttctcaattgcttgatttaggccgggtattcagaggaaaatgccggggcgttggcgccgcagttggataattttgtttttgggggatcaccggcataaaataaattaagcaactgagcacagatttcactttctttacaaaagaaaattccctccgcccacaataaaatgccaaaataatttaaattgtatttttttcacagcttcgttgcacgaagaagaaatattcaatttgtacatcacttattttgaaacgaatgacattgagaaaatgcacaaatacgaagcgattattggcctaaaatttatgttaaacaatgtccgactaattgaagcggaattgataccgaaactaaaaaaagagggggatgaaaaagcgcaaatggccaaattccgtgccgaaatgttggcaatgctcaaaatgtttgacttttgcatggaaagtgtggaccaattgattcgcatgagttgcccgctgattgaatacaaggcactgttttccaaattttatctcaaaagtgccgcggcaccgttggccgaatggcaaccgccgtttgactgtttgacaaaatcattcggccaaattttaagcgattttcgcaacagtgtggcgagccaacattttcaattcatgcaaatggcattgaacaaagacagaaaaggaaaattggcacagattttgagggaaaaggaggacacatttatgagattggagaatttgattggcgaagaaatgttcaaatacctttggaacaaaagcgaaaacagacaaaaactgttcaaccaaaaatgtatgttcaagactcgttaattttaggctaggatttcgggttcgggtcgaaaaaagcaaactcagtttttttatcgtgtcaacaaataattccgatagaaaaaattgctatattggttgcactgaaatgacgacaactttttgaagattgtggataaatattttcaaaattttaagtttaggtattctttaatctattttgatacaaattttattaaatattttaacttttttgcaaaatattaacttttatttaaaagaaattttgaattttaaaaccgagatggtcggggtaccctggccgggaattccctgttttttaggttctggtagggccgtgatgaactgggaaa

SEQ ID NO: 69407 - DNA, 348 bp, Heterodera glycines
  Genomic contig location: Contig_ID=SeqID_8844; Location=85..432; Strand=+
  SCN-specific regions: Sequence locations=1-245,282-348
atgctttcttctgcgaactgtgcacagataatcaggttaatggtgctggcttgaggaattagtacaataatttataagttccacagaaattactccgcaccacttttcagcgcatctatccgttcagcgaaaacgtggccatttgaaagagttgttgtgcagtctatcaccgctcgtgctttgaccgtgccaacaaacggtgtccgcgatgttttacgaagaaaggcgagaagaaaagcggtgatggaagagaatgagggggacgaggaggaagaagaggacggacaacaacaaccgtaggacagcaaacttttttatttttgtataaatcgggtcacaatagtcaaa

SEQ ID NO: 69408 - DNA, 1296 bp, Heterodera glycines
  Genomic contig location: Contig_ID=SeqID_8844; Location=477..1772; Strand=-
  SCN-specific regions: Sequence locations=1-106,137-415,437-897,919 -1132,1155-1296
ccctgacaactaaagcgccttttccctgtcctcggcaaacaccttcgcaagggcgactgtggcaaaagcggagtgatcggcggttcgcccgactacaccggtggcatattgcagagaaatgaatgcatttttatggcttttccccgttaggtgcgccttatttcgcttcgatcaccccaatgaaaatcggtgccgattaggcctttgtttacgcccattccgacgctgctccggtgatcaaaagttacagtccggaactgatcgtgggttttcatgttgactagttaactaattggggttggggttgctaattgccctcctccttaataggtttaccccagcaccgatttcgccacgaatagacacagcattgagcggttggacgtgctggtgttcgggccggggcttggccgacagaaacacacacaaaatttgctggcggacggcgtaaatttcgtcaggagcaaacaaaatgtaattcccctccaatctaaatccatctaattattgagatacaatcatcattttctttgcttttcaagctttgtttggtcattgacgcggacggtctgttcttcgtcaaagaatgttcgcagctgttcaaagggtgcacagacaaagtgatcattacgccaaaccacagaggcaaaacgcaccccaaaagcaaagcaaacaaaatgcatgtttcttaagattttgttcgggtttatacccaaatgttccctaaccagcagaagggagaggacacggacgaattgaaaattcaatgtgaaatggcggaacaattggcaaagatttggaagtgcctgtgatgagaaagggtcggtggcacagaaacgcaaccgaaaaatatatgaggtttggattcaataacaattgtcattggcactttaggagagagattgacatagtctccaacggttacgccgcccaaacgcgaattgtccaagcggaaacttcgatgcgccgttgcggtggccatggcgacattctcagcggcgcgacggcccttttcgtattttaggcaaggaaagcctcagatgccgacatttattcctccgagcatttgctggacggggcggaggccgcttcgcttttggtgcgcaacgcatcgctacggacctttaggtcgaatttattttttacaaaacaatttccaaaaaatattttagtctgtcggccgatcgatgaacgctgcccacgtcattgaccacattgtgcccgttgtccgcgacattgactcgggtctttcagcaaaagttgcgacaattacaacacgttgatttgtgtacgaaa

SEQ ID NO: 69409 - DNA, 1142 bp, Heterodera glycines
  Genomic contig location: Contig_ID=SeqID_8845; Location=1133..2274; Strand=+
  SCN-specific regions: Sequence locations=1-42,81-157,179-468,508 -889,912-1012,1035-1142
atgacatcaattaaacgcaggactttcaatgtcattcgaaagtaaaataattaatttaaatttattattttaaaaattttcagattggaaattcaatcggccaaacattcgcttcggtctttggacataaacaacaacaaccaattggaatttgtccatgctcaaattttccagggctttgtgcaactccgatccgttgatctttcgcacaacgatttgatcgttcgtaattaattaaattgattctaatcaaaagaatttaatgattttaattagaacctctgtgccggctctttttggggcagtgtccgtttggagcgaattgtgctgtcggaaaacaatttgcgcacaatttggtggcactgtcagaagcaaatccatctaattaattgatccttttttccgattagactctgatcgttgagcttaatcttgccgggaatgttcttcactcgttggattctgttgaaaattttaaagttttattttgtattttaaaataattaagggagtttttggccaaaacaatttgcagggcttggacctcagtcttaaacaatttcacgttcattccagtccgagcattgtcatcggtccgagcaagccttacggtgctcaaaatgtgaaaaaatggagtgaaagtgctgaatcggagggcttttgaaggaatgcgcaatttaaattcgttggaattgggagaaaatcgcatcgaaacgctggaagaggcattttcaaaggaaaacagtgaattaaaagcgtaactggttaagcaaatgttctcattttttgccaaaattgaagccttttgactttttgaatttgtcgggcaattttttgtatgaattgcatcctacagacattgaccgtttgcctgcacttcaaattaatggctaatttgggtgattttcagttggagtctctttctctttcccaaatgtcgtcactttcgcgactccccgacacttccgaaattcgcacatctgctcagactacaggggcttgagataataccatttttgtattaatttatttacattaattttctttacagatcattccaagccgttaaaaattggccacagcgaaccttcaattattgcgcgaattgagcataactggtgcaaaaaaaatgtcgaaattaa

SEQ ID NO: 69410 - DNA, 141 bp, Heterodera glycines; identical to SEQ ID NO: 66691
  Genomic contig location: Contig_ID=SeqID_41225; Location=415..555; Strand=+
  SCN-specific regions: Sequence locations=1-141

SEQ ID NO: 69411 - DNA, 804 bp, Heterodera glycines
  misc_feature (20)..(20): n is a, c, g, or t
  misc_feature (41)..(41): n is a, c, g, or t
  misc_feature (66)..(66): n is a, c, g, or t
  Genomic contig location: Contig_ID=SeqID_41227; Location=141..944; Strand=-
  SCN-specific regions: Sequence locations=1-314,358-366,399-615,643 -679,709-722,786-804
tgacgacttttctgtgctgncgcagttggtccatccggtgnccgaaaggaaagtgggttaccatcnccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcac

SEQ ID NO: 69412 - DNA, 920 bp, Heterodera glycines
  misc_feature (879)..(879): n is a, c, g, or t
  misc_feature (904)..(904): n is a, c, g, or t
  Genomic contig location: Contig_ID=SeqID_41227; Location=1..920; Strand=+
  SCN-specific regions: Sequence locations=1-159,223-236,266-302,330 -546,579-587,631-920
cttatgggcttatcgacaacactaccgggacgagccatctcccggcagcgggctcgaattggcgccacccgtgtggcacttagggactttcgcgacctgccgactgcacaggctccctggaagtttcgaaccaaccacacgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtggngatggtaacccactttcctttcggncaccggatggaccaac

SEQ ID NO: 69413 - DNA, 538 bp, Heterodera glycines
  Genomic contig location: Contig_ID=SeqID_41228; Location=6..543; Strand=-
  SCN-specific regions: Sequence locations=1-201,223-475,501-538
atggcactgtccctcactgaggcggtcacccgtcgcttttttgaaggagaggaacgacgaattgaggcaatgtcaaaaattcggtgaatatgcacgaattttgtacgactatttgttcgtaatgtatctccaaggtcatagtttattcttcatccataattttttttaataaaactaaccattttattcgatttctaagcgttttaaataaatttgaaataactaactaatcatggtgaactgagagcagagactgtatgagtcctgaggcgagtgcgccccaaaatgtcgcctgaaggtttttggaccataattatgttcttctcaatcaaattaagcattgttggttttgttcaatattctctatgcgtttgttattattcttttacaaaaaaatttcgttaaattcaaaaaaagatgaccggaagtaactcaaatttttcgagtttttgttttccctggttttttttgtacatggaatataaattttaaaaatttcaggttaatagagtttttaagtgcttccgagcaatgctaa

SEQ ID NO: 69414 - DNA, 517 bp, Heterodera glycines
  Genomic contig location: Contig_ID=SeqID_41229; Location=79..595; Strand=-
  SCN-specific regions: Sequence locations=1-263,285-341,363-517
atgcacggcttcaaggcttcaagaaagtcatgtactggtcatccacccctcccgtttaccaattgccaaccccagaaaaaagggaggggtggatgggtcaccggcgctgagctcagcactgacgaagacgaagatgacaaccatcatcgtcaaagaaaaagcggaggaacaacaacttcaagaagttcaacaacaaaaagaccaaaacgacgacggcgagcagtacaacaacaatgacgagtgttaaaaatgacgacgacgacagacagtgggctgcttggatggctagtcattaaaaattggcatttttcttaattattttccattaaattttgacgaaaacatttatttttctcattttaattgattttgacgtttaaatattgacaataatataagagaaaatgtgaatcaaaaaaatttggttaatttttaataattacactacttttttaaaccataaaataagtataaaaaaccaagtttccagcaaaaagatatttttttaaataataaa

SEQ ID NO: 69415 - DNA, 1549 bp, Heterodera glycines
  Genomic contig location: Contig_ID=SeqID_8846; Location=261..1809; Strand=+
  SCN-specific regions: Sequence locations=1-326,348-634,656-1549
atgcaacgtattgcaggagcgcccgaggcaaatgtggccctgaaagctttggagagactggaggaacgacttaaggcagctcaaatggaagaggaggccaagctgcaggccattttcaaaaccggagcgcccaagtcggagacaagccagaccctgaaaatggcacgagaagaagtggccaaactgcggaccgaagcgaccagggaagagttgctgaccttcttggccaccctgatggctcccgaagagtttgaagcggccaagactctgcagaaaatggcctccaaaagcacagccagcacagtggccaaggctccaacagagttggaagcagagtcaaaggcagaattggctcggccggaagaggcgctcggagtcagcgttgagaagccggaaagaagggaagcgaaggaagagcgccggatgagattggagcggcaagaaatggccttccagctggttcagcagctgttgagtgcaggacgaagtgaagcatcgctttcggaaaagcaacgggcaatggtttccgagcagttcaagcagttcggcctggaggagatgagcaccagcattgtgctggagcagctcgaagaagtggcgggcagacccgaggcaaaagtggcgctcaaagcgtggaagagcctggaagaaggactgagagtgctggctgttatggaagaacgggtcgggtttgaagcaacctggacgaccggagagacggagtcgggtgctgagaagacagtgcagttggcacgtgttgaagctgctcagaagcgagttgaagaagcgcaggagcagctaaggaccttcctgacagtgttggtcgggccggaacagttcgaagaagccaaactgctccagaaaattccatggcacacgtcagccgaataccgaggcccggaatcgcgcgaagaatggacgaaaattggccaacaattggccaaaatggaagcgattggccttgttggtgtggtgaagccactgccggtggtgggcaaggcggaagcgagccgaagaattgaaggacgagaacaggcgtttgacctggtcagaaaggtgctaagtgaagagaagggccagcagacactgtccgaagcacagaagttgtccgttttcgagcagttcagagaattgggcatggaagagacggctgccaccgttgcacttcaacaaatacagcaaattggcggaatgcctgaggcaaaagttgctctgagagattggacaaagctggaagagcatctgaaggccaaagaagcgtttgaggaagaagcgaagcttcaagcagcactgaaaacaggagctccagacgccgaaacgagtcgaacactgcagattgcgcaggaacaagcggctcagctgcgagtgtgccaattgaaagaggagctgctcacattcttggccaccctgatggcacccgaggaatgggaagcagcaatgactttgcaaaaatttgatgtggcgccaaaagccgaagagacgttgcggctgaagattgaggaacagcaacaaatcactgaacttgtggcagccgcacttaagcgtgaag

SEQ ID NO: 69416 - DNA, 886 bp, Heterodera glycines
  Genomic contig location: Contig_ID=SeqID_41236; Location=283..1168; Strand=-
  SCN-specific regions: Sequence locations=1-85,107-206,261-353,375 -533,600-715,737-738,771-886
  Gene Ontology: Mol. function=cysteine-type peptidase activity; Cellular component=intracellular; Biological process=proteolysis and peptidolysis
atggaaaatgtccttgacgttgttggcgaagaaattttggaacgcatccaaaataatgagtttgaaagagatgtaccgtgaattgcaaaaaatgataatttgaaatttaatattttattccttcattaggttgaggggttcatcccggtgtcgggtgagacaccgtcccaatcatttgagctgcttagagactattggctccaggcaataaaaattgataaaatttaaaataagtaataaataattattttgttaatattgtagagagatggtctctttgaagacccggagtttccggtggagtccattcaattgtacttcactggagagccagtggcggtccgatggcgccggcctggtgaacttgctgaacatccgcagttcatcaaccaagggcccatcgctggggatgttcggcagggcagcatcgggaattggtgggcgctggccgcggcatcggtgttggcacaatatgggcccctgttctacagggtggtgccccctgaccagggattcgggcacaattacgccggtaaatttaaaattaatgataattaaatttaaaaattatgtcagaaattttttaaaattttttttttgcaacgattttttttattgacatacaatttcgtagggatcaactgcgtctgggttaatttcatctgaaaatgagccaatttcgtctcgccaactccgtcttcgtatataatgggccaactccgtctcagacaaaaatccaaatttaatttttaaatttaatttttttttttgctataaaacgccatttttggcaatatcattttaaaattaagtgataattttatccgactaccaccaaaaatggtcaattttcccttagaacactgtagtttttgggattaataaa

SEQ ID NO: 69417 - DNA, 481 bp, Heterodera glycines
  Genomic contig location: Contig_ID=SeqID_8847; Location=315..795; Strand=-
  SCN-specific regions: Sequence locations=1-137,159-258,288-306,330-481
  Gene Ontology: Mol. function=aminopeptidase activity; Cellular component=cytosol; Biological process=proteolysis and peptidolysis
gtcgacgtacaaagacagtgcgggcaacgaaaagattttggcgtccactcaatttgaggttgttgtcaaagcgttaaaaatgccaataataaaaaaaattgtacacataatttgcgtaatggagaaatattgttgcttaaaaaattggcccaaattttggcagcattaatttttcatccggaaagtgattggcaacactttttcatatagtttttgcatttttgagctaatttgaatagaaattttttgcatttcgcatcatggggaggaattttgggaaatttaagcaaaatcaaaaaaaaaatttttgttttccaattggtcaaacaatggacaccattttcagagcacttacgcccggtctgccttcccctgctgggacgagcccacgtacaaggctcaattcgacatcaaattggaggtggacaagcacatgaccgccctgtccaacatgaacgttgtggcggaggaggaggcggcg

SEQ ID NO: 69418 - DNA, 846 bp, Heterodera glycines
  Genomic contig location: Contig_ID=SeqID_8848; Location=309..1154; Strand=-
  SCN-specific regions: Sequence locations=1-339,381-435,460-551,574 -669,698-766,788-846
atggcaaacggttcggacaaattcagcaaattgccgcagttggccagcccgtcgctgtaccaaattatgctcagtgtcgacatggagacgtgcaaattcaagggcaacgagatcatccatcttgaggttagttggcactaaaattttggggcaatccttcggaattagtgtcccccggcggtaaaaaaaattgagacccgaattttgaaaaaagcctggacctggatttcctggacacgaattcgggtccagaaaaacccaagtttaccgataatggccttgacctgctcgtatttacataaacattgattccatctatgattttgcatcaagcaaatgattttttcaaaaaaaaaaaaattaattttgtaaaatttattggcgttaaaacgtacgttctgaatagtgtagaaatgattagcacattttcttaccttaaaaaattaaagaaaatttttatctctttttttgggcaccaattccgaaggatttacctaccccaccaattttggggcaaatttcactttcctcccccctcaccaacctaatttttccctctctccattttcagattacaaagccaacaaatttcctgacactccacgcgggtgcattggaggtggaaaaggcgtcgctgaagttggaggatgggacgggtgagtggtggcgaaaaaaaaaattttattttcaaatttttcggcgggggggggggacgacccgggggaaacgacgggagaaaatcccgagtggtggcggtgcttttttacgccattttctttttcttgcacaaaattttgcctacaacaaaaaaaaattgcaggccctgaaaaattcataaatttatga

SEQ ID NO: 69419 - DNA, 1122 bp, Heterodera glycines
  Genomic contig location: Contig_ID=SeqID_8848; Location=1248..2369; Strand=+
  SCN-specific regions: Sequence locations=1-159,182-336,367-396,419 -535,559-648,672-781,809-1094,1116-1122
atgttcagttttttgcacaggtaattaattttaaatgttggtaaattcggcacttttacgcttggggccaccgaaaaattctttgatcatacgtatgtaaataggaagaattcgatttcctttactctattgagttacagtaccaatcaatgcatcagcaatatttgcaaaaattgaaaatttgaattttttcaaatgttcgaatccgggttcggggttcgaaattaagtcaaaagaaggtcaaattcgtgctcagcgcatcaaataacccctaaaaaagtgttttttgaatttttattccttttttttgtgggaccaataatcttcatgattgccgaaaagagtgagaaagagaaaaaagtcagcgaaaatgtcgatcgtaactatgaaaaaagaaattttataaagaaaaattgccttattttttaacaaacttcattaaaaattccaaattttctacgatcgactaaactctatttgtgaaaaacttatcgatcgtaagaggaaagtgtgtaaaaaaccccaaattttgccggcttttaaaaaattccaaatttttacgatcgactaaaatcaacattttccctttcgtctataattgtctttaaaatttggcttaaaagcataaaattggtcatttttaggtgcaaaaaaaaaatttttttttttttggaaaaagtagcgtaaaaaaagtggtatgaaagttttcctaggcgttcaaaatttttaaataagactggcagaaaatttttattgatctactaatattttggttggacaaattatgattttgctttgtttgtttgttaacattagagctcggggaatttgtgccgaaggtaccccctccactttttgaaaaaaaaattttctcgagaagtcattttagggatttcagggtcgaagaacacggacaaaaatccaaggctgccaaaaatggcctagatttattaaaacggagcgggaatttttttttaattgatacagtactacttttgtccatttacagtaatcgagttattacaagaaggtggctggccaaaataatgatgacaaaactgtgcacacctctccgtggaattacaattccaacaaaatattaaatacattgaaaatgaatta

SEQ ID NO: 69420 - DNA, 854 bp, Heterodera glycines
  Genomic contig location: Contig_ID=SeqID_8849; Location=146..999; Strand=-
  SCN-specific regions: Sequence locations=1-145,167-504,526-526,548 -764,786-854
atgaaaatggtaaaatcagcacaaaaaaatcgaaaaaagcataaaaattttatgatttttaggcaaaaatttttatcagttaacaataaattctcattttttttcttttcacactgaatttaatattttcttagcaaaaatttgtacattttaaagcaatttttcaagaaaaaaaattttttgaggattggatttttgagaaaattttccatttttaggggtgtatttaaaaaaaaaaatttaggtcgattcttaggggtggatttttcgtttttattgctaggaggcggtgttttagtgaaaattttacaaaaaaatgccaattaagcacaaaaataagaatgaaaatgctaaattcagcaccaaaattacctgctcagcattaagcacgaaaataccaatttaagcaaaaatcagcatgaaaaagatggacttagaagcctcaaactaagttagaaatgcgtttttcatgcttattagcacgccccaagttagcaaaaaatttcagcaaatgctgcaaaatccgttctctacatactaatatttcatcaaaatgatttcattttttgttatttattgtctttgtttgtgctcattttgtttgatactttcattctcctcaaaaagggcgtgaaattggacaccaaaaagtgccaaaaattgtgacactgaaaagcgcaaaaactgacatcatttaacaaacgaaaaaatgaaatgacgtcggaaaaatgtcatattaattgtacacactcaagactctcgagtttctccaaattttaaattaatcagattgcaaacgatggcgactttttgccggtctgctcaacgatgccaacttttttatagtaaataaa

SEQ ID NO: 69421 - DNA, 407 bp, Heterodera glycines
  Genomic contig location: Contig_ID=SeqID_41248; Location=417..823; Strand=-
  SCN-specific regions: Sequence locations=1-51,95-139,161-162,200 -207,241-407
atgagcgaattggtcaaggaattggagcgcgaagaacaatgtaaaaatcgcttatttattttaatttcaatttgatcattttaatttaaataaacaaatcaataagaagccgatttatttttaggtcggaaatgtctgtctttaaagaaaaatatcattggcaattaaaattgaataaaatatttttaaattaaaattagcaaatagcaaatagtaataaaattttgaacatatttaaaatttcaattcagtggccgacgaattggtccaaaattcaaatcgacaaatgcaaaattatgcgccttcccgggaagcttctgttggccaacctcttccagcacaaaatgatggcacacgaagaagctgacccttattttgctccattttcacaaaaaaataagaataaa

SEQ ID NO: 69422 - DNA, 78 bp, Heterodera glycines
  misc_feature (35)..(35): n is a, c, g, or t
  Genomic contig location: Contig_ID=SeqID_41249; Location=941..1018; Strand=+
  SCN-specific regions: Sequence locations=1-78
aaatgctctgaacgcaccaaattttatttacatgntagtttaggcactctgatgcttttctatcgaaaagggagatga

SEQ ID NO: 69423 - DNA, 388 bp, Heterodera glycines; identical to SEQ ID NO: 51536
  Genomic contig location: Contig_ID=SeqID_41250; Location=232..619; Strand=-
  SCN-specific regions: Sequence locations=1-20,42-275,297-388

SEQ ID NO: 69424 - DNA, 325 bp, Heterodera glycines
  Genomic contig location: Contig_ID=SeqID_41251; Location=111..435; Strand=-
  SCN-specific regions: Sequence locations=1-79,113-325
atttataagcatttgaagggttctcagcagtttccctgcaaaatttggtgagcttctgatcagtctagaacgttgggtgataaaataaaaaaaataatttaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaatgaaaaaaataattatcgaaaaaataatacttgtgtggtaagtgtgaataactgtgttccctccgggcgaaaaa

SEQ ID NO: 69425 - DNA, 267 bp, Heterodera glycines
  Genomic contig location: Contig_ID=SeqID_41251; Location=503..769; Strand=-
  SCN-specific regions: Sequence locations=1-79,113-267
atttataagcatttgtagggttctcagcagtttccctgcaaaatttggtgagcttctgatcagtctagaacgttgggtgataaaatgaaaaaaataattttaaaaaaataatgctggtttggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattt

SEQ ID NO: 69426 - DNA, 640 bp, Heterodera glycines
  Genomic contig location: Contig_ID=SeqID_8850; Location=21..660; Strand=+
  SCN-specific regions: Sequence locations=1-402,439-521,543-579,615-640
atgtgccaggatctgatcgaccggctcgatctgatgtatcgggcccggttcaagaagaaaatattgaacaaaactgatgtgaaaaagttcgcgcaaaacattgtgggagggcctcaatttcgtgatcagttgaatgatgagtgggagaagggcgaacagcagcaacaacggcgccgacaaaatgccaatggagaggacgaggacattaagccggtagaattggaaattgtataaattcaaacactctatgaattactgtaaaaatccaataaatttggaaaaaaatccatttcaatgttccaaaattgtttgtgccttagaattccggctttcgcgtttatataatttttgagattctgaaattacggtgctgtgcagaagttacaaaagtatcaatgttagtaatattaaaatttatttattattttatttttatttgcgaaataataaatcataatttagctcgaacttagtcaaattaatgatatggggatattgaagcgatagctcgacgtatccactattattttatgtaattttaatgtcgaaaaatttagactcaataattttgtccataacttttttgaaactcaagaaaattttttgaaattttatagaataatagagcaatcttagtaaa

SEQ ID NO: 69427 - DNA, 2365 bp, Heterodera glycines
  Genomic contig location: Contig_ID=SeqID_8851; Location=295..2659; Strand=+
  SCN-specific regions: Sequence locations=1-388,415-758,780-873,895 -1135,1164-1307,1383-1510,1533-1569,1592-1649,1742-1929,1951 -1979,2097-2137,2159-2337,2359-2365
atgcgaaggaaggtgaccgttgcactgtacgaagaccacgtcaaggtgttcaagttgttgttctgggcacgcttttatgcgcttgccatcgctttgcaacgaattccagtggaagtgaaagaagtcagtggacggggggggggcaagcagtagttgctgaggatatgtacagcaacagggaccggattaaatgcccaaaaaatcttagaaattcggatttgtggggatttgcgcaaaacccggaaaaactaaaatttggatccttgtaaattggaatttcgaatttgatgacaaaattttttgaccggttttggcatcaaaataagtcggggtttctgtcccccccccaaatttggtgtttaactcttttgtcaggcaaaacccggccaaagaaaagaattatttttgcaaattccatttcatattctgttctttaatttaaactttcatggctttatcgagaaaacgtgcccttctgacatgcttaaaaatagcggcttatctattaaggatgccgtgccgcaaaagatcacaaaagatgagggcgctaaactgttcggctacaatgactatgccgatgtacaaaaggaagaagaaaatgccaacgccacaaccaaagaattggctgctacttttcgtatcgatgtgccgcgcaatgcgtggcctgatgaaacgcgccgacgtacggaggaattgcgcaaaaagtttgaacaggacatggacattttggaggagtacctcctggccaatttcaaccatcaaatgctctacaatggacaatcacgcttttaccaggtaaaacaaaaaacacagaattactttatagcaatttagctttcattaaaatccaaaaaagaccccaacggattgtaccaaattttcgaaaaaattttgccgatgaattggcgccgctggcctccagtaaggtcaccagacaggtgtccatggagtttcggtatgaaatttatgtgcggatatagcagatagcaccactgggttcttaagaaaagggtttccttttttgcaggatgagcctgagtgtcaagaccaaaaatgccataattgttagttcattttacttttctttcctctgtttacgtcttttgcatgtctccaataattatttctttaaaggaataatttaaattaattacaaattaaatgctttgattctcaaattcaggtgggctacgaaacgctgcaaaagttgggctacgatgatgtgctgcaaggggccaaattgcgcacattgttggttcatgagatggaggaaatgttggaggaggcggacaccggaggcaagagagaaaaaaaattaaatttaaattttataaataaatttttaaataaaatttaaatagtaattaaaacattaataattagggttaagaattgtatgcttttgcatatttttctgcgcatattctatgaagaaagaaatgggctcaaaaaaagcatttctacattaaaattttttgatttggtgaagttttttttagtgatataaatgtatattttggggttttctagaataaatgcatattttgccatctttggatttttgagcatatttcggctatttttggcaaaatttcactaagctttttgggaattaaaaaaaacactcttaaaatcgaaaaattttttggaaaaaatttgtttatataaaaaatagaattttataataaaaatttaaaaaattcaaaaatatatataaattaagaaaattaaatatttttttgcaaactctaaaaaacctccttagccattttgtttagtgtttttaagtcaattctgagttttttacgcaatttttggcattttttgagggttaaaactttttaaaggcatttttgtgcataattgggtatttttcgggtttttaggtcatatcaaaatttaacttatattttcgataaagtataatgcgatttatttaaatagttttttactgttcattttgcaaattgtctttaggcataaattaatttgattaatttacatataaaaatttaaataattttatggaaaatgaaaaacatattccaaatatattttttaaattcttattaaataaaatgaattttaaattttttgcacttttaagtgaataaagaagacgaagattattcactgaaaactgttcacttcacaaaagcaaatgtgcaattgttcaagaaaggcaataatggaacagaaaagctaaagggcatagaaaaatggcttcaaaaaattttcaattggttggacggactcgtggacaaatgccataaaaaatcgttgacaaaacgaaatcggatgcaacgatttttattcgagtgaatttttatccaaaattaaataatcaaaaaatttcaatttaaaa

SEQ ID NO: 69428 - DNA, 2181 bp, Heterodera glycines
  Genomic contig location: Contig_ID=SeqID_8852; Location=294..2474; Strand=+
  SCN-specific regions: Sequence locations=1-211,278-374,397-410,432 -522,544-745,767-775,818-959,981-1384,1425-1791,1813-1900,1932-2181
agatatttttaatgttaagagctccaaggaaaagactggttacaagcacaaaaagcaccgattggagtcaaaaaaggcaatgttcggcttattaatggaagttgacagtgcggttgaggacaacaaaaacatcagagaaaagtggcgtagaaaaggggaccaaatttgggaagaaaacagggaaaatgaaatggaaagtcagtgaaaaatgaaaaaaaaattattaaaattattattttatttaaattttcaataattattaatatatttaaattttcatgtttcaattttgggttttgttatgcgtgaaacgctcattagaaggtgccagccttacgaaatcttgaatattttaaagctttcatattggacagtttaataattaaaaaaaaaattcaatttccctgaaaaaatatcaaaattttgagaaatttttgatttcactcaaattttggtgaaccgggggattttattggacttgcgccataataagcacgcaaaacatcaattttacttcagaagtttaaaaaaataaattttaatccaacataatttttgttggattttagaaatttgggcagaacagatcgaagcagtgaagatggacaagacaaatgaattgtcaaacgatgcgtttaagcaagttaccagcatgctgaaagaaggcaccgatatgccaaagtggatgatcaatacgccaaaagattcaaaggtggaccaaattttaaaattgaccattcatcaaattttaaaataatccaaaaatttatttaaactaaaatctgtcttcattatttttgttttggcatgaatttgcctttgctgctgatgcacgtattgacaaaaaaatcaaaaaagttagatgtctatcgttgtgcatattttttttttgcatttcttttaattgcttttaagttgttgttaattagtctaacaaataagtcaaattcgttgtaaacttttaaaaatattttaaatatgctttgactgagcggcgcaagtgtcaaggcgcaaatttagcggcacaaaagtcgcaacacgtataagtataggtgcacatccgtaaactttatccttatctctaaaatttaatttcggttcttgtttttaggcaaaggctaatttttgttatgccaaattctcatgttccttaactcgagttacattttcactaacaatcaatttggttcaatgaatgactaatgagattatgacataatcttaggaaaccgaaaatttaatgacggaatgtcaaattaaaaaaatttttagagttcatcaaacaaaaatgcggggacatcctcgagagtggaaagcagcaacacgagaagacgtggaaaacgacgcgtaattcgcaacgcgacgacaccagcggacaaatcggtaaaatagaataaaaatttaattaaaaatatacaaaaaaagtatttggatgttagggtgaaaaatcatcttctgtataccgtaaccatttggaaaatgtccttattaatttttagtcattttttcgaaaaatcaagacttatggaaaatcaaaccgaagccttttaaaatacctgagctcactattcattttttaaaattaacaggaaccgtttgagtaataccgtacaattaatttgaaattaggtagaaagtttggataatacaccgtcattttttttttaattttaggaaattcgcacaccgtttaccgaagaaacgctcgtacgtaaaaagcgaaaaggcgggtttggcgcagggcatgctgccggccatgcaatgtctcgttccttttctcatgcgcattattcggccccatactatccgcacggcggatcatactgtatgggctaccattaccattcatcaacttattactactactcgccttatcacatgtcacacaaacaagtaaaggaattataaaaaaaaataattatttaattaatggcctaaccgattattgtcaatgttattgcactatgaagtcgaggcaaaagtcacaacttgtgaaaagtttcgagttcatactgcattggtctcgagttcaagacttggacactcggagtaaagactcgttatcgagcatccattaatagtttaaattattcttatgccaacccaaatttatgctggagtttatatgtaaaaacactagaaaaaatgtattcataacggaattttgaagaaattgtaaaa

SEQ ID NO: 69429 - DNA, 49 bp, Heterodera glycines
  Genomic contig location: Contig_ID=SeqID_41253; Location=120..168; Strand=+
  SCN-specific regions: Sequence locations=1-49
ctgtgacctcgagcgttaccaatggacgcagacactcggcgaattggaa

SEQ ID NO: 69430 - DNA, 780 bp, Heterodera glycines
  Genomic contig location: Contig_ID=SeqID_41259; Location=83..862; Strand=-
  SCN-specific regions: Sequence locations=1-588,610-690,712-780
atggttgagatgggaaccgaaattcaaacatcccgaaatgaacttaagtcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggctttgggtgagcatattaaacgtaaagatattgaaaatagacaagtatctgaagctgagaaaggactacaaaaaagagaaagactagccaatgaggatgttcaatttcaatatgacagcattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccaggatcaattagtgaagttatatatagcaccgagtattttcatcgtctacagtcgaaacgaatttcagaaattacaattgaaattcacacaccatttggtgaattcgttaaatttcactggggaagttgtattcttacattacattttaagaaaagtatattttaa

SEQ ID NO: 69431 - DNA, 1319 bp, Heterodera glycines
  Genomic contig location: Contig_ID=SeqID_8854; Location=397..1715; Strand=+
  SCN-specific regions: Sequence locations=1-132,392-394,416-426,448 -459,507-520,543-660,710-1023,1074-1319
atggttgcattgattggcgacaatgtgccgttttttacccggaagcgacatgttctggtgaaggaaagtgccattgtccggccggcatgcatccccagcatggcacgtgcgtcgagggcgaaattattggtgaaaaattaaaataaaaaatattttttttattaattttaaacaaaaaatatttgaaaaaattatggttaaattaaaaaatttattttttatttaattgtaaatatacaagaacttttttaaagaggaaaaaatcaaaatattttaacaattatttgagattgatgacaaataataaaaatttaataattaaataaattaaagtatttttttacatgaataataaatatttaaaaatttattttatatgaaataaattattgaaaacaatcttaaaaacttatttattggtatcacatttttataagtaacacacatatttagtattagtttaatttaattaaaaaatatatttcaaaaatttcatttattataaacattgcaaattagatttttacaatttataacaataaaaaaggtgtccaacatgaccaacccccacaattgtcgggccgcgtgccgttgctgccaccaagccaaattgaccccggaggcgacacctcacccattgttgttggcattgccccaggcaaaaaaaatcaaatttttatttttaattaccattttttattaaattttagatggcaaaaggcaaaaaataaaaatgctttttgaacaggttgaaaatgtgggtggaaaaatgaacaattggaagactcctaaccttttaaaacggtcaaacccgcataaattttcattcgaaagctctgggattttcccaagaccctagtcggggtactgtaatttttttgtttggaaaatgcaaaagggacatggcgaaatactttatttcttcctaaaatagaactcccggggcgctttattctccaaccctcttcaaagagtgggctcgaatttaggaaggggagggactgtattttataggaaatacggtaatataattttttaatgcattttttaaatgtaatattattatttaataaggcatcaatcaccgaccgactgagctgggcaagtgccggatttggttctcgcacagcaccagctcggccaggttttgcaggtcgccaatgttcagcggcagttccgtcaattggttcccactgatgtccaacgtgcgcagcgcgcggcaccgcaacagttcgtccggcaaccgggcgaccatgttgcagtgcaagtcgagcagctccaggctgacgagacagtccattttgggcggctgcaaaaaa

SEQ ID NO: 69432 - DNA, 429 bp, Heterodera glycines
  misc_feature (38)..(38): n is a, c, g, or t
  Genomic contig location: Contig_ID=SeqID_41263; Location=38..466; Strand=+
  SCN-specific regions: Sequence locations=1-64,86-211,264-366,392 -394,424-429
atgtcatgtcatcttcgtgaatttggtatatccccccnatatatcaaccagaactttttttaattttcatatacatatatttccagggtccggatttatacattttttatttttcacaaaatttgaaaatggatttttctattcatttcgtagttgtaagaatgacttgaatattgcaggaaaataccttgatatgaggactttctatatgtaaaatttaaaaaatttgttaatatacaaatttaaaaaatatatttataaaacttgataatcaaattcagacactgccttgaagagttttatctaacgaaacgaacagaaaaatcgcatttcaaatttggtaaaaaaaaacgaatccgggccctgttaatttccatttttatttttcctggcgtaatttaattaaaaattagtttattttttctttta

SEQ ID NO: 69433 - DNA, 92 bp, Heterodera glycines
  Genomic contig location: Contig_ID=SeqID_41263; Location=834..925; Strand=+
  SCN-specific regions: Sequence locations=1-92
atggccatggaagctcagcaacaattagcaattaatggtgccattttgggaatgccgaaaaatgaagcgagttttaaaaataatattgtaaa

SEQ ID NO: 69434 - DNA, 309 bp, Heterodera glycines
  misc_feature (280)..(280): n is a, c, g, or t
  misc_feature (296)..(296): n is a, c, g, or t
  misc_feature (298)..(298): n is a, c, g, or t
  misc_feature (305)..(305): n is a, c, g, or t
  Genomic contig location: Contig_ID=SeqID_41266; Location=418..726; Strand=+
  SCN-specific regions: Sequence locations=1-81,115-309
atgccaaaaattaaatcaaaatcggccagctttcgggaatggattcgaaggatcggaggaactgacttttattcaacaactggcaaaataatttattgtcaattatgtgaacaacaggtaactgcgacaatccgtcgaacaacaacaactaccaatacaaaattcacagattccttgcacgcaattcgcgtatctcaaacaacacaacgaaacggtaaagcacaaggcaaaattggaacggaacaatggaggacacagcagcaatttttgacaacactanacaatattccaaaccnanttcaccnttga

SEQ ID NO: 69435 - DNA, 87 bp, Heterodera glycines
  Genomic contig location: Contig_ID=SeqID_41266; Location=283..369; Strand=-
  SCN-specific regions: Sequence locations=1-87
ttgttcttattgcatttttgttaaggaattttccaaaaaatgtcgaaatagtgaaaaaatagtgacaaaacgccaaaatagtgtttt

SEQ ID NO: 69436 - DNA, 504 bp, Heterodera glycines
  Genomic contig location: Contig_ID=SeqID_41269; Location=721..1224; Strand=-
  SCN-specific regions: Sequence locations=1-107,134-263,292-504
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgtaaataaa

SEQ ID NO: 69437 - DNA, 689 bp, Heterodera glycines
  Genomic contig location: Contig_ID=SeqID_8858; Location=380..1068; Strand=+
  SCN-specific regions: Sequence locations=1-116,198-313,335-350,373 -483,513-523,562-595,618-689
atgcgcgaggcgccctacaaggcggacgccaagccgcgcaagttttggctgggcgtcgagtcgaccggcgcattgcgtgcggaaaacattgtgctcaggtgggcaaatttatgatgaattataatttttcaaaaaaaaaatgctagaaaatttttaaaaagtttttttgaaatttaaaaaaaatcaattttttttttggtaaattttctgtttgagaattttttttgaaacttttttttcaggggcggggaaccgacgcggggggggggaggcatagttcacccagtcaatttacaaaaatgggtaccaatacggcaatttttggggctttttcggctttcccccaaccactcccatcgactctttaaaaattagttcatgataaatcgtgaaaaaaacaggaaaagaaaacattagaaagacagaattttttggagctgggctcggaattccatccctattatataccaaaaatttcttaagaaaattagtaaaaacaattttctttttggcatacccaatgaaatttacttaaattttttttttaattcaaattaaaatgcggtaaaaaattgtttgtttttttttgcagtggtatccaagtgctgaagaagaagctgatcgacatgcaggaacagttgaccattgaacgcagtgccatggagcagcagccgaccacatattattaa

SEQ ID NO: 69438 - DNA, 269 bp, Heterodera glycines
  Genomic contig location: Contig_ID=SeqID_41272; Location=185..453; Strand=+
  SCN-specific regions: Sequence locations=1-108,130-269
atgttggtgcttctccttagtcttgaccgttctcgacttttgcgctctctctacttcttccaattctcgtctgaatgggctctccgtctttcagcggtatttttttcaattcgcccaaacttctttgttccaaaggtcatcaacatgttgcccggtaaattccccagcgcacttcagccgaggttttttgatctgtgcgaacaattgaccaagcaaattgtgcccactttggagccattcttgcgggaactaattgcagttgatcagag

SEQ ID NO: 69439 - DNA, 923 bp, Heterodera glycines
  Genomic contig location: Contig_ID=SeqID_41273; Location=2..924; Strand=-
  SCN-specific regions: Sequence locations=1-74,104-923
atgaatggtgtcatttcaagagaatcccgaggcttaaaccatgggctaccattagacactgtaccatttcataatggaatggtaaatttaaaaaataaaactcactcgacggcaaatggaaggaaatgtgccaatggttttcgtccctccgcaacgttttgccggtgatccgggcatagaattcgtaacattcaaagggaaacagtcgcacagcaccgaacgattggatgattttggagatcacttgggaggccaatttgaagcgcattatgtcctcaagcttggcctgaatacaaaatcaattaaagccgaaacaaaaatttgtttttggaaaactttcgtaaaagagaggatgattttttacagaaggaattgaagcatacgtagcagaaaaagcataatttaaaaaaattaagaaaacatttcggctcaatttttgtctatgagacgattcgccaaaaattccatgctaaaaaatgatcatgcttttagaagactaatatattgcttggaaaaagcattctaacgagattacagatttgggcagatatttgtaaataaaaatatgatgatgagttaaagatgccaaagaaccaaaaaatgagggattcaatcgcatttttaaccaaaatttatttttatcgaaaattatttgaattttcagaaactcatgggttgaaattaattcattttcccacaagttttacccgttgtccatcgtgaatgcacgtgtggaacggcgaaggcgcaaccgaaatgccgatggcgtccggcgtcattcgagtgccgaatgtttgtgccgagtcggtgatgacgcgaaaagtgccaaacaaaagggccaacaaatgttgggaagggacgggcaaagcggtgacaattctaagaatggaaatgaaatgtattacttacaattaggattttag

SEQ ID NO: 69440 - DNA, 668 bp, Heterodera glycines
  Genomic contig location: Contig_ID=SeqID_41273; Location=46..713; Strand=+
  SCN-specific regions: Sequence locations=1-668
aattgtcaccgctttgcccgtcccttcccaacatttgttggcccttttgtttggcacttttcgcgtcatcaccgactcggcacaaacattcggcactcgaatgacgccggacgccatcggcatttcggttgcgccttcgccgttccacacgtgcattcacgatggacaacgggtaaaacttgtgggaaaatgaattaatttcaacccatgagtttctgaaaattcaaataattttcgataaaaataaattttggttaaaaatgcgattgaatccctcattttttggttctttggcatctttaactcatcatcatatttttatttacaaatatctgcccaaatctgtaatctcgttagaatgctttttccaagcaatatattagtcttctaaaagcatgatcattttttagcatggaatttttggcgaatcgtctcatagacaaaaattgagccgaaatgttttcttaatttttttaaattatgctttttctgctacgtatgcttcaattccttctgtaaaaaatcatcctctcttttacgaaagttttccaaaaacaaatttttgtttcggctttaattgattttgtattcaggccaagcttgaggacataatgcgcttcaaattggcctcccaagtgatctccaaaatcatccaatcgttcggtgct

SEQ ID NO: 69441 - DNA, 1029 bp, Heterodera glycines
  Genomic contig location: Contig_ID=SeqID_41275; Location=1..1029; Strand=+
  SCN-specific regions: Sequence locations=1-509,532-544,566-573,598 -1029
  Gene Ontology: Cellular component=mitochondrial inner membrane; Biological process=electron transport
ccgatgattttacgaaattgttttttggactctcaacgcatttggcccatctctgagctcatgttctcccactcctccctctttttcagatttgtcgtctcttgggcgctttgtacagcgaaatgattttccgccgcggctacgtccacagcgacccgcaccccggcaatgttttggtcagacgaagtgccaacaccgggcgggaggaaattgtgctgttggaccacggcctttactgtgtaaaaagtccgtttggaaatgccaatgtcaaaacgagcgccaattgtcagactcttcccgacgaattgcgcattgattacgcgaaactgtggctggcgctgatgaagccggaccaggacgaaattcggagggtttgcgaacggatgaacatcggacagaactacggactgttcgcctgcattgtcacaatgcgctcttggaagtcagtcactgcgggcattgcgcggacagaaattgacgacagagaggtggggaaacggagacagggttttgaaaagggttcaaattttcaaaaaaataatccaaaattattatttatttttttggggggctctgtctttgcatctccctcaaatttgagtacttttgaagcgatcgcacatcaaagagtacgccaccggtcttatccctcaaatttccgtggtcctcgattccatcccacgccaaatgttgctgattctgaagacaaacgatctgctccgaagcattgcattcaaattaaaaacggaacaccgactggacagtttttcagaggtgaattcggccggaaatgtcttctctttcctcgttaattaatttttgttccgtcagatgaccaaacattgcactcgcgccgtttaccaccactcaatcgccgccacccaatctttgctgagcaaattgcgactttacttggccatgtacgtccttttggtcaaaataaacatcttcgaggtctttctgattgtgaatggactgctcacagcgaggcaaaggcatttgacactttaacaaatgcttttccttttg

SEQ ID NO: 69442 - DNA, 738 bp, Heterodera glycines
  misc_feature (89)..(89): n is a, c, g, or t
  Genomic contig location: Contig_ID=SeqID_41276; Location=197..934; Strand=-
  SCN-specific regions: Sequence locations=1-92,114-266,288-361,383 -576,720-738
atgattggaaagctggtgagattgagtccagagaattggaatgatggagaattgagtccaagtgattggaatgctggtaagttgagtcncagtgattggaatgtcacagaattgagtcccgatgattgcgatgccgaaggaccaggtgaggttaggtcccagtgattggaatgccggagatttgagtcacagtgattggaatgccggagaattgagtcccagtgattgcgataccgaagaatgcgtgaaaagtgagggattgagtcccagtgattggaatgctggtgagattgagtcccgggaattggaataatggagaattgagtccaagtgattggaatgctggtaagttgagtcccagtgattggaatgtcacagaattgagtcccgatgattgcgatgccgaaggaccaggtgaggttaggtcccagtgattggaatgccggagatttgagtcacagtgattggaatgcaggagaattgagtctcggtggttgcgataccgaagaatcaggtgaggttaggtcccggttattggaatgttggtgcaataacgaacccaagacttgtaaagactattaaaaatgttaaaaaatgaaaatttaattgctaaaaattaatatattattttgttaacactacaattcaatacttaaaaaaattttcagttaaatttaaattttaaatatattcataatcttaaataatatcttataaaagcggaaagactcaaataaa

SEQ ID NO: 69443 - DNA, 679 bp, Heterodera glycines
  misc_feature (354)..(354): n is a, c, g, or t
  Genomic contig location: Contig_ID=SeqID_41277; Location=8..686; Strand=-
  SCN-specific regions: Sequence locations=1-314,337-378,422-517,539 -579,622-679
gcaattttcatcgccgaagtgttccatcgacgtgaggtgcccacacagttccgctccaagcgtcgtctgctcggcaagtacacgctggtgccaccgaacacggccggcggcagcaacaatgactaccaattggagacggatgggccaccatcaccaccgccaccgggaggaacagcgccgaatcgcaataacaaccatttccaattggacactgtacgggttgcggacgatggattacgacatggacggccagaagctgggagcaactacaacaacaacagggtgggatagggttaggaaatttttttaccaagaatttttatttaaaaaaaattacgtttctccaaccccccnccccatccaatatttttccttctgaaaaattttttttaaataatgaaattttttattacttaaatttcttttagagttttttctattggattgtcccataattacgtttagcgttttaattggtgtcttgtcctccataaatctcttcaatcgtatctcagaaattttaaaagaaattgagttgcccccgatagcgtttcctctcgaaaaaatcttagagggtactaaatttttttaaaatttttttaagtaagttttaaaaattatgcaaatattttgtcattattgggtttgcacccagggatgggccaaatcggaaaataaa

SEQ ID NO: 69444 - DNA, 802 bp, Heterodera glycines
  misc_feature (706)..(706): n is a, c, g, or t
  misc_feature (731)..(731): n is a, c, g, or t
  Genomic contig location: Contig_ID=SeqID_41278; Location=250..1051; Strand=+
  SCN-specific regions: Sequence locations=1-101,123-126,150-233,257 -459,481-802
gatggagcggacgaagtattgatcaacccaaacatgttagagaacgaacggcataaattgaacgtggaacggcgcaaaaagaaggaccactacaacccgtatgaggaggaggtggacgagttcggacaggtgggagaagggggatggggagttggaagtccaatatatacattaattgactaattaatgtgttgtcaggtcaaaaaacagcaaatgctttccaaatacgacgaaggcattgacggggagaaggaacgcgacacattccgacttggtaacacatttaaacaggcatttgtttcgaaatatacaaatatttgacacaccgaaattccttttatttgggcttaaaatggagccaggatttggtttgaaacccaacggaacgcttggcatatttagatgagagtggacagtacgacttggacgcggagaccgccgagctggaaacacggcgtcggctgatgatgctcaacaaaaagtttgagtcgttagaaagcaccaaatacacattggccaacgaatttcacaccgaggcaagccaaacacatcttcataatacgaaggctcattacaaaaggggaaattgccctgaaaaataaaaaattagaaatttgtttcacattttggcataatctaccaacaaatgttccaatttattggataaattcaggaagaaatgatcgcatttcgtcgtccgaagaanaaggggagggaaaagcacgcggaanagaaaggcattgaaagccgacgatttggagacggaaacgacggaagaaacggagggagaaaaaaggatacg

SEQ ID NO: 69445 - DNA, 1026 bp, Heterodera glycines
  Genomic contig location: Contig_ID=SeqID_41281; Location=79..1104; Strand=-
  SCN-specific regions: Sequence locations=1-636,807-1026
gggatggaattggccaacgaacgaacgaacgattcatcagccgagtgatgccatttcattcccttctcagattcgcaattccaccgactttgccaacacgggaatgaggtgactgtgcagaaagtgccctcattttccaataattcttctcctcccctaagatattgctgcttcggcactcccgaatcgcccattgtgtcggatacgcgtgacatgctggtgagtgggcagtgcaacggcacagaatgccctccagcgaagatggcaatggattcccccccccctccccgcaggtgctgttccgctccttttaccgcggcggaaagggctttcaagcgcgtgcccgggcagtcgcgacaactgacgcgccgctgggcgcttggagtgagtggagtgagtgcagtgcctcttgcggtgcgtgcggtgtgcgtcggagggtgcgcgagtgcgcgccccgcggggacgcggtgtgcctgtcagtgtgttctctttttttttgcttatccgttgctgttgttttgcggtcgaaggttctgttttttttgtcgatcactttgttctcttcagcttggttttgtgttcctttacgttttcgattggcttcacttcccaatgctaattatgctaaccgtggcactcgcttcttctctttttatccatggcattatccctttggcttttttgctttctctctctctctgtttgattatcccttcggctttttctctttgcttttcctctctcccctttgtctctttctctgttttgctttatctttccatgcctttctctctctgctttatctccattacccccctctttgttttagaactgaactctcgcaaaccgaagtctgtgcccgtcggccctgcgcctcactctgtgcccgttcattcagcgaagaggcgccctgcgaggggattctctctcttctgaagggcctccgctgccgcacggagagaacgcggatggagccatgtcgatggatgtgttgtgccgggtacacagtgacaaagatggacgagg

SEQ ID NO: 69446 - DNA, 666 bp, Heterodera glycines
  Genomic contig location: Contig_ID=SeqID_8859; Location=660..1325; Strand=+
  SCN-specific regions: Sequence locations=1-477,514-530,552-666
atgctttacggtatgacataccgataataaaacagcgtaacaaacggtacatttaattaataagtgcaaataaaaatgtagctttggaatctttaaatttgttcagcacaggaatttctttgtgcacttttcgtccaccacattcacaaaaaacaatcgcagaaacatatgcagtggggcagaagctgtgtacatatccgtgttcattagggcaaatcggcccgatcggatcaaagtgtcaaatgattggaagaattgctggtgggtgtaattggcgatcagagtgttcgggtcgtggacctaaaacagggacaattaagctaaattagtcgcaattagcacttaattgccaaaaacctcaatatttatctgacaaattgagccggtgaaacgctcaaagtgatctggaatatttattgcgttaaaatacagtttagaaaaaaactcaaaaatttatcactttttgtttattggaacataaatatttttacaattattttttaatttaaaatagttacaagcaagcagttcaataatgccaaactctgctccctcaatgtccattagcagcaaatcaacgggctcctgttcccattttgtgtgattattcataaagtcaatgatgccaatttgtgtgactaatttccgctcaatggcatgttctta

SEQ ID NO: 69447 - DNA, 349 bp, Heterodera glycines
  Genomic contig location: Contig_ID=SeqID_8860; Location=478..826; Strand=-
  SCN-specific regions: Sequence locations=1-272,294-349
atgaacaaagcgaacattctaaaattgaattcaagtgatgagtttaaatattttatgcgcttttgtcccaatgtcaatcttcaaaagcgaacttgcacagttgtcacattcggtacaaacctaaaaaagaaaataaaaattagtctaaattttgaaatttttgcaggtgttggacatacggttagagctgaacgggaactgatcaaaatttaccctgagtgccatttgatcgctgctgatccgtcggctgagattaatgcaaatttgacacaatctgtaggtggcacttttgttcagggcccaattggtgccgagacggctaatcaacaaccagtgatttcatgggaag

SEQ ID NO: 69448 - DNA, 66 bp, Heterodera glycines
  Genomic contig location: Contig_ID=SeqID_8861; Location=372..437; Strand=-
  SCN-specific regions: Sequence locations=1-66
atgccattcactggtttttctgccgtcaaatcggatatctaccgtgtgaacccattatattcattg

SEQ ID NO: 69449 - DNA, 186 bp, Heterodera glycines
  Genomic contig location: Contig_ID=SeqID_41282; Location=504..689; Strand=+
  SCN-specific regions: Sequence locations=1-186
atggagagaaaggtgctgaatgggctccaaaatccctttaggtatggtttcgtccgtcttcgtatggtcagcaaataccacgcggacatccgcgaatgggaagtgcaaaagaccatccacaagaaggatgcggataagaaggagtcactgagagtgctgcgtgagcaaaacgaatggattatgaag

SEQ ID NO: 69450 - DNA, 446 bp, Heterodera glycines
  Genomic contig location: Contig_ID=SeqID_41284; Location=439..884; Strand=-
  SCN-specific regions: Sequence locations=1-178,201-446
cgatggcttcggcgctttgcttgtctcatgtgggcggtcagtcgttaaaatgtcaaaaaaggtaaaattcaatttgatgattcactgccaaattactttttatgtttcagggtaatgtgttgcaatgttttacggcaccggagggtgtcaattattcggcactttttgtcagtcaatccgggaggcttttaattcttaacagagcccagagaattctttatttggtcgataaggtgtgattgtgatcactgatcagtcagcagggcatttctctggccaatgccaaatgcctttcttttctttaggattcgaatgctccgattgctcgtctccaccattgtgacggggccgtgggcagcgcctcactttggatttggactcattttggtgtagaccagcaaaatggaactctgtttatcctcgagtacatttcgaatcgcgtcgaa

SEQ ID NO: 69451 - DNA, 455 bp, Heterodera glycines
  Genomic contig location: Contig_ID=SeqID_41288; Location=242..696; Strand=+
  SCN-specific regions: Sequence locations=1-81,149-312,334-455
atgcttgaacatgtttttgttcgtacaataggtaatgtttcttgttttagttgagttcgggatttaatcgaaatctaaatgattaaattaaattaatggtattaaattttagtctatattaaaattataggtttaaatattattttatcatcaatttctaataggcacaaaatcgaaaatgccaagctcggacggcgtttccaattgaatgccacttgccaaacgttggataaacaaatgaaagatgtgccaatgaatcaaattgacttactcggcaatgagtattccgacggggaagtagacgggccgaaatttttgatagaatttgtcccataggaacgatcaaaaaaaggtacaccgtctaaggcttccaaggccatcaaggcaattttatacaatatgaacaagaaacaatcaaaaaacagttcttataacaatgtcaagtcaatgccgaa

SEQ ID NO: 69452 - DNA, 55 bp, Heterodera glycines
  Genomic contig location: Contig_ID=SeqID_41289; Location=40..94; Strand=-
  SCN-specific regions: Sequence locations=1-55
atgaagcgccaaatcttggaagctagaggaccatgccgcaataaaatggaaatat

SEQ ID NO: 69453 - DNA, 84 bp, Heterodera glycines
  Genomic contig location: Contig_ID=SeqID_8863; Location=123..206; Strand=-
  SCN-specific regions: Sequence locations=1-84
atggccacggttagcaacgaaaaagtcgggggctccactctgatcggagaagaagacgggcgtgatcagcgtaaggtcggggag

SEQ ID NO: 69454 - DNA, 612 bp, Heterodera glycines
  misc_feature (12)..(12): n is a, c, g, or t
  Genomic contig location: Contig_ID=SeqID_8863; Location=45..656; Strand=+
  SCN-specific regions: Sequence locations=1-200,222-612
  Gene Ontology: Biological process=glutamate metabolism
atcgatcatatnggaaagtccaacttccgacgaggcgatgtgattttgtcgaacagcccgcgggcgggcggttctcacctccccgaccttacgctgatcacgcccgtcttcttctccgatcagagtggagcccccgactttttcgttgctaaccgtggccatcattcggacattggtggccttgtccccggctcaatgcccccacattccacaacattggcccaggagggggccgtctttcacagtttcaaaattatcgacggtggtgtgttcaaggagtctgagctggtggaacaattgatggcaccacaaagagtggccggctgttcaggcactcggaatctgcgcgacaatttggccgatttaaatgcgcaaattgcggccaatcaaaagggcattggccttctgcatgaactcgtccgtgaatattcgctgcccatagtcaaagcgtatatgaaacatatccaacggaacgcagtcgaagcagtgagacaattgttgaaaaatgtggcggaagagagtcagcagaagggacaaaaggttttgagagcgaaggattggatggacgacggaacggagataaaattggaggtggaaattgacagagactca

SEQ ID NO: 69455 - DNA, 519 bp, Heterodera glycines
  Genomic contig location: Contig_ID=SeqID_8864; Location=2643..3161; Strand=-
  SCN-specific regions: Sequence locations=1-519
ataattctgggaaaaaggctgctgaaaatctgaaacaaaacaatgtccaacaggcgaaaaacggggagagcaaacgcagtaaattgcaagaaatgatcggccaagccaaaaaaactgttgaaaatgcgctcggttcttcgcacggatcgttgggtgagaaaatacaaaaaaacatttttgaatattttcacagagagtcaccaaaattcgattgaccttcgtcaagaagtggcggaaatcaattcgaaatgcgcggatttggccaatttgctcaatgcgttggaacagaggctgagagccgtcgaagaactgacggagggggtaattattatacaaaattgccaatttgtaattgtaatgcccacgattttcagattgccaaaaagatcggctacagcagctgatgagtgtttgagtgagcggagtttatcagggcaatccccagaagatgatttcgatgatgatccagtgcagcaccaccaatctgatctttttgctagtgtaacatttgatttttga

SEQ ID NO: 69456 - DNA, 484 bp, Heterodera glycines
  Genomic contig location: Contig_ID=SeqID_41292; Location=178..661; Strand=-
  SCN-specific regions: Sequence locations=1-484
atgtcttcttcaagtggaggcgccgcggggccttccgtcgtcgacgaagagacggcggacgaagtgaaagtgttccgctcgaacaacgccgaagacgacccaaccgatatggccgggtcgtcggcggatttggacgcggataagcaggaattggccatggaagcggatatcgaaatgcaatcgaacattggcgagtcaaagaaagggcgagggaattatgcgggaaaaacgatcgaattgtcgtcaatttcaggccaatcgttcaatccgatggccaatccgttgtccggcccacttccgtggccttcgcctggcagcaacttccttttcagccagatccttgccgccgcttctctctcccccgtgtacggtcccgcatttcaaaaagttgccacggcaatggccgcacagcacttcgccaccgccgcggctttagtcgtacggaactcgccaaattatatgaatttgggcccgtcttttgggg

SEQ ID NO: 69457 - DNA, 629 bp, Heterodera glycines
  Genomic contig location: Contig_ID=SeqID_41294; Location=271..899; Strand=-
  SCN-specific regions: Sequence locations=1-147,174-213,235-286,324 -342,364-449,500-594,616-629
atgcattgccttttctcaattgtctacacgattctgaccatttttatggttgcgcacacactttccaagggcaccgtgggcggccaaccgatgaaaacagagcgggtgagttcggtataatttagttggttcgggacaaaggaaccgcagggaatatttttgtaacttttaaatgcgatgcgattttgttaattgatttatccaaaaaatttcaaaatttgtaaatttttagcagatttttatcaaatttgtaggccttggaatatttttttaagtacgtgtctgtgtgatcacagacatctctcttgcttctctgattctttcccacctaataaaaaaaaacaattttcttcatttccaggttttgctggatgatgaaaaactgcgggaatatctcagttggttccgtttctttgacaatgacaaagatgcgcagctccagcacaaacaatttaaagtaaaaattcaatttatatatttttttcaaaaatttaattttgttaggacatcctttgggcgttggggcgtcttccttattttgaggagcagccgaagttcgagcgggttttggacgtggtggaccccaatcggtaatttattatttatttagaagaacataaaaaaataaa

SEQ ID NO: 69458 - DNA, 144 bp, Heterodera glycines; identical to SEQ ID NO: 57282
  Genomic contig location: Contig_ID=SeqID_41299; Location=174..317; Strand=-
  SCN-specific regions: Sequence locations=1-46,89-144

SEQ ID NO: 69459 - DNA, 237 bp, Heterodera glycines
  Genomic contig location: Contig_ID=SeqID_41300; Location=147..383; Strand=-
  SCN-specific regions: Sequence locations=1-88,111-237
atgtactttgctgatttattgcaccactccgtggaaggtaattaattatttattaattgcggtattagcgtgtacgatctcaattaactttaagatgaaaaattaaaattattgtaaacaaattcaaatcatttttagcatttcccataaatgatttcgatctgattcgactgctggtcacacgttccgaagttgatctagccgaaattaaggtgtgatttgtttaagtaaaataaa

SEQ ID NO: 69460 - DNA, 232 bp, Heterodera glycines
  Genomic contig location: Contig_ID=SeqID_8865; Location=454..685; Strand=-
  SCN-specific regions: Sequence locations=1-76,98-232
ttggactttttcttcgagattgccaggccccaaacgcatggtcatccaattaattgtctgacttcggttgaccggtaagaaaagaaaatccaaaatatcgcagtcgatgaaccgcccatttttcagcaatttgttcgtttccgggggagaagagaaaattttccgcgtgtttcaggccacttcatcattcgccgaaaatttggccaatctctccgattcttcaacaaagacg

SEQ ID NO: 69461 - DNA, 1623 bp, Heterodera glycines
  Genomic contig location: Contig_ID=SeqID_8866; Location=471..2093; Strand=-
  SCN-specific regions: Sequence locations=1-251,282-380,402-403,435 -524,550-631,654-667,690-771,800-1031,1068-1157,1180-1351,1380 -1392,1431-1623
atggctgcgtatgcaggcgacactgacgatgtactgcttgccattcttcaatttgaccacattgatgtccaatttctgaacatggatggcgatgatgatcaaattggtgccgccgtttcatccctcaaatttggcagtgccattccatccacttttgaactttcgcacatttgtggtgccgttgtcatggctgttggcttgtcgaatggactcattgacatttttgtctcggaaacggtcggttttgaagcaaattttgattttaaattattatttttttacttttcgatatttagaattcttactccatccagaagaaattgtcccttgacttatgcggtagcaacaaatcgtggacccgcgccttggcgtttaatggtaacaatttagggagtgactcgtcccattttaaaaattcaattttgaaaattttccatgaaaatatttaggaattttttttcataagaaaatttcaagaaaaaaaattaaaaaatttcttcgcgatttttcataaatttacactgaataattatttttttaaaaatttttccaataaatcgctgaaaactaaaaaaaatttcttgagtttttttctgaataaatttcttaaggttatttcatgaaaaattttaaaatgttttttcgagagaaaaacgtagttcacagcaacaatttatggttttttaaaaattgacgattaattactgacttttttcaaaaagaatttccaaaaaatcgctgaaatataatataaaaagaatctttttctcgattttttaatgaaaaattaaaatttaaagcaaattcagttagcgaagatggacagtgccacaatttgtcgcttgccgcagcaaccgatgggctaatcaaaatttggcaatttgtcggcggcggtgaccaaatcactgtgacaccactcgcaaatgatgatgatgatcaccaacagctcaagatgaaccaacaaacattttgcatccaaagtaagtgctaacagttttattgctttatttttttttggaaaaagtaacaagaaaattttaacttttatgaatttttttttttaaattgggggggggggtgaccgtcaaatcttttcaaatcaatgtttttaaaatcttcagatgttaaactgcggtgggtgtcgactgggcgacgccaacttttttgttgttgttccaaaagttttctgggtcgctgacaatgaatcctgtatccatttcgaaccctcggacccaaattctaacaatttttgttcgaatttgggggtccgggttcgtaatttgtcgaaatggatggcggattcgtgataagcgatccaaaaccccttgaaatcatgctttcatgacttttgaaaataaaaaaaaaaaattttaaaaatacacccttcagaattgaaaataaaaattctcaaaaattttattgcctcttcgaaaatttttgtgtctatttaaacctattttgcttaaactgatctcctttattcttttgttaaatttcgcttttcttttttactatttttaagatggcgtcgctcatccgatctctgtcactttggaatccgtcctacacgcgcagaccggcccaatttatgcacttggtaatgtcccctacaatgctaaatga

SEQ ID NO: 69462 - DNA, 857 bp, Heterodera glycines
  Genomic contig location: Contig_ID=SeqID_41304; Location=28..884; Strand=-
  SCN-specific regions: Sequence locations=1-120,142-724,746-800,822-857
atgactgaggatgaaagggcggctgccaattggctggacaaccacgcatggccaccagctgaagccttcaaggacaaattctttgagaaaggtaatttccaagggggggggggggtgggacaaaatacgcctaaactttttccgtttttcagtttggaagaacgcaaaagggcgctcgggatacgcggctcattggcgtaaggagttcatgcactcacacactgaacgcacatcccgtgctgcgagggcggctgccgaagggcgcttcgagaagtgtggagatttggaatacaccagaatgtctgagcgcgtgaacccaaacgaactcacgcttgaagatgcacttcgagaagaggtttttgagagtgttattagtagaatagtctgtcttttggtggcttttagaacaggtgcctctgaatgtacctatagtattctctttcgactaagttgggtgcctttgaatgcaccttaagtatattattattcaccccattttaggacactgacgtcaactcgcccgatttgcttgatgagttttgcaagaccaaagcgcccaacatggtgcgccgacaggaattgtgcggtgaactccagagccgctcgttgcggatctctagactgttcgaacttcttcagcagcatgtatgcattaaagaagaaatcatttcacttagtcgttttcataggcggcggatgcaaaggaggcgaaaaaatgctacaaaaaggtgctaaagcagaagaaggaccagttgaaagaaagggcggatgcactggcgagcacgaatgcggaaaacgaggagctcaagttggaaaacaacttgcttcgtgagcgaatcggcgcgctggaatcaatg

SEQ ID NO: 69463 - DNA, 156 bp, Heterodera glycines
  Genomic contig location: Contig_ID=SeqID_41308; Location=192..347; Strand=-
  SCN-specific regions: Sequence locations=1-156
atggggaattgtaagcccgcggatgccactgagtcggagaacgcgtcttctgtcgagacggttgaagttgaagtacctccggaccctctcgttaacccattctggaagatgcaaaaagccttcgagaagaaactgcgtaatctgttgaagcgtgag

SEQ ID NO: 69464 - DNA, 480 bp, Heterodera glycines
  Genomic contig location: Contig_ID=SeqID_41310; Location=23..502; Strand=-
  SCN-specific regions: Sequence locations=1-100,122-480
atgaaaaaagttgtgctccaaaaaccgggctggcgcccagttggttggcgcccagtcgacccccaccctcgggaaagtaccctaggtttcagggtaattcgaaaagaaaattatttataaatccataaaatatgttttataggcttttcgggttctctggtcacaaatattaggtgtacatccatttcgaactccttccggaccctaattcgaacaaaaggtccaacgcccaaatttcgcatttttttgttttccttctactttgaaaacagcttaaatggtcgttcattgtgggattgacgctttcattttgttttcttgttagtcccgggttcggaattggccgaaatggaagccgaattcgtgatcagcgaccccgaaatgactaaaatttgaaaaaaggtgggggggggggaatttaaatttaccgttttttaggtcttacttttgtacaaactttttaagcactatttgaataaa

SEQ ID NO: 69465 - DNA, 963 bp, Heterodera glycines
  Genomic contig location: Contig_ID=SeqID_41311; Location=172..1134; Strand=-
  SCN-specific regions: Sequence locations=1-887,909-963
  Gene Ontology: Mol. function=valine-tRNA ligase activity; Cellular component=intracellular; Biological process=translational elongation
atgggactgtaccgggacaccaaggaaaacccgatgcaattgcgcatttgcaggtgagggagagactgtggcaaaaaagcatggttttggtcacaagatattcacgaaagcgaacccggctcattagcaattatacaaatttgaaaaattatttaatggtccgtttaacacccaaggaatatgtcgtaattttatgcacacgaaatatttgtggggcgagtattctgcactttccaagctgtttttttcatgatattttccaacaccaattactatttttcatttttttcagtcgttccaaggacatcattgagcccatcataaaatcgcagtggtacgtgcgctcttcagagatggcgaagcgggccaaagcggcggtggtcgacggacgacttcgactcatcccggaataccacgtgaacacgtggaatgcgtggctgaacgacattcggttcggaacagaaacataatcacataagaagttactaaatcgatcatctaagggattcggtgcatcttctcgtcagcttcggtggggtcaccaaatcccggcctcttttatcaccattgacggcaatcattcttcgacaccgccgggaaacaatgaagagcgttgacgacgaagaatcgtattgggtgtccggaagaacggaggcggaggcgaagacaaaggcggccaagcggttcaacgtttctgaacagtccgtcacactcgaagcggggtatttgaattttaaccggtttaaaaatggaataatatccaccccatccattttcgccagacgaggacgtgctggacacgtggttctccgccggcatcgtggccctttcagtgtggatgggttgggcccgaaacagaacggcggacaggcgccacttttttccccggctctttggctggagaccggacacgacatttcgttcttttgggtggctcggatggtggtcattgtcgcaggcacg

SEQ ID NO: 69466 - DNA, 1574 bp, Heterodera glycines
  misc_feature (1466)..(1466): n is a, c, g, or t
  misc_feature (1543)..(1543): n is a, c, g, or t
  Genomic contig location: Contig_ID=SeqID_8868; Location=37..1610; Strand=+
  SCN-specific regions: Sequence locations=1-429,451-495,518-694,751 -867,892-1574
atggcggaaattagatatttaggctttttattaagcgaaaaaggagtgcgcatggatccaaaacaagtcgaagctgttcaaaattttaaaccccctaaaagtctaactgaattaaaatccttattaggagcacttacttatttccgtcggtttataaaaaattttgcacacattgctaggcctctacagactttaactcaggataaatttgagggtaaaataccagaaaattggggaaatgaacaaaacgaagcattacaaacgctaaagaaaatgctcacttccgccccggtcttacaatcaccaagatttgggaaattatttataattgagtgcgacgcatcgcgcagagcaatcggagctgttttactccaagaaacgggtcccgttgcattttcttcacgagcattaaataaacacgaagcaaattatccctcaattgaaagagaggcgttagcattagtctatgctgtaaaggaattttccccttatataattgggtccggtacaacaaagataataaccgactgtagtgccttaacaggaatgatgagggcaaaagaacttaagggcagattagaaaaataccaagtcacgttacagggatatgacttagaaatagtttataggcccggaaaaaagaacaaagccgcagattttctttcacgatataatatcccaggaattgaagatgaaacagaaacaaatttaactgaaaagaaaaacaaaaaagaaaataaagcacaaaaaattctgagtactgagaatagtgaaaataaaatagaaaatcaggacaatagcaataaaataactttaaaagaaataattgaagaacagcggcaagtaaaggaattagcaaaaattttttatattttgaaaactggaaaatatcccaatgaaattttgaaatggaaaaaggttaattcggaatactgcctaataaatggcgcgatttattaccaaaaagggacagagaattctgaaaatccaaaattaatcatacctcactcattaagaaaaagaattttttgtgaaatacacgacaaaggacattttggatttgacaaaacatggacagaaataaaaagcagattttattgggtcggaatgaaagaagacgtaaaacttttgattgatgcatgtgatgggtgtcagagaaggaaagtccaaccaggtcaatcaaatttctcaccaagtgttccgataaaagcaacggaatacccatttcaaagagttcactgtgacttaatgggcccacttaaaaaaacagaccgtggaaatttatacatttttctgactatcgatagtttttctaaatggataacagcaaaagcaatttctgatcaaaaagctgagactgtctccgaagtttttgtagagacagtaattcataaattttccaccccagaaatagtagttacggaccaaggcagacaatttacttcagaaatatttagtaatttatncaaaaatttacggttttgagcatacaatgtcaacggcttatcatcaacagtcaaatggccaagcagaaggctcaatngagaattgtagctaatattatgtcacaaata

SEQ ID NO: 69467 - DNA, 2095 bp, Heterodera glycines
  Genomic contig location: Contig_ID=SeqID_8869; Location=148..2242; Strand=+
  SCN-specific regions: Sequence locations=1-490,513-602,626-838,862 -866,894-1083,1131-1668,1691-1697,1719-1960,2007-2095
atgtataatggaccggtcgttcttccattgagggaagcggatgaacccttaaattgggaaaaatttgtcaatgacccaaatttagaattggaggaaaaaacggaagaagaaagttctgatgaggaagaaaaaaatactgagattgaaaaattaaataaagagaaaatgcacaaaaagggagctgaatttaaaaaatcactgaccaaatttggatttgaaagcagtgaggaagagcaggaatcacaaatcgcatttgtgagaaatgtgaatgaaaatgaaggagaaaatgaattggaaattttaataaatgaaaatttaatagaggaatgggaagatccctgcacaattacggaaatatttatagatggggaagcaaagtttgcctatacgagttggccagaagcaaatttgatttcgctgacttcactaatgccaatcgatttggttcaggatcattgggaagtgtttacgaatgattttggaaaggattatgtgattggaaatttattggggaccaactttgagctatttataaatgaagaagtggacaaaatagtgctcggaatccaaattcaatttttattaaatgatgaatgggattctaaaatggaaaatgaaaaagaaacatattgggaaaaattgggagaattaaatggacaaattcttgaattgcaacgaattcctgatataaatattgcttacaaagaaaatttacaaaaaaataaaaatcgtgaaaacaatgaacaaataaatggccaaatacaaattaatgtcataaaaaataaaactacaaaagttggggaaaaggaagaaaatttggaaataatactttcaaatgatttaaataataataaaaataatgaaagaaataatttggaaaatttgggcaaaaatgttgactatttagccatgcaatcgccaaatctgcctccggtcaaagtttttgaagatgatttggatgaaaatgaacggaagttaagggaacagatcgataaattgaaagaagaattggaaaaaacggaagagaagaaaaaggagattgagaagagaagaatggagcaaatgaaattggccactgtggacgaagttgtccttgaagatgaagaggaggaagaggaggaggaaccaacctccaaaaagtcccgtcttaatccgacggcgacgaaagaaattgtgcaaaaaataattaatgaaaaatgggttgccaatgatttggtcatgatcgatccaagagggatcaatgatcggaatggaccggaagatgtgatcgaaagtcggagaattgaagatggaataagagcaaaaaataggagtgtaaatgaaaaagcaatgcgagaattcgtgatgacgaaaacatcgctcgatcatgcaaaagaaattaggacgagagcaatgaatgaagtgaaatatgctgaaaagccaactgatccgtcaaggcttttgagaggtgaaattcgtgcggcggaaatggacatttgcgaaaagcaaacgaaggcaattccgcctgaagggaagcgattggcgatcaaccaactcgaaactcccgaagaggaggccaaaagaaagcaattttgtgcgcgaaccccgccaccatttcaaaatctgatggcacagcagtgggctcaaaagagagaaaaagcggaaaatgaagtgataagcccagaaaagttggaaggaattttgcaaaaaatcgaagaaatgaaagggaagatgaatgtgatttgtgaagaagtgaaagcgttggtgaaccaatcgtccgtgagcagtgatggtgaacccggcacttcgaatttcaaccgctgggaagacaatcagtggcgcaatcgcggacacagagggcgatggtcggcaactcctcgttggcgcgggcgagcacgacaacaatttgggaacgattggaatagtcaaggaaatggattcggaacggatggctactcataaataatttggattcttatcgattaaaatgatatagaaattatattttacatattatatatttaattgtcaagtcgtaattaatttttgttgcattttttttaattttcaaaaacaaacaaaaaaataacaataacataactaaaacaaaattaaa

SEQ ID NO: 69468 - DNA, 456 bp, Heterodera glycines
  Genomic contig location: Contig_ID=SeqID_8869; Location=2637..3092; Strand=-
  SCN-specific regions: Sequence locations=1-72,95-104,126-254,276-456
atgtttcgcggtccgttcactctaattctctcgggggctaccgggagtggtaagacccgttggctattacggtttttaaaacatcataagaatctaattgaaccaccgcctaagaaaattctttattgttatggtgagatgaatgatagtattttaggattaatcggggagggtgttgagacttttaacgggattccagacatgaataagattaaagaacaggaaaaaccccttttactgatacttgacgatttaatgcttaacatgcagaacaattttcttgatttactctttaccaggggctcccataattggaacgtaagcgtaatttttgtaacccagagtctctatggtcgggacattaaaacggcaagagccaacgcacattatctggttttaatgcgcaacccttccggccaattacaagtgagaacattggggttgatttctatgtaa

SEQ ID NO: 69469 - DNA, 1459 bp, Heterodera glycines
  Genomic contig location: Contig_ID=SeqID_8870; Location=248..1706; Strand=-
  SCN-specific regions: Sequence locations=1-99,122-476,499-777,799 -959,982-1073,1101-1103,1125-1235,1274-1459
  Gene Ontology: Mol. function=protein domain specific binding; Biological process=protein kinase C activation
atgactgacaaaagtaaaagaaacacgcatttgctttttgctcgattcgcggaggaaactgggcgtttcggtgacatggctcagtcgatgaagcaggtgaaaggaaaacacaataaaagtgtgaaccccaatttcatttttgtttaaggtggtcgaattggacgccaaactgaacgaaagcgaacgcaaatcgttggccgtcgcgtacagaaaggcagtcgctggacaacgttatgcttggcgagccatcacatccatcttggaaaaagggaatgatgccaccgagagacagttggagatgaccaaagagttgctgaacaaaatagagcgcgacgtggaggaaaagtgccgagaaattgtggtcagtggttcagcagttttccagtgaattttcctccaaattaataattttcgttggttttcaggatttgttggaccgtcttctgctcaaagaggctgccaatgacgaagcaaaagtgttctacttgaaactgaaggccgaccacttccgctacttggctgagacccgagctgagaacgccggtaaaacgacgcatcgaaacggaaaaaggcattggttaaacggcaatttcttattccagatgttgtcgagaagtcaaagcaagcgtaccaagaagcatttgacatggcaaaggacaaactcagcccattgcacccgactcgtctcactgtggcgctgaactttgccattctcttattcgaagtgcagaacttgccagccgaagcttgccaactggccacacaggtggacgacggacatacattttaaatatcaatcgcttggaattttgcaggcttatgaagacgcttttaacgaaaaaaaggcgaaacccgaggcggcttgccctgattccgtcacgatcatggagctgttgcaggacaacctggagtattggggcgctgccgcggattagaagcaaattaaacgatccctatgtattgtatataattgttcccaatgtgatgttctgtctgtctgtacatattgctctattccataggcccatttgctgtccttcaattcactcatattttgtcgtgatttgtgtgtgtatatgtattatatatatatatatataaatggaaaataattaaacatttttcacctttcggtaaattttcgtttacaaattttttaagttccatttagaagaaacgactaaaagtgatagagtacttttgatcgcgtccagacatttgcggacaatttcgggaaaaatataaaaaatttataaaatttttttttttaaatgcaatgcaaaatttggactcatcacagaacgtttcttctaattttagatataaaaaaatattttgaagatatgcttaatcatgagcaaaatttactttcactatttcaaattaacaattcgtaaattagtccgttcggtttggtgctgtaacatttcgacagtggctgatttcgacagagaataaa

SEQ ID NO: 69470 - DNA, 711 bp, Heterodera glycines
  Genomic contig location: Contig_ID=SeqID_41313; Location=114..824; Strand=-
  SCN-specific regions: Sequence locations=1-53,83-217,247-383,413 -548,578-711
atagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaattttggtaagccaaaaaaatatccaaacatttaaaaatctataaaaaatttaaaaatgagaattcatgcgagattttctggaaataagcttaatagggcctaattaagctgtaaaaaaaaatttggggcgatttgaatgagaatagaaagagccaggttcgatgaagttttggtaagccaaaaaaaaatcc

SEQ ID NO: 69471 - DNA, 339 bp, Heterodera glycines
  misc_feature (314)..(314): n is a, c, g, or t
  Genomic contig location: Contig_ID=SeqID_41314; Location=68..406; Strand=-
  SCN-specific regions: Sequence locations=1-80,111-150,174-339
atgagcaaaaatacctcaacaatgttattattttctctattagcaaaccgaatatttcttgttacgagcggtgattagtgaaaattaataaaaataataattcatttaatctatttcaagcctaaaatgggaaaatattcattttctaaattaaatattaatctttcttttcagtcaatgatttgacagaagcaattggttccatgaaggagaaattgttcaccatttatcaaaaatatgacactgactttacgccaaatattccttcaattcttgaaacggaacgtcaagaattttttaacaaattaaacganattacaaacaagcagttccaaactg

SEQ ID NO: 69472 - DNA, 1121 bp, Heterodera glycines
  Genomic contig location: Contig_ID=SeqID_41315; Location=57..1177; Strand=-
  SCN-specific regions: Sequence locations=1-345,368-496,518-765,798 -1121
  Gene Ontology: Mol. function=extracellular matrix structural constituent conferring tensile strength activity; Cellular component= collagen type XI; Biological process=reproduction
atgaaggcccactccccatggattgggcaccaaggcgatattggagaggcaggcctgcgaggcccacccggtgaggatgccattggctatgcacgcggtgcaactgggccacaaggcgaacttggcacgccaggcccagtcggtgaagaaggcccgcccggggaacgtggggacgactcgccaccaggtgacgcgtcaaattaatatttttcgagaatttttaatgttaattttttaagggcaacctggtgaatcaggcccacaagggccgcctggcgagccgggcaaggacggttttcctggcgcatcagggccaatcggagcacagggtgagcaaattgataaaacagtagggaaacgaggagatgaaagtgtagacagataagaacaggacataatcccggacatgattagttatgtaaaaggcatttacatgataaaaacattaaccatgcccaaaaaaataataaatcgcaaaaatccctggctaattaaccttaaaaaatttccacaggaattcctctaaaatctgcttgcattttcaaggacatatcttgaatagaaaaacttactgtacaaaacacaagattcttgcgatcgagaaatctaaaattgttattatcaaaatttttaatcaggcgccgatgcagaatattgtccttgcccagaacgctctgatggtcaactgtacgagcagtcaaaacgcactcacgcagaaccatctgcagcagcagcggcaattggaactgatggaattggaggtagaattattttaaatcatatttttattttaattagtctaaaaaagatcattaagactaagcttcgattgatgtcaaatttataaaatttggttgactgtgaagaaaatttatggcttctaagattttttgaatttttcttaaatccttttcctatgtttttccattgaatttgcaaattttagcaaatcctcatgctgaattcgctgccaatgtccctgaagggtatgagggctattattcatatagcaaaatggcacatgcaaatacactccgaagacgccatctctgataaagcaagttatgacaaaatgtcttttcggatttgttgttcttattttaaaatggttagtaattaaa

SEQ ID NO: 69473 - DNA, 775 bp, Heterodera glycines
  Genomic contig location: Contig_ID=SeqID_41316; Location=97..871; Strand=+
  SCN-specific regions: Sequence locations=1-775
atgagcgctaaaattatcagagtgccgaaaatcgcatgtgatctaagcctagcaaaaaatggtgtaagtaaaaatcgtaattacgctcaaaaagcttctcaaacaattttagcgcatccaatttccttctacaatcgcctttatacatcccattatgagcgctaaaattatcagagtgccgaaaatcgcatgtgatctaagcttagcaaaaaatgatgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaactacgctcaaaaagcttctcaaacaattttagcttccaattccttctacaatcgcctttatacatcccattatgagcgctaa

SEQ ID NO: 69474 - DNA, 705 bp, Heterodera glycines
  Genomic contig location: Contig_ID=SeqID_41320; Location=89..793; Strand=+
  SCN-specific regions: Sequence locations=1-492,520-705
gaacggggaagtacggaagagcgcagcgctgttggtgaagaatggtgtgctacagggagacacgttgagtccgctgctcttctgcctctcagtggccgttgtttcgtcttcagtgagaaaactctttgactttgaagttctcataccgggacgaggtgtgatgcaacggcagaaccacctgttctatatggatgatttcaaagggttcgcaccgagtgaagagtccttaaaccggatgcttgtaactatggagcggaccgcctcagccgtagggttgaaggttaataagaggaaatgcgccttagtgagtacccgtgaagcggccggcgaggcgtcagggaatgagattccgaccctcggagcccacgacacttataagtatcttggagtcgaagagaggatagacatcgtttttgaggatgcgtgggaaagagtctgtgccaagatgaatgagcgagtgaggtccttgttacgatcggaaccgacatttggtgagcttagaaaagccatcagggtgacggtgaccccagtagcgaggtatctattcctcaatgtaatcgctggcgggcctagctggggaagcgtcctagcaaatgcccaagattttgacacgcgtgtccgtggcctcctacgggaaagagtgagtgatgagcctggatggcggtttaagcattgtaacgctgatcgcctgtacctccggccaca

SEQ ID NO: 69475 - DNA, 407 bp, Heterodera glycines
  Genomic contig location: Contig_ID=SeqID_41321; Location=259..665; Strand=-
  SCN-specific regions: Sequence locations=1-407
tttgtgggttctcgttatcgatcgcagccaacgacgaccgagggacaattagcgaagggaacgacgccgccaattccccaaacgtcacaacagcagcaaatacagcaggtggagggggtgaggaaagacaagaatggaacgaagtgggcaatgcttaaattcgtttcccacccttttagccaatgaccatcagcaaaccgaaccagcatcacaacgccaacaccggtggacaccgtgccaacgccagcttgtcgccggcgctgggatcctccggtttcggctcgtccgcctccagcaacgcttccgcccaggtcgagcgcgacctgatcgacctcttcgacgagaagtgttcgattgggccgccgctcaaatggacgccttcccctcctccgcttcaacagcaccag

SEQ ID NO: 69476 - DNA, 312 bp, Heterodera glycines
  Genomic contig location: Contig_ID=SeqID_41321; Location=1307..1618; Strand=-
  SCN-specific regions: Sequence locations=1-236,259-263,304-312
catgaagaacccccgattgagctcccgcacgagagcaaaacgaccttcaaaatcccccgtatgttttctctcttattttccttttctcccaatcgatcgaaattcgagtttaaataatcccacatttaccggagcgcaaaactgtgccgtttgaaattaatttgtaatcggaatgctaacaaaaagtattttactaatgttgtttttaatggtatccgttatccattcctgtaagcatacatatgtatatgtatttgtttttaaatttaatttaattttttattttaatttattttcgtttaactgtaaatt

SEQ ID NO: 69477 - DNA, 899 bp, Heterodera glycines
  Genomic contig location: Contig_ID=SeqID_1183; Location=1715..2613; Strand=-
  SCN-specific regions: Sequence locations=1-39,63-281,303-688,711 -866,888-899
atgggtacgccccactgtgcagagaaaagcctagtactatctcgtcgtttctctttttctttgtaatttatctctgtttggcgtactatctctttattttttaattgaaaaaacagaattcaatctgatgctaatatcttttcttcaatgctaccaatcagggatgtgccgaatcggaatcgtaatcgtaatcggaatcgcaattaatcggattttgggccataatcggaatcggataatcgtaatcggattttgccttgaaatccgattattacacccctaagaattgacctttgaaggaatttttttagcgagaataccaatgaattttgaaaaaaatgttttctgaaacgaatcttttaatcttattttaacataatgactgaaattaaatttttctcacaaagcagtgccggattaattctccccgatataatcaagttttttgttatttagcaaaaatgtcaaagtctttgaagggttgttaatggtgtcagtttaagaacatggcagccaattcacctatttttgaatcccggacccgaattcgaaccaaaagtcgaaatttgaagaaaaaatttgttgggacattaaagcagaaaagaaccatgaatgaattattactaagttgcaattttcctatcaggtgcgttggtcatccaccttccaaatgcttgatcgttttttgcaaaacaaaacagttgttgggcttctgtatgcagaagacatttcgtttccgaatctaagctatcaaaaaaatatttctcagccccagctacattgactgaaagcgaacggcttttctccaccgctgggttgattgtgacagatctgagaaaacgtttattgcctcagaatgtggacaaacttttatttttatgattttgattatgaataaa

SEQ ID NO: 69478 - DNA, 73 bp, Heterodera glycines; identical to SEQ ID NO: 56843
  Genomic contig location: Contig_ID=SeqID_1183; Location=1545..1617; Strand=+
  SCN-specific regions: Sequence locations=1-73

SEQ ID NO: 69479 - DNA, 135 bp, Heterodera glycines
  Genomic contig location: Contig_ID=SeqID_1186; Location=330..464; Strand=-
  SCN-specific regions: Sequence locations=1-135
atgctttatttaactatggcaccgaatttgccgtgccaaaacggttttcctcctcgtccaagtccaactcctcctccagctcggcatcctccgtctgcttctgttgtgccgttttgcgcaggaaatggtgaccat

SEQ ID NO: 69480 - DNA, 213 bp, Heterodera glycines
  Genomic contig location: Contig_ID=SeqID_1186; Location=1188..1400; Strand=+
  SCN-specific regions: Sequence locations=1-62,113-191
atgattagtccaatcactatcaatggcattccaacaccgtggcaactgctcgcgttcttggctaattatgtaaattaaaattgttaataagtaaatatttaaaatttaaattctaggtccttgaaaatgggtgtatccttcaaaaaccgggttcaaatttcaacactggaactcttaacctttcggcttgctattaaatatatttaattttaa

SEQ ID NO: 69481 - DNA, 1466 bp, Heterodera glycines
  misc_feature (308)..(308): n is a, c, g, or t
  misc_feature (324)..(324): n is a, c, g, or t
  Genomic contig location: Contig_ID=SeqID_1186; Location=1452..2917; Strand=-
  SCN-specific regions: Sequence locations=1-153,175-212,234-277,301 -885,915-1036,1186-1466
atggtcttcgtcaaatgcttgcttttcccgtccattttcgccgttcttttgcggttgtgcatcatcagcgttttgcttgaacacgggcacggttacggtcaattcggtggtggtcgaccaggtcaattcaacaccggtaatgaccatttacaaacatttattaaaaaattgctttcaaccggaaacatggccacggtaattaccgtataataaaaatgggttaattaaaaattgctttcaactggaacctaaagctttgcttttcgtaagattatccaaataattttatttaaaaaaaaagaaaaagncatttttatataaggnacattgattgtcgctggtcaaacgcaaattttacgaataacatatagaaaaaaagagagaaacaatgtccttgaaaaattaagtacgcaaaattgctcaaaaaaaccatgctgcctttttccagtatctttccagtacacacacacatttcagtattcccgtaagcactgcactccctcccatttaatgcgttgtttttttaatcattttttttcacttttcatgttagctgctgcattgaagtgcaaggacgccctgaacacggagatattcacagctagtcttgatgaaaaaaaaatcaaaacaatgtgttccaaagccacgcattgtatggcaatgttttgttcatccgctgaaagtgattgaatttatctgacgaaaaatccacccaaaaattcgactaaaaaagtcaccaaaatcccaaaaatagaaaaacaaaaaaatcatggtagaagatacaaaaaatatagaaacaatttttttaaagtctttttaaggcgatttcgagtcagaatcccagccctagtgaatatgggaagggatttttagctgtttttgaagtttgttaagaaaattgcttttaaaattttcaaaccccccccccccgggcgctatgggcctgttttcaagcacttttcatcgaaacaagcggcaaaaaaataattaagtcagtgacctaaatattattgttagaacgttcattttggcttgcattatttacttaaaaaaaattaaaattttgtgaacaaaattatcaaaatttaatatatttttaaaattttaattgactattaaattaaagaaaaaatttattcagaagtttttttaaaaaatttaaaaattttaattattttttttttacattttcagatggatttttcttgaacatgtgggcttgttccccttttggtccagaaaacaaagcaaaatgtgaaaaggaaggtcctgacggtgccaatcaaattcgtgccgatgttgaagctacaaccaaaatgcgtgccccgaccgccaccgattggaaatgcacgtgccattttggggccaaggacaagagcatggacaatgaacagtttgtggcaccggcaccgccggtggtgaagcaaaagaaaggtacagacagaatgccaaagctgaaactatga

SEQ ID NO: 69482 - DNA, 2335 bp, Heterodera glycines
  Genomic contig location: Contig_ID=SeqID_8872; Location=154..2488; Strand=-
  SCN-specific regions: Sequence locations=1-11,33-467,490-1265,1288 -1662,1685-2223,2245-2335
atgtgtttgcgatgtgcaggtgttttgtgcatttctgctgctcctttttcagtgttttgagtttagaaaacggtgcgaatgttgcgggaacagagggcgacgatggttcagacggaggcccaataccgtttcatttactatgtgatctcggcatttatgaaggcatatcgcgacaattctctgacgtcgtctgttttttcaacaaattttatttgtttcgaaattctttttgctgttcagatggacttaactgcaacacaacgatgagcttaaataggcatccactgactgaccgctgtgaatcgctcttcaagacattccccagtgatcagattgttcctttaaaatcggtgacaaatacccaatccatggcgctactaatatttttgaaaattgatcaattgagcatttcggctttcctccgtttttagtatcgccgtgatctccatttgtaaattcccaaaaacataatagtaaaaagattagtgtttgatgatctgtccattctcgccatttgtttcggtttttgcaatattattttttccttcaaattggtgccatttttgtctaattatctctaagctgtccgttcgttcgttctctttggcccattgaaagtgtctgcgatgtccggtccgttttcttctcatttttctttttccaatttgattttttagccgcctttgaacgtttctttgtcgcgtgtgatattcctgccacaatggtgcccaaatatgcgagtcgattcgtcaaggaacgcattcatcccgcactgatgaaagacctcggtgcgagggggggatgctcaatgagacgccttgcaattagtgtcttaactttttgtttgcatcctttaaggcaaagacgatttgcgtgagttgggcgtcacagcgttgggtgaccaagtgggccaactaatcagagacaatcggaatttgggttatacttaagttggcgataatgcgctacataaagcaatgcgaagggaatccgccggagtttaattcggtcgaacaatcaaagcgaaagtcggagtcgcgcggaagggaaactgccgattttgaaagtgacgaaggtggacgaacgaactcaaaaaaaggcgaaaggacacacatcttcagatgaaccgatgctggtcgactcaaactcatcgagcagtttcaaggcccccgaccgagaagacatttaccacataaaaatgccaattggaacattgccgaaaacgcgtaaaattttggaaaagaatcgctctcttcgcgacagaggtgcgttgtttttactggaggatttgtctctgaattcgtccccaattatggcagcttatttgtaggtgtgcttaagcgtggcgtttctggggttcgacggtccggcattgaactgaacaaacctctgaacacaatttcgactcggtccaaagtcatcggtcggaaggcaatcacgcttcaagtcagaacattttgtgatggactttgttccaatgtttttaaaggacaccgacatcacttcctcgacggcatttgtccctttggggtcaatgcgaagcgattcgatctctacgaaaacgaccgttgtggccgacaacactggcaactcgagaccgtgggttttgttaatccaattgcgcaattcgtttgttttagtgtgagtttggcaaatcgttttgcctctctctccggtgctgcgccaaacattcgctttcaattggggaaagtcgtcagtccctccgtacaactcatcccatcgcgtcgccccctcgtccgatacagcagtgacattgacgacttctccacaaccgccgagccattcagcgaacttacaacagaaatggtcagaaaagtgcgcaagaataacagcgtaacatttcaaccgccggcgttccgtgctccaatcaccgaacgtattcaaattgttggacgaagccgaagaagtcgtccggtgatcagcacaacgcggggcataaaaatggtggcagttggaggcaattccgggcgattgggacaaccgacgctgggaaaaaggacttcaattttggatcggatcactgtgaccaaataaacaaacggtggtgagtttggaggtgccgctgattcgttgggttgtattaacttttgcgataaatttgtttgtatccttcgcattgtttgcatttccttccattccctccctttcgatttgtttacattcaaaattattggatgatgctttcttctttttacaataatatttttgtgtgttttttccaatacgcataaactatcggtacaattttattaagttggtttggtccctccgctgttgtttggccatcattttacttttactctttcggaataaa

SEQ ID NO: 69483 - DNA, 416 bp, Heterodera glycines
  Genomic contig location: Contig_ID=SeqID_41322; Location=1..416; Strand=+
  SCN-specific regions: Sequence locations=1-416
taaatctgggcgcatcggttcggggggactgaccgccataagagaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattat

SEQ ID NO: 69484 - DNA, 385 bp, Heterodera glycines
  Genomic contig location: Contig_ID=SeqID_41326; Location=1..385; Strand=-
  SCN-specific regions: Sequence locations=1-385
cggtgcaccccaaaacgtcgtcggccgaaacgtcgtcggaagactttttggaccataaatttgttcactgtcaatcaaattaagaattgttggtgttgttcgatagctctatgtgtttattattaatttgcaaaatctcaaaaattttggttaagtttcaaaaaagttatgtccagaaggaactcaaaaacccagtaattcgaactttttttgctctgatttttttgtgcataaataacaatttttgaaaatttgcaggctaatagcatttttcgaatgctttcgaataataccaagaatgtttaatttggttgagaaagataaaagttatggtcgaaaaattcgtacgacgacgtttcggctgacgacgttttgtcctactccg

SEQ ID NO: 69485 - DNA, 149 bp, Heterodera glycines
  Genomic contig location: Contig_ID=SeqID_41326; Location=426..574; Strand=+
  SCN-specific regions: Sequence locations=1-45,67-149
ttataaacagggtttcactgaaaattagccaatttatatgtaaagttttgaaaaattttatgggaatttaatccaattcttaggggtgtaaaagtcgcgtttcgcgccaaaaagcgaaatgcgaaacgccaaaaaatgcgaaaagcgaa

SEQ ID NO: 69486 - DNA, 497 bp, Heterodera glycines
  Genomic contig location: Contig_ID=SeqID_41328; Location=1..497; Strand=-
  SCN-specific regions: Sequence locations=1-192,216-358,380-497
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccacgcagaattaaagtacaggctatagggaagctattcccgaaggattcggtctccccataaatctgggcgcatcggttcggggggactgccccgaaaacaaaaaattcgatttt

SEQ ID NO: 69487 - DNA, 2513 bp, Heterodera glycines
  Genomic contig location: Contig_ID=SeqID_8874; Location=643..3155; Strand=+
  SCN-specific regions: Sequence locations=1-227,249-813,835-921,944 -1123,1145-1683,1705-1936,1958-2052,2074-2156,2182-2403,2425-2513
atggcaaagacgacgcaagcccatttggccaagaaaagtgagttttttcaacaatttttactcaaaatcattttttaaaatttcagccgctccacagccgaatcccaatgccgaaacgccacagcaagacgaagtagggccgtcaacatctgctgcaccggccgaagaagcgatggagccgccgccaccaactccaggaccagtgccaacgccagaaatggacgaggaaattttggaatttggcttttcgctgccatcggcatctgtcacaccaatcggcgatttggtgccgttttcgacaacaccaactgcgccaatggacaccggagagacgaccccgccaccgctggccattgacgagcgatcagagcgcatcgaacaactggagaagcagctcaaggaccgggacgacaccatcaaatttctccacgagcaggtgcgcaatcgagaagcgctgatcagtgatctccgtcggcagctggatcaacacatggcaccaccgatggcaccaccaacgaccagcaaaagtgagtgaaatttttccttttttaatttcataaaatctgatcattttttcaattttagcaccaccaaacagaggaagaccgaagaaaagactggaagaactgcagcgcagcgccaggcgcggcatcgtcgaccaaattgtgggcgtcatcgatcgtgatcgctcgcgttccgcgagccacgcatcgctggatcggatccatcgggatatccggcacaaattcgcgcactacacgccaaagaagggccaggagcggaaggagtggatggaagctgaggatgggctcctgctgcttgcccagcttgggacacagatggcttacaaacggatgaaggcgactctgaggctgatcaacaggcgctttgacactttcccaccattgataaaggtacagtttttcagaattttttcatccgaccaatttttttttgggtgatcaaaatcaaacgaagaatttgctcagctttaaaatatgatgtcatttcaacgccaggcgggcctggatatgtttgctctgacattgccggggcactgcgtttcagattgtccacggcaaaggacaatctgatcagcctgatccctgcccatggtctgccactgaaggtcagtggcgatcacgggcagggattcacaaaaattaccatttcattggcccatgcattgcgcccaaattccccttccaacaattttgttgcggctgtttttcccgcaaaagattcacgaacgaatttgaagaatttctgcggatcgttgtgggaacaaattgagcatctcaatgaaattgacgggcgcgaagtgaaatggtgaaaataaattttgttttttgattttttgaaaattttccaggtttcttggcggtgatctgtgttttctgtgggccatcattggccattgcggttcggcaatgacagcattcccatccccagtgtgtaactgccgaagagaccatctgatcagttcagcaaaatgccaaattcgaactgtgcaagaattggagagacaagccgatcagttccagcagctgacccatggaggagacaaagcaacggcagaggctcgggctctgacgaaaggcattgtttgtgcatctctgctgccgtcgatcagttttgagcagatgctgttggccccattccacgtcttccaaggcctcggaaatgctctgatcaaggagttggaagcgggagaaaatgccgaaattgctcagcaattcttcagacgaataggggcaagaagggaagcgttcagaaagcgcgacttgacggggaacagcatccgcaaaatcctcgtccatgccgatcaaatggaggcccttttcgaaacggaatgggccaaaacaatttgcaaaacaatggcacatttggggaaaatccaaattttcaccaaagtaattggttttcatttttgtggaaataattttttttaatttaaggcccagccattgtctccaggtgatttggatggactggagacggcagtttaccagttcaaggcatttctcgacgaacaaccaatggtgcgaacgcttctttcaaaaaagacaaaagcccatttgctgcttcaccactttgttccgtttgcgcgccaacacggatttttgggccttttggatgagcagggtgggaccatatcatttttgggggttcaattttaaaagttgtgattttttaggagatgaggcactgcattccgtgtggcggcgacttgagcaactttggaagacgatgccggactctgaacaaatgcgacaacagctggagcatcatttcgtctcgaattggctgctggacaccggcagactcgacgaattgaagctggtgagttgatggaaggggatttaaaattttaatccaactaattaagcgggaggaggaacaacgggagcaagcggaggaagacaaaacgaatgaagaaagtgatcaagatgccgacgtcgatatcgttgactgatcgaggattgatggttatttttcattacacatgacaa

SEQ ID NO: 69488 - DNA, 716 bp, Heterodera glycines
  Genomic contig location: Contig_ID=SeqID_41332; Location=624..1339; Strand=-
  SCN-specific regions: Sequence locations=1-274,310-445,513-584,660 -667,695-716
atgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaaatccctctaagaagtttgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagt

SEQ ID NO: 69489 - DNA, 121 bp, Heterodera glycines
  Genomic contig location: Contig_ID=SeqID_41332; Location=1364..1484; Strand=+
  SCN-specific regions: Sequence locations=1-121
atgcttttggggtgcttccatacgttggagctgtggtataccgctcagtgctgcacgtgtgaaagcctgtgtatggctgctgcgtggcaatgtgtcggtggcgggccgcctcgcttggctg

SEQ ID NO: 69490 - DNA, 696 bp, Heterodera glycines
  Genomic contig location: Contig_ID=SeqID_41336; Location=429..1124; Strand=-
  SCN-specific regions: Sequence locations=1-197,235-419,464-469,491-696
atgccaacttctaaccatgggaagtatgaaatgggtcaacagtccgtcctccgatgccataacccacaacaaaaagtgttgaacaccgaagtgatgacgaatgtgcagcaaatcgagcgaagaacaaagcaaacggtgctgagacgaagccgggaaggcaaacaaaggcaggggacccttcggaggagcacagggccttaaattaaaaatttttgaattaaaaaaaataaatttccaacccaatcccatcaaaggggaaaagtgtggcgtaaagttggccattcgaatccaacgcgagaagagagccgagcactgtccgattgccatccaccgattgagggggtccaaagtcaaaagaaactgaaaaatgaattaattaatttgaggtaaaaatttactaaaaatcgcaaaaaaaaaattcatgaaatttcttttgaaaatttttaaaaaatttcagggggctctaattgagagaaatctgggaatatggcaaattatttgatcagaaatgtacctagttgagtgatgaaaccaagcgtagaatgggcacgtcctcgtccaaattcgtctccactcgcctcactgtcgtcaggcgttcggtctggcaacaacgcattgaaatcaaattgaatcaacggactgtcgaccgccgatgacacgtcgtaaagcctttaagacggaggatcgtttaataaa

SEQ ID NO: 69491 - DNA, 678 bp, Heterodera glycines
  Genomic contig location: Contig_ID=SeqID_41337; Location=382..1059; Strand=-
  SCN-specific regions: Sequence locations=1-250,272-366,388-678
caaccgcatcaccactccgtcgttgtaccaacacatgctcaacacgtacagccacaccatccgacgccgttggccgtgccccaaccgatgcgtccgtcgccgccgcccctttcaatgcccggcactggcgccgcaaagcaccactaccagtgcaccaaagtgcgggcacacaacacatttggactcaaatgccgtttccgacccgacggactcgcggtggccaccacatcagctgaccaaaccgccaaactgtggagttgcagcagcaacacgcacaagctggtcggtgcatttggacgaatttagaaacttcgtaaattataaaattatttcgggatcagctcgccccccccccctcaaattctcgcgggaaaacggggcggggggtgggagacgtagtacaaccaattatttttgtgtgaggagtaattaattaattgttcaccgtgccctgagttgtcgtcggattgatcaattttcgttgtttgttttcagttgaacacttactcagtgccgggcaacaaatgggtttgggactgcgcatttaccaacgattcaagcgtaatattttcttgatggattcatgaaatatgtatgtaaaatttgtttttccagcatatggtgaccgcttcgtctgatggcattctccgaatgtgggagttgaacgcgtgcaaagtg

SEQ ID NO: 69492 - DNA, 530 bp, Heterodera glycines
  Genomic contig location: Contig_ID=SeqID_41340; Location=383..912; Strand=-
  SCN-specific regions: Sequence locations=1-119,142-447,471-530
gttaagttagtcctgtaccgggggagtatgcctataaaatttggtacgattttattgcttattgaaagagctagaaccgaagaaaatttttttaatgtaagcctaaactttttggcatgtttaaaaagcaattaaaaattttattcatctttctttttgatagaaaaagcatcagagtgcctaaactagcatgtaaataaaatttggtgcgtttcagagcagtttctgtaaaaatacttatgaattaattttgtaaaaaaataaataaacagttaaaaactcagaatttctaaaaaatttaaaatcaattacaattgtcattttttcaggttaagttagtcctgtaccggggagtatgcctataaaatttggtacgattttattgcttattgaaagagctagagccgaagaaaatttttttaatttaagcctaaactttttggcatgtttaaaaagcaaattaaaaattttattcatctccctttttgatagtaaaagcatcagagtgcctaaactagcatgtaaataaa

SEQ ID NO: 69493 - DNA, 680 bp, Heterodera glycines
  Genomic contig location: Contig_ID=SeqID_8876; Location=1368..2047; Strand=+
  SCN-specific regions: Sequence locations=1-67,89-403,474-680
atgcattctggccaacttcaaatcccggataatacggtcaaaaaggtaaacaaaccacttttgaatgcaataaaatgaaagcataaattggacagtgttaaaattgtcccaattttcttcatcccattgaatggccgccgtctccccaatttggcatcggttgatcatccatcggcggtggtcacatttatattcgtttgctttggtcagtaacagcttttcaattggtccgttcattcaccaattcaaatggcaccattgacattggcaccgcatgaacagtaaataagaaatgttctgatttggagggttcaaatcttacaaaaataaaaaatgtttttatagaattatcatccgttgaaacgaagctatcatcgtgtatttacgggctttaaacggtctcaatttttattttaaaaatttagaaaacccccaaaaatttaaaaattgaaattttttttttattttaaaaacagaaaaaccaaaaaaaaagatttgtatttgcattttatgaatgttatggcataatgttcattttttggcaaatgaaatattaaattttcagaacgcatttttttcagtttcacgccaatcaaatcaaaactttctcgccttcgatatctttagagaacataattttaatatttaatcatttcctaattacttttatattaatacaa

SEQ ID NO: 69494 - DNA, 601 bp, Heterodera glycines
  Genomic contig location: Contig_ID=SeqID_8876; Location=2122..2722; Strand=+
  SCN-specific regions: Sequence locations=1-601
atgaatcgacgtttaaggaaaatgtgagaatttttaaatgattgtttttttcggcacttttacagtttaatgagcccctacgaaaaaaatcacagggatggaggggggattttggggtaaaatcattggtaaaaaaccaactcatagtgtgaaaaaacagaaatttacctcaaatctcagtacgagtttgcggtttccggcttttgatttgtaattttttcaaaattacctactccctacttttgtttttcattgggcccttaaactataaaaaagtgccaattttctctttttaagtaattttttacgtttgcatttcagttggatttgtggcgacgtttggatggacattctcccatcttttgaacgtgctgaacttggcctcaaaattgcattgctttcttaccgttacgatgctttggtggacaaacattttgacggaaaaaaagaattgacaatttggagaacaatcgaaatttgcgagggcattggaccagaaccgaaactgtctgtacagatcgatgacaaatttgtggcatttccgttgccggagcgtccgctgccaaacaaaatccgctttaattttctctggattaagtaa

SEQ ID NO: 69495 - DNA, 480 bp, Heterodera glycines
  Genomic contig location: Contig_ID=SeqID_8877; Location=530..1009; Strand=+
  SCN-specific regions: Sequence locations=1-10,38-220,243-480
atgtcacgttatgatggtggtggtggtgatttgctgttgaagcgatgcccaattagtgaaaaagcgtcggcggatcaatgggaaaacgaccaaaatttggacgccaatttgaactttgtccaatttaatttgtgtgctggcaaaagttcgactgggtaagcgtaaaaagataattcacagttcacacctaattcaaattgtgtttaatttcaggccttatggccaccagcggacgaagaagaaaaagcgggtcaaagcatcgaaatatcgtcggattgcgcggaagacgaattaattacatttgagaaatggccgatctcacacaattggaatttgattttatgccatcattttctctcggaaatgcttttgtgattctttctttaatacatttatttgctactttttttggtgtgcaattttctttagtatcaatgaaacgattgaccatttgtgaaatactttttacttggttaagaa

SEQ ID NO: 69496 - DNA, 824 bp, Heterodera glycines
  Genomic contig location: Contig_ID=SeqID_41346; Location=230..1053; Strand=-
  SCN-specific regions: Sequence locations=1-9,52-134,161-292,314-824
agtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttt

SEQ ID NO: 69497 - DNA, 404 bp, Heterodera glycines
  Genomic contig location: Contig_ID=SeqID_41349; Location=247..650; Strand=-
  SCN-specific regions: Sequence locations=1-315,337-404
atgctcgctgagaactgtctgcgaacagttcaagtcagtcgcacttcagtgccaaagggttgcgtcgagataattaaaaagtgcttgggaccgacggatcatttgcgaattgcgatgagactaatgggcgcttttcgtctttccaaatgggacattattgtttaaatgcgaaatcatttcagaggcaatacgtgaaacttggtagtaatttggccaaaatccgagacaatgagcaagtgttggccattacgccgtgggaaagtgcaacagatgcttcggactcagcagagatcacggcaccggcaaatgccgacgaacacccacaaagttggcatggaggaaggcactttgtcgaagtccaaacgacaaaaagttgtacattaaatgccgaagacggacgctag

SEQ ID NO: 69498 - DNA, 855 bp, Heterodera glycines
  misc_feature (22)..(22): n is a, c, g, or t
  misc_feature (89)..(89): n is a, c, g, or t
  misc_feature (213)..(213): n is a, c, g, or t
  Genomic contig location: Contig_ID=SeqID_41350; Location=1..855; Strand=+
  SCN-specific regions: Sequence locations=1-360,385-855
catgagtccacccttggccacnccgtcttcgaaacggcttttggcggtcggttgaccaatcggacatttcttggccaacccaatcatcnacattaagccaaaattgccgtgaacatttgctacgggcgccaccatccgcaaaattgagatgatgtacgcgttgaatggtgtgcttctgctgatgctaccaaatgcacttggttcttctccccnccactgtttgaggtgccgacatcattttcaacccttccgccactgtcagcggactcagcgaagcactttggcccatcgaagcgcgcaacgcggccatcgccaaccacgtgtttacagtgggtgaaatgccatttggaaatggcatttcttttgttggcattttgctcaggtggccatcaatcgcgtgggcaccgaatcgtttccgaatgaattcacttcgggcaacggaagagccggtgggtgggaggacattttggcaatttttgagagaatggccccattgattggttaagcccacaaggaatttggccatttctacggcagcagttacgtgacagcgccggacggaagtcggacgccggtgaaaattggacgaatttggggaggcaaaagtaattttcctccaaaagggcctctcgaggacgcgcgacggcgtactaattgtggaattggacttgaatttgtgcagacaaacgaaggactcttggggatttagggtcaaaactatcgataacattccaagtaaatccaatcttttgttgctgaaaatctcttcagatgactcaacggttggaaatgtacgcccaaagtctaagcgcagccgcagcaagtgaatatcggccgaatgtggtcaaggagaag

SEQ ID NO: 69499 - DNA, 689 bp, Heterodera glycines
  Genomic contig location: Contig_ID=SeqID_41351; Location=98..786; Strand=-
  SCN-specific regions: Sequence locations=1-97,128-186,397-588,615-689
atgatttgcggtaattgcattgccttagccgtttatcagccttatcctgcgcaagattcggacatgaaaaacaccgttttggtcggttaaaaatgacaaaaaaaataaaaataaataaatatttttaggaaaatttggagaatcttttcattgttgtattcacagcagaggtaaaagaaaacagagaaaaaatgaaataaatctattttaaaaaggaataattttaatttaaaaaaataattatctcaaaatttttattttattttttcgcatttaaattgaattttaaaatatatttaaataaatattcgtttaaaattataattaactgcgtttattaaatgtaaaaattaattaaatttatattaaataaatttttaacaaataaaaaatattgaaaatccaatcgtcacatttgaaaacaattaatcaattcaacaccaataattaaattggattatcattcaattcccttttctgatcagtgtgtgatcaaagtgatcgcgctcggttttctgtgccatccgggtgcctatctgcgaaacgcgtggaatatcctcgactttatcattgttgttatcgggtgggaattaattttttttaattttaaatttcaatttcaaagaattttaaatcattttcagtctgatcagcacagtgctttcccggatcaacatccaggcatttga

SEQ ID NO: 69500 - DNA, 1831 bp, Heterodera glycines
  Genomic contig location: Contig_ID=SeqID_8878; Location=2819..4649; Strand=-
  SCN-specific regions: Sequence locations=1-569,591-1472,1500-1831
caaacagaaggtgcacacaaagtgcacaagctgtgcatggagttcggatggctttttctatgcagtcggcttctttgacggcacagtgtctgtccggtcggcatcaggcccaacagtaggccaaaagcaaattttgcccaaataaatttgcaaaaattgtgtttaatagcccattggtgaggagacggcacgcctggaaaggccgggaggtgaacccgtatgggcactgcagtttgcacaaattgcttccaagtgggatgaacgacaaaatcaaaaaaaaaaaaaagttgaacgaaaactcagcaatcagatcagtggtgaaatgctggtggtggcggattgggcccaatccattggattcttggcccattcacagggccatttggttcgtgggttgtttttgagattttttggcactctgccaactctgagcccattaccggggaaccaatgatgctcgagaattatttctttttccgcgggattgaaaattcgtaagcccccgaacttcttttggactctaaactgactgatcagtgatcactcctgctgattaccattccaaggtcattttatttaaccattatttattgttgcagtcccatcgaagtgacaaacaattggactacgacccgactgcagtgcatttgttcaacaacggatgcttcttcctcaccattggatcaaatcgaatgttaaatttgcacaccgtcgggggtaaacaaaaacaaattgttctcgtcctggaaatcttatgcttaaaaaatccaccggtgattttcattgggtcgagatttgaaaacaaaatttctcgagcatgggtcactaaaaaaatggctctgttttcgagaattttgtttgtggaaattggtttcccaactttgcctataagtatggcactttttttacaggcattgacttgggtgccatggcacagttggatgcttggccatggagcatggtgttgttcaagcaacaatttttggttggtaagtgtggagtagtggccaatgatgggttagacagtaatgcaaaatttgaagttggttgtattgatgggtcgttggtttgctaccagctgatgatgaacacgatacatgcactgcacaaaagtcaggaaataacttttgttctttgaaatggcgagtggcaaaatgcagacaaaaaaacctagcctgaagcgagtgcacgagggatatgtgccgattccctcaaaaaaaattcggaaaccggaattccgaagcccaaaaatgtcgtcaatcggaaatcggcatgccgacacatccctggagtgcagcaccacatccccctccaaaaggaacattttcaatcttttaatttcccagtttttccccagtaaaaaaaaactaaaaaattgtaaatttcttttttgagaaacttggatttttttgttaaatttctctgttgaaatacatttcatctgtttgccctccccttccccaaaaaatgtcaattttaaaaaatatatttttaaaaaagtcaaataactgatccaagattattacgcgttccgcgagaaccagacggatgtggttgtgcagcagttggagcaacaaaagtccacgcgcatccgttgccaagatcttgtgcgaaaggtggccatctacaacaatcggctggcaattcaactcactgatcgggtgctgatctatcgccagtcggctggcgaaagggagggcgaacagttggagtacaagctgatggatcggatcagtcaaaattttgagtgctctctgctggtgatcaccagtcagcatttgatcctgtgccagaacaggcgcttgacatgttacgacctgaagggcattaa

SEQ ID NO: 69501 - DNA, 206 bp, Heterodera glycines
  Genomic contig location: Contig_ID=SeqID_41355; Location=1..206; Strand=+
  SCN-specific regions: Sequence locations=1-206
catggtcattcatttgactttgctcagctgaaccaaatgatgcatcacttcgattgaataggtctcaggtcacccatagattgtcacatttttgttggttttgtttgtttttatctcctcaagttcatccaatttctaagaattcagtcctaagttaattgtaatactaaataagccaaactaagcctaagcgagttatctaatta

SEQ ID NO: 69502 - DNA, 384 bp, Heterodera glycines
  misc_feature (338)..(338): n is a, c, g, or t
  Genomic contig location: Contig_ID=SeqID_41355; Location=1209..1592; Strand=+
  SCN-specific regions: Sequence locations=1-246,280-384
atgtccgaggaagttgacagacacatcgtggagcgttacgaaattcaaaagagactcgggaagggtgaggagtaatggacgttttttgtgggtggtgaattggtccctttcaggagcgtatggcattgtttggaaggcgattgaccgaaaaacgaacgatacaattgctctgaagaaaatcttcgacgctttccgaaatgctacggacgcacaacgtacatttaggtgaacagaaggcgcggaaggacagccattaaataaataaatggaacatgaaaatggaattaactaactacggttttcagagaaataatgtttctgcaggagttccggacggnacccaaacatcatcaaactgttcaacattctcagagcggacaatga

SEQ ID NO: 69503 - DNA, 253 bp, Heterodera glycines
  Genomic contig location: Contig_ID=SeqID_41356; Location=400..652; Strand=-
  SCN-specific regions: Sequence locations=1-107,134-174,213-253
atggagaaggcctgcaaaatttggagagattatatcgattttagtgcgctaggttcgatgaaactttttaaaatataagcctaaactttttggcctgtttaaaaaggaattaaaaatttttaaaatttttattcatctcccttttgatagaaaaagcatcagagagccttatttaacttttaattaacattttgtgtgtttcagagcagtttctgaaaaaatatttatgaattgattttgctaaaaaaataaa

SEQ ID NO: 69504 - DNA, 85 bp, Heterodera glycines
  Genomic contig location: Contig_ID=SeqID_41356; Location=124..208; Strand=+
  SCN-specific regions: Sequence locations=1-85
aaactgctctgaaacgcaccaaattttatttgcaagttattttaggcactcagatgctttcactatcaaaaagggagatgaataa

SEQ ID NO: 69505 - DNA, 357 bp, Heterodera glycines
  Genomic contig location: Contig_ID=SeqID_41358; Location=211..567; Strand=-
  SCN-specific regions: Sequence locations=1-75,100-205,296-357
atgcgtttgaacaatcgaaatagacagtttatagaagaaacgcgaatttcagtgaaagaaaattattgcattttggcaaattttgttttgaatttattggaaaaggccaatgtagtggaatatttgcaaaaaaatgatgaaaatattgagtatttttttattcggtattcgactgattgtgcacagaggaacggtgagagatttgaaaaaaataatacaaaatttaaaaaacttgctttatttttcattatctatttaatttaaaaaataaaagttaatatttaaaataaaatttcaaaaacttgagatcttccgacccgaacatttgacgaaaatatagtcggaagacaaatttaa

SEQ ID NO: 69506 - DNA, 716 bp, Heterodera glycines
  Genomic contig location: Contig_ID=SeqID_8879; Location=33..748; Strand=+
  SCN-specific regions: Sequence locations=1-260,285-716
cagtcgccaacactttggtgcccgactttcacaaattggcctttgcgctgctcagcggactgcccaacgaagtttctttcggtcttaacattctcaccgttctctcccaccccggttagttcattttcatttggacatttcactttcttttttcatttaaggcccttttgtgttgaatttcgccaattgtccccagcttatcgctcttttggtcgccctttgcggcgtttgcgttaacgttgaaggttggctgtggtttctttgggtttttcctttttcccttattaaataggttcgtccaatccgtttttgctcttcgattggtggcgtcgttcttcctgctacgacttcgcctccttttgggccgactcgggcgttgaagaggctcaactttggtcgattgtttataatccggacggaatgaaaatgaacgcgacggggagtgaatttgaaaggaacacagcgcaactgatgggcgacgaccgactcgacctcgacagaccgaccaattggagggtcttcaacattttggccgtcttccacaatctttcgtttgaggaggcgaacacggcccttatgggcgaaagtcacgcgcttgtcaggtcgaaattggatcatgaatttcagtttgttttttaaattatttttcaggtttttgctgctttgcttcaattgtcggtggcatttgctgcgtaaaattgcctatgatacactga

SEQ ID NO: 69507 - DNA, 596 bp, Heterodera glycines
  Genomic contig location: Contig_ID=SeqID_8879; Location=838..1433; Strand=+
  SCN-specific regions: Sequence locations=1-596
atggctgacacagcgacggcgaaccgccaaggattcgctgtcgttggcccatttgcgacaacactccgcgcactttgtggtccatcacaactcatttgcaagtaaacaatgatgagtaatgcattatgaaaatggatactaaatgtgctcaatggtcaggatatccattgcactgaaaatgcgttggagtcggcgatgctccaacgggtggagatgggctaccacggtacaatctgatcttgaataagcgagttcaaatgcaataatccatcggtgcttccctacaaagagtacgtctatcacattcggcaacagttcgagcgcagtagggaacggccatccgcgcagaatgcttactcagactttgccgcccaagaagcgatacgacggcacgcatttgccaatttgcgcaaagagattacggtacgtacagtgcatgcagtgcaagtattctgtaggtattggcgtgattttccattccgtcaggaagattcggagggtccggtgacgcgaagcattcgcctcacttcagcgctcattctgcgcaacatttgtcaccattccgtcgccggacgtcgcaaactccgcacgcatga

SEQ ID NO: 69508 - DNA, 56 bp, Heterodera glycines
  Genomic contig location: Contig_ID=SeqID_41363; Location=718..773; Strand=-
  SCN-specific regions: Sequence locations=1-56
ggaagctattccggaaggattcggtctccccataaatctgggcgcatcggttcggg

SEQ ID NO: 69509 - DNA, 391 bp, Heterodera glycines
  Genomic contig location: Contig_ID=SeqID_41366; Location=1..391; Strand=+
  SCN-specific regions: Sequence locations=1-257,280-391
gtggtgattcattctttcctggactgtgttcacttcttcaatattttacgtttggcggagggtcaatcagccggcaatttccggatcaactcccaggttgtcagtgggttttacgcaaaaaagggaaattcgtccatttcccttttaggctcgtctacaaatactttttgttcatgcataaactcagttacatttttggtattgtcggttacttttcactcgtctttactgtcattggaataaattcggtgttcggtaaaattaaattttctaaaaattcaaaaaaggctttttaaggaattagcagtaatctgagcttggattttggcgtgcatttgttgttttattgcctttattacggtgtgcttggacgtgatttggcacattcatc

SEQ ID NO: 69510 - DNA, 403 bp, Heterodera glycines
  Genomic contig location: Contig_ID=SeqID_41366; Location=587..989; Strand=-
  SCN-specific regions: Sequence locations=1-142,164-265,287-377,399-403
ccacttcctcgttgattttcaatgaaatcactttgcacggcttttggatgtcgcgatggtacaattgtggacattcggaggtaaaacagaataaaagatgatgaccgaaacgatggaattttctcaaggaacgttcgaatatgtacagtctttaacgattggtataaaagtgggaagctttcgacgccgccctttcggaaatggaaaattgaggagttcaaagaagcggtcgaatgccatggaaccgatgacgaagttcaaacacgtctttgtgtatgagtgattctccggcacttttaaatatcacagaattccggttatgcacataagtgattccttgctcaaaaattgtctttcacaaacacatatatttctaatacattaaaacaataaataatgttat

SEQ ID NO: 69511 - DNA, 107 bp, Heterodera glycines
  misc_feature (10)..(10): n is a, c, g, or t
  Genomic contig location: Contig_ID=SeqID_41370; Location=8..114; Strand=+
  SCN-specific regions: Sequence locations=1-107
tgtccgtttnggggtactcaaacaattataggggagcaaaaatccaacgcagaattaaagtacaggctatagggaagctattccggaaggattcggtctccccataa

SEQ ID NO: 69512 - DNA, 855 bp, Heterodera glycines
  Genomic contig location: Contig_ID=SeqID_8881; Location=68..922; Strand=-
  SCN-specific regions: Sequence locations=1-32,62-67,106-137,167 -171,193-209,260-275,314-464,510-556,582-605,715-855
atgcgcgccattctcttcctggccatggtttgcttggtgatggctgttattcttgagacaggtggccaaaattaattaaaaatttaaaaatattttattattttagccaactcaaaggcagtgaaaaataagaaaggtataaataaattgataataaatattaattggaatatgcttttaaaggaacagttgcaacgccagcaaaaggaaaagcggcgccgaaaggagcagcgaaaggaggtaaagcagaaaagagagagggactaattaatacaaattaactaattaatcaaataattaattaaggaattaaaaaagacgcaaaatcaaagggaaaaggaaaaaaggacgccaaaggcaaaaagggtaaggattttaatataaagcgaaatttaaacagttaatttttgaattttagacaaaaaggctaagccagccaaagggaaaggagtgcctaaaaatggtaattattattaattttaaatgctaattaaaattgaattaatttagacaaaaaatccccagcggcaaaagccaatgacaaaaagagcccaagtaaataattaattatatttaatattgtgccaaaattgccaatttgaagtcaaaccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatggacggcgaggcggacgaatgggagggcatgggggacgagttggtggacagccaaatggcactttga

SEQ ID NO: 69513 - DNA, 1144 bp, Heterodera glycines
  Genomic contig location: Contig_ID=SeqID_8881; Location=4132..5275; Strand=+
  SCN-specific regions: Sequence locations=1-186,210-307,329-348,371 -581,603-688,711-822,844-1144
atgagcaacggtccgcgcgaggagcaaaactttcacctgatccgcgttggctttgacgacacgctgcagggcgaactgatcaacgcggcgacaatcaattacaaagtgagtgcaccggcgaactgcttgagagcaataaatgaacgcctcgagcgtctcgaacgggatcagtttccatcccccctgaaaaattattttaaaatcttcaaacacaaatttttcgaaaaaaacatcttagaattttttataagaaaattttaagaaatttaggtaaaaaattttaagcgatttttggaaaactagttttttctcataaaatatgaaaaaagcctgaaaattgtcaaaggatgtttaatttttacttttaaaacttcagtgcataaaagtggagaatggcgatcgaatgccgcagctgatcgagcgtgcgttggacaaacatttgatggacccaactgaagcgcccaactactgcttggtccaattgttgccggacggaagtcggtggcaaatcaattgctgtttttttcaattattataaatacaaaaactatctaaacaattaactacttgctgatcaatcgttttttgtctttccttctgatcaacttgttgtggccaacactcactgatcaatgttgattggtctctcaatcaattagccgatttcattctcggaattctgatcaatcatcttgtcaacaccaattattaaactaaataagacttagtgttttgctcttttcataagttcgccgattagaaaaggatcaatgacgtgaactccacgttaccacttactaatttttcactctattctttacctggcattctcggaattctgttcaatcaactaattgacgccgatcagtaaatttgatttgatatttcttctgattttgctccattgtctgatcacgtttttttcttcttacatcaaaattggatagatgggaatttcatttatggcaaatttttcattaaaaagtttcaatttcaggcgagttcgtgttccccgaccattgcaacccgttctacgcggtcgcgcccgaccccagctcgcccatgttggcctgcgtgttgcgcaagcgtcgtggcatcggccctggaggagcggcggatagcggtagcttggccaccatgttga

SEQ ID NO: 69514 - DNA, 148 bp, Heterodera glycines
  Genomic contig location: Contig_ID=SeqID_8881; Location=2269..2416; Strand=+
  SCN-specific regions: Sequence locations=1-148
tagggtgcggatttttaggggcgaaaaattccaatttagggacctaaataggggcaaaaaattcgcaaaataggggcgaaaaagtttcaaacgtagaggtgaaatttattaaaattgccgttttctctatgtaataagttaaaattaa

SEQ ID NO: 69515 - DNA, 386 bp, Heterodera glycines
  Genomic contig location: Contig_ID=SeqID_8881; Location=3247..3632; Strand=-
  SCN-specific regions: Sequence locations=1-386
cggagtaggacaaaacgtcgtcagcagaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaaagttcgaattactgggtttttgagttccttctggccataacttttttgaaccttaaccaaactttttgagattttgcaaattaataataaacacatagagctatcgaacaacaccaacaattcttaatttgattgacagtgaacaaagttatggttcaaaaagtcttccgacgacgtttcggccgacgacgttttggggtgcaccg

SEQ ID NO: 69516 - DNA, 67 bp, Heterodera glycines
  Genomic contig location: Contig_ID=SeqID_41374; Location=380..446; Strand=+
  SCN-specific regions: Sequence locations=1-67
atgctctcacttttaaccagcctttttgttccaagaccagcaactgtgtgcccaccattttccgaag

SEQ ID NO: 69517 - DNA, 837 bp, Heterodera glycines
  Genomic contig location: Contig_ID=SeqID_41375; Location=1..837; Strand=+
  SCN-specific regions: Sequence locations=1-837
  Gene Ontology: Mol. function=metallopeptidase activity; Cellular component=extracellular; Biological process=body morphogenesis (sensu Nematoda)
aaacgatcatttttttaaagccagcgaaatgaaatcttatatatatgaagctgtaaaactgtggaacgacaacacttgtttgaatattgttgagagtgacaaagtttctcctagaattcaattcacaaatattgtgggcaggggatgcaaagcaaatgttggaatgcaatcctcgaaagcataccaggaagttgatcttgaatacccagattgttacgaagtaagtaaaaatttgtttacaaaaactatatttaatattttcaaaagcttggattaattgcgcatgaaattgggcactctttgggattttttcatcagcatgagcgatatgatagggattcctttgtttggttttaccctgacaatgttgaccctgaaaatcattacgctttccaaaaggaaacaactgagtctactgataattataaagtcccttacgaccttggctcagtgatgcactatagcgcaagtaaacacaaatgcataaaacaaagcacggttttatgccgtcttattttccagaagcattctcaatcaatgggcagtataccttggtgcctcgagcgggtgcttcgtatataaatacaattggacaaagatttggtcccagcatcagtgattatattgtgataaacaagcattactgtggattagagtttctcccagatggatcaaccataaatacaggcacttagaaatttctatactgtgcattgtttttgtaattaagaagcatgtcgtgttacaatgaactgtgacaatgatgggttccagaacccggacacttgctcaacatgcatttgcccacagggttatatcggagcgaaatgccaagat

SEQ ID NO: 69518 - DNA, 3325 bp, Heterodera glycines
  Genomic contig location: Contig_ID=SeqID_8882; Location=231..3555; Strand=+
  SCN-specific regions: Sequence locations=1-92,162-723,747-952,974 -1014,1036-1047,1069-1675,1698-1787,1810-2327,2349-2451,2509 -2786,2814-3003,3027-3051,3073-3154,3177-3274,3296-3325
gcaacttctgtcgctccgtcagccaatcttttggcacaacaattggccggtcaatccgcggccgccgccaccgccaaatttggcaccactccacaacgccaacaacaacagcaattacccgcaaaacaacagcaacaacgccaaaagcaacaacaccaacagcctggtcaagcaggtgtgccaatgccaaaatcaatacaaaatctgttgtttgatagcttcgagaaatttttctcgacaataaaatttaaattaattacatggagtttttcgaggtcgagaattttcggagggtatcaaagaacaaaagtcgttcagcagcagagatcccgaggcttacttttttaacaatattaaaaaaaactgtgaatatttatttctccctcactcacggccatttaaaattagtaattaattagcgactaattattaattaattggcaattagcaacatcatcggtcaatttccgttataatttttggtcccttccaccaattgacctttgatgtttggcgatgattttcctttgggtgccgccgccctcgcacttttgccttttattggcaccgcgacacagtcattcgttccggcacttttcagcacattttggcattggcggcgctcagcagcagcaagtgccggtgctcattttgccggaccaatcgctgctcgagcggtacgtgcagcacaagcgggacgcccttgaccaattgcacaacagcgacgacgacgaccacgacgccgcgggggacgccgctgctgctgttgacgaaggtgggccccgggggcgatgggggggggggacaaaacgccaaaaactaaccaaaacgacgacaacgaggtcagtcacctaacccatcccatcgtcaattgggtggaatttgagtaccaccaccgacccgccgccaacaaaaaaggaaacttgtgaatgaatggctctgctgcataatatcccttttgccccctggggggatggggcgacaacaagtcgatttggggctgggcgagggggaggaattaaaggaaaagtgccgacgccatcatttgtataatcctattttattagggggccatttttttgcgatttacaaattacgaattatcttaaaaatgcattgcggatcccgtgggaccaagcctgaaatttgcggatcacgctgcgggactggaactaaaaatttttttgcatgacaggatcccgtgggattgccgcggcacacattttcgaatgttttgacattattgctcactcaatctttggcactctccatttttttgtctctcttaagacaaacccctgctggtttcagttgatttgggaattagtttatttagccccgagctctcaatccctcaacatttgggtgctcatttccctcccatccctttggcatgccaatgccacggaatgccaaagaatttgtcagctcgatattttgagtctcggggatttgtaagtcttgcgattcccttttcattccgttccccttttttctcaaatttccttaccccaaaatttctctcggtcttgaccttgactctcggcatcaatttttgccattctcggtataatttgccctcctttcagcgctccacaccgccacaacgccgtcggcaccggcactgttcgttccgcgcactgctgcggccgccgccgtcgtttccgcctcgttgcctggctccaagcggaacagtcagatgttggcggcggtgccctccggcgccgaactgccccagccgttgaccggctcattccactcggccatcgaggcgaccgcggccgatttgcgcgccgctgcggcggcggcacagccgcggctaaggtgggcaaaagccaggggagcaaatgctgaaagaatctgatcaagaagataaggggacgctgatcattgggcagactctgatcggaacactctgatcagtgaactctagaatagaaaccgaaaatttcaaattcgcggatcccgctgcgggattagaactcaacattttttgcgggactgggtgccgcgggattaagccttgcgaatcgggatctcgcaaaatcccgcgcgcgattccgtcccgtgctgctggtctctagtctagaacatagaaggtagctcgagactcgaacccacggcaaaaatcatcaaatggaaattccaaattattcataactttactcaaaatcaatcaaatttttaatttttgatagaagccgatagccctaatttgtaagtgtattttccctcaaaattgcatgcaaaaaactgctaactttcaaaaaaagttatgaccagcagaagaactcaaaaaaccaaatttctcgaacatttttggtcataaagaaattttttgaaattttgtacgcttatagaaaatactgtgccaagggctgatcgccagaaaatcaactgatcaattttcaaatcactctgctgatcacaaaaatttgtctccactaaaatttttaaaactttacaatttttcctttccatttaagccaatttcatgaaattgaatttccaaatcttaccaatgagcacatattgatttgtcccaattagtgttttgttgtttggccttccttgttttgttcgaaaattcatttaagaagaagcccctcataaattggttttgccataattagcacaaccaaaagcagaagaagcggcggcggcacaccgtcaggagaaaaagagaaccgtaccgccgctcattagccattaaccaaatatgcaaatttaattacccatttaattaccccactcctcgcggttttgtcccgcgtgtgtccaaattagtatttatatgtatgtatatttatgtaaactttccattcattcatattcatagaaattgttcaaaaattctttcatttttggcgggggagaagggctgggaaatttttccttttttttgaaaatttatccgctaaatggactgaaatgtatacactaattagcgattagatcacagcaaaaatttaaattccatgccatgtgggacaattaggggaataattaccattaattaattaattgacaataattatggccatttaaagacgtgctcaacagcagcagcaacaaatccctatactcagcacacaaacgtttgagaagcccaagtcgctgtttgaggagcaaatgcagcgccaggccatccaattgcgccagcgtggcgccgtggcgcgccattcgctgcacgacgacgacgctgaggcggcgccggcagcaaagacggtgcaaaaccaacagcggcagcataaacaggcggcccaagcagtgccagcaacacaaccacagcagcggcggcagcgttcgggcgacgccactgctc

SEQ ID NO: 69519 - DNA, 719 bp, Heterodera glycines
  Genomic contig location: Contig_ID=SeqID_41385; Location=1..719; Strand=+
  SCN-specific regions: Sequence locations=1-100,136-156,255-572,594-719
  Gene Ontology: Mol. function=ubiquitin conjugating enzyme activity; Cellular component=endoplasmic reticulum; Biological process=male courtship behavior
attttcacccgaacatttacgcggacggcaaagtgtgtatcaggtgaggggaaagggcctccattttgtacatgtacacaacaatgtttgattctggctgacatttggcatttcatttattcaacaaaatttaagaattatacacaacaccacaacaaaatttattaattattataaaatttaatcattgaacaaaaaagcaagatttttttaaaactcagaaaaattatttaaattttatatattttttaaaacggaaatccacaaaaataatttggttgtattataaaaaaaaacaatttcaatttttttgcatatgagttagttgcctgtgtaatatttctatgggaggattcaacctcataaaatttggtttcaatttttggaatttctgcgcttttttcagcattttgcacaccccgggcgacgacccgaccggttacgagacgagtgccgaacgatggtcccccgtgcagtcggtggaaaagattctcatctcggtggtgtccatgctggcgggtccgtcccttgccaatttgatttggcgttgacattggcttttttcatggcattttgcccatccatcctttgcagagccaaacgacgaaagtgcggccaatgtgaacgcggcaaaaatgtggcgtgacaaccgtgcccaatttgagcgaattgcgcacaaactcgtgcgcaccacactggtaaaacaggggaaaacgtgt

SEQ ID NO: 69520 - DNA, 429 bp, Heterodera glycines
  Genomic contig location: Contig_ID=SeqID_41386; Location=85..513; Strand=-
  SCN-specific regions: Sequence locations=1-296,319-429
cgcatttattgagctgactcatcgcgggtgtggaaatacaatacccgagctgaatgattatgggcttttaattcttaaatcaattaacgaaaacaatgcagaagtcatatgttcatgtgattttacgaatagagcatttggaaaaagaaacttttttgtaatatctcaaagccaagacgccgatttagtcatgtccaaaaaatcgggattaactggttggattacagaacaaccttctgtgctagatatgttagttggaataacccaaaaaaagaacttagcaaaacttatacttcttataaaaattaataaaaaaaacgaagatgagcttaaaaagtggaattccctaaaattggccaaatttgttaacagaaatttaataaaggagaaaatgcctatcaaactagatgaagataaaatgatattcat

SEQ ID NO: 69521 - DNA, 821 bp, Heterodera glycines
  Genomic contig location: Contig_ID=SeqID_41387; Location=13..833; Strand=+
  SCN-specific regions: Sequence locations=1-327,349-631,653-696,754-821
atgcagaaggtggtgagaactcccgggtgtcaattgctctacactgataccgactcgctgattttcgtccatccaatcggcatgtgtccactgaaaacagggccacacttgggacagttcaccgatgaatatcctgagcacgaaatcgtcgaattctgcagtggcggtgcaaagcagtatgggttggctctacggcgtaaaaatggccaagctgatgcggaaatggaatacgtgcttaaactccgtggattgacactcaattatgatgtgatcaacaaccaaggcttaagatacgaaaccttcaagcagcaagtcaaacgttatgctcaaacaggagagattgaaccaattaatgtaatgtacccaaactttattagacccaatattcgtgatggtggatctgtaatatcaagctctatgcaaaaatgttatcagccttatgttgggaagggtattgtaggagccgattataatgttctcaattttggacacactttgtaattgctcacccattataatgtcttttcaccattcattgtaattgttcacacattgtaataccttcttcaccaatcattgtttctctctcatatacacatgtacccttttatgttttttcgcctcttttgtatctctctctcatatacacatgtactcttttatgttttgttgatctgttattgtatctctctctctcacacacacacacacacacatacacacacacacaccccatacacacgtacacacgcatgtaccacctttgtttttcatgttttataccaaaaattgtgtaatttttcattttatttgcgttttta

SEQ ID NO: 69522 - DNA, 351 bp, Heterodera glycines; identical to SEQ ID NO: 53910
  Genomic contig location: Contig_ID=SeqID_41389; Location=198..548; Strand=+
  SCN-specific regions: Sequence locations=1-20,51-351

SEQ ID NO: 69523 - DNA, 200 bp, Heterodera glycines
  misc_feature (199)..(199): n is a, c, g, or t
  Genomic contig location: Contig_ID=SeqID_8884; Location=9..208; Strand=-
  SCN-specific regions: Sequence locations=1-200
atgaacactgtacggcgcacaaaatggtggcagttcaccggcgtgaagaagcactccgagctgtaccggcgcccgacgggcccggccgacggatggagcagcgctttgcgtagcacaatcgcagaaacggcaccatcaccaccagtagttgtggctgttgttgctggtgttgtggtggaaaacgaaatgccaaaaaaang

SEQ ID NO: 69524 - DNA, 500 bp, Heterodera glycines
  Genomic contig location: Contig_ID=SeqID_8884; Location=575..1074; Strand=-
  SCN-specific regions: Sequence locations=1-159,181-248,270-500
atgccaaaagatgtgctaaaaaatgtgcgaaaattggaagcacttcaagtgtattaatacctaaaaatcacagaaaattctcattatttatcattttcgccaccattgcaaatcaaatacatttcgaggtgttggagggtaaatttggttatttttcagttaaaattatttttataaattgaaagttccagcagggaacttcgaaatccaatgacgaattaagaattcgatttggctttcgacattcgaaataaaaaaggaaattttgaaaatgttgtaaaaatagcaagaaaggtgattttaaggggtgcatttacaatcttcttgtattttttttacaaatttttctcaaaaagccaaaatatgtgccaaacctcgaaatatgtgccatatgttttttgtgccaaaacgtcaaaatttttatgtttttatatgtaagtcgctgaaatcaaaaattgttcggagaaaatgctattttgggcttctctcgccataataaa

SEQ ID NO: 69525 - DNA, 280 bp, Heterodera glycines
  Genomic contig location: Contig_ID=SeqID_41393; Location=313..592; Strand=+
  SCN-specific regions: Sequence locations=1-280
ttttatctccgccgattgttggctttgtgtgtacgatctgctcccggcttcacaacttggccttggaattgcactgatcagccaccgttttgacttttatgtggatgaacatttcaagactcgtcgctggactctgagatccatggcaattaaatccaaatccaaatcggatggaaccgtgggaatggatattgtcaattacgctggaaaagcattgccaattccgcaaaatccgttgccaaagaaagtcgtcggattcaaagccatttcaatgaagtga

SEQ ID NO: 69526 - DNA, 325 bp, Heterodera glycines
  Genomic contig location: Contig_ID=SeqID_41394; Location=69..393; Strand=+
  SCN-specific regions: Sequence locations=1-325
  Gene Ontology: Mol. function=ryanodine-sensitive calcium-release channel activity; Cellular component=integral to membrane; Biological process=calcium ion transport
tggacgacattcaggcggcctgctacaaaatcctcgactcgctttacatggtctcccgcctggccaacagttgcgcgtcgcggcagagcatccaaattgaagtggaaaagcatcggtcggcccttggccaatgtctcagtgccttttccgcctgtttccccgtcgctttcctcgaggccgaattcaacgccaacaacaaattgtccgtgctggccaaaagccgagaccaatctgtgcaagtgcaggaaatgttgcagaatttgtcccagcacattcccatgttggacaaattgttgcaggaaattgagcaaagcgcagcaaaagg

SEQ ID NO: 69527 - DNA, 420 bp, Heterodera glycines
  Genomic contig location: Contig_ID=SeqID_41395; Location=67..486; Strand=+
  SCN-specific regions: Sequence locations=1-62,84-328,351-420
tttgtaacttattggtcaaatacaactcaatccaccaacattccaatcaacgggactcaatcctcaagcatttcaatcagtgggactcaaccctccagcattcaatcacttggactcaacccaccaacattccaatcaacgggactcaatccaccagcatttcaatcagtgggactcaatccaccaacattccaatcaacaggactcaacccaccaacattccaatcaacaggactcaatccaccagcatttcaatcagtgggactcaatccaccaacattccaatcgccgggactcaatccaccagcatttcaatcagtgggactcaaccctccagcatttcaatcagtgggactcaatccaccaacattccaatcaacgggactcaaacggaacttatatccaccagcatttcaatca

SEQ ID NO: 69528 - DNA, 304 bp, Heterodera glycines; identical to SEQ ID NO: 51570
  Genomic contig location: Contig_ID=SeqID_41396; Location=604..907; Strand=-
  SCN-specific regions: Sequence locations=1-304

SEQ ID NO: 69529 - DNA, 76 bp, Heterodera glycines; identical to SEQ ID NO: 51235
  Genomic contig location: Contig_ID=SeqID_41398; Location=279..354; Strand=+
  SCN-specific regions: Sequence locations=1-76

SEQ ID NO: 69530 - DNA, 759 bp, Heterodera glycines
  Genomic contig location: Contig_ID=SeqID_41400; Location=152..910; Strand=-
  SCN-specific regions: Sequence locations=1-498,525-592,614-759
atggagtactactactgttttaattattcgcaggtgaaacactacatggcactcgtggacactcaacagtacgaggcgtgccaccaagaggcagtgacgcggtgccatgccacagacaattggcacgaaaataccaacaaattgccgggacaggaccaaaaagtggtggtggacccaggaccacaggtaagccgacaatcgcggctcatgctctgactttgccgttaattttacaaataagttcaggtgcttgcttgtctgtaccattcaggtattgttttaccgtacacacttgattttatactgtataatttgaaaaattcaaaggcttcgatgaggcggacccgttgggcaaagagtgcgcgttgtatgttcgccaagtgttgcgcgagcgtgcggcacgcgtcaatctgctcccggacattgaggagaactgttgcgacgcactctcggaatactgtaagtggatttgccatgtgtggcgcatgaaaattaagcattttttaaaataatttataaattttccacccaatgatcaattgcggattttttatcagttccgctcgatttccgactttcaccccatcaattattcaatttataattttcacaggcttccaaattgtgatgcttgacaattactgctcgccaaaggttgacattgagtcggagggcaaaacggtgcacagttttctggtacattcgcaggagaaggacgaaggaaaggtggagaccacttatccgatcagatcagcatga

SEQ ID NO: 69531 - DNA, 638 bp, Heterodera glycines
  Genomic contig location: Contig_ID=SeqID_41401; Location=730..1367; Strand=+
  SCN-specific regions: Sequence locations=1-96,246-262,285-313,340 -441,469-510,532-638
gaaattggttgaattgaaaaagaaggaagtgtcaaggaagagaaaaagattgatagaaactgaaaaagtggaagggaataaagtgccaacaaatgtaaaagaagtacaagagacggaggatggagaaaagaaggatgaaaaggaattaaaaggaattggaaatgaaagagatttgaaggaagttaatgaagaggaaaaagaaaagaaagacaaaaaaggaaaagaagaagcaaaaaagaaggaaattgtgttaattgattcggaagaagattggaaaaaagtgtcccaacatgaagacgaggtttcgttaggtcctgaggaggaggacgacgaggagcgaattttattcccaactccaaagggtgcagaacttcagaatttgagtttttgggaatcgtgccataataaagcaaaaagtagaggcgaaatggaagaaaagtcgagagaaaaggaaaagagggaaacgaacgccttgcgtttggcacgagccgaaattcgatcggcggaattaagcataattgaaaaaagagacgaagaaattccgccggaagggaagagaatcagaaatgaattggacattaattgcgaaacggaagaagaggaaaggaaccgaaaaaaataccgagctcatactcccg

SEQ ID NO: 69532 - DNA, 344 bp, Heterodera glycines; identical to SEQ ID NO: 52084
  Genomic contig location: Contig_ID=SeqID_8885; Location=1639..1982; Strand=+
  SCN-specific regions: Sequence locations=1-157,179-344

SEQ ID NO: 69533 - DNA, 1003 bp, Heterodera glycines
  Genomic contig location: Contig_ID=SeqID_41409; Location=1..1003; Strand=-
  SCN-specific regions: Sequence locations=1-40,62-176,198-329,356 -438,481-1003
acaaaaataatcgatttttcaagtgtcgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaatgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcaggagggctgccccgaaaacccaaaaaaaaatttttggataaa

SEQ ID NO: 69534 - DNA, 513 bp, Heterodera glycines
  Genomic contig location: Contig_ID=SeqID_41410; Location=278..790; Strand=+
  SCN-specific regions: Sequence locations=1-193,217-405,427-513
atgacaacttctgctggagaatggaagaataaacagaaagtgagaagatgaaagaccaacgaagcgtgggaggaaatgtgccgaaggcgcggattgtccatcgacaaattaccgtggcgcctgatcgcgatcgcgcaagaaatatcggctctattgtatgcagttcacacgaccataaaaaaaagacgcgaccataaaatatttttgtaaatttaatgcaacataacttcttcaagaagcacccaaattaaacattcttggtatcattcggtagccctaagagtcctttattagcttgcttgaaaaatttcaaaaaatttcgttggggttcaaaaaagttgtgctcaaaagtactaaaaaaccagttttttgaaattttctagccataactttttgaactccaactaaattttttgaaattttacaggctaatagaggactcttaggggctctcaaatgacactaagaatgtttaatttggatgcggatgcttcttgaaaaaattatgttgca

SEQ ID NO: 69535 - DNA, 1333 bp, Heterodera glycines
  Genomic contig location: Contig_ID=SeqID_8887; Location=1736..3068; Strand=-
  SCN-specific regions: Sequence locations=1-205,227-281,304-786,808 -1034,1056-1154,1192-1258,1302-1304,1327-1333
atgcgacatgagcgccgaacagtggagtgtcagcgacgtgtgacccagctaaaacggcgtgcagttgagacgtggaaagcgccggctacaattcttgcgcaagtcttgcagaacacaacaacaccaatgttagctgcttttccgaacaaagctgcgacaaaaaggtcaacttttcctaatttttatgccaaaattatgatttgttcatttattttaggttataaaacgtgttctccgtgacgaatatgtgccacctgctgttcaactcagtttggacgctgtccacaaaggtgaaaaaatgaaaatcctaaaattccactaaattctgtattaaggcttttggtgtttgctcgatcttcgacttcacaatggacctgtattatgaaaaatgtgtacgcagacggcactttcagtcggcgccacctttttcaggtaaatttatgtcctcgcaaagtaaaagcctaatttctttcatatttattttggtttttaaggcgaattaattggattttgattacgtactgccttctcacttcaagtgtgaagcgttgaacacgtatgcctcaactgattgtcaaagatggccgaatttttcgcctgaaacttttcgttggacttcgaggtggtgatatcgccgatgcgagattcgactcttacgggcatgccaatgtcaatgttaatcccgatatcatcagcgattttctcgttggtacattatctcgaatttatgaaatgtgcccataatgatttttcaatgttttgttttttttattggaaatacattgataaatatgttttagtattaaattaaacatttttcgaaaaaaaaaatcagattagaatccatatgaaacaaatctcgtgtttcgcatttcatattttcgtaaattcgtgattttatggcgtttccttttcgtgtttcgcatttcgtattttgttttaatttcgtttttccgtattttgcatttttttcgattcgcaataaccctggtatgcatcagaaattgcgaattattcaagtgaattgcacaaaatttttccaattaaagttaaaatttattaattgtgacgtcaaatcatgttaaaagaattttttttgttgatttcagatccttccacagttgcggaaaaaataattattagtgctgggacagatatttattaaatccaaaaatatttatataatatttacgataaatcctgtaatgtttagcaaatattgagcataaaaaaaataacagctcataggtattaccacaaaatttattcattaatttaaagttatatatatatatatttttcgagatttttaaatgcatttttccaaaataaa

SEQ ID NO: 69536 - DNA, 584 bp, Heterodera glycines
  Genomic contig location: Contig_ID=SeqID_8887; Location=4112..4695; Strand=+
  SCN-specific regions: Sequence locations=1-562
atgcccgaaattgatgaattcgatggccaagccgaatatggtgcctatggctatgttgatcggttcattcgaaactggatccaacaatcagcaaaccaaaatcgggcagctttgtttccgatggaattgtggaacatgtgtgatcggtaaaaaaaccaaataataagtaaatgaattttgtaaatgatagggtggaaggcgacctctgcagaaccaataacagtgttgaagcttggcacataaatctgaacgcgttattccgttcaccatcgccacgtctaagcatttttcttcggaaagttcggcaagaagaaagccattggcgtcagcaagttgaagactttgcaaacaacccagcaaatggaatacgtggcaagggaatgaaacgcaagcaaacttatgtggaccaagacatgaatcttaatgagttatacgtcacgcgaaacaatcgccatcctctgcaatatttgcgcgcaatttcccaccgaatggcagaacctctttaggacaaaaatcaatgatttttaaaacgtaactaagaacctctttaggaataataattgatttatttttcatttttaaaa

SEQ ID NO: 69537 - DNA, 1113 bp, Heterodera glycines
  Genomic contig location: Contig_ID=SeqID_41414; Location=218..1330; Strand=+
  SCN-specific regions: Sequence locations=1-59,85-270,292-719,741 -995,1017-1113
atggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaggattgcaacaccgtttttgcacggtgtcatgacgcgaaaaaggcgcgtctcttcatcacattcacgaacaacagggaatggcctgagttcaaagagaatatatataaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctg

SEQ ID NO: 69538 - DNA, 1048 bp, Heterodera glycines
  Genomic contig location: Contig_ID=SeqID_1187; Location=39..1086; Strand=+
  SCN-specific regions: Sequence locations=1-18,40-59,83-134,156 -215,239-317,339-495,517-570,592-671,693-697,720-902,925-1048
atgaccattgttcgaagatttggaaaaccagacttatttgttacaatgacatgtaacccaaaatgggaagaaattcaagaaaatttatataaagaacaagatcctagcgaccgaccagatattattgaccgtgtttttaatctaaaaattaaggcacttttaagagatgtaacgaaccaagtttttggattttgtattgcttggatgtatcccgttgagtttcaattgagaggactcccacatattcatttacttattacattggcacaaaaagacaaattacacgatggagaagatgtagataaaaggggaattagtgcaaaaattcctaataaaaaccaagacccacaactttatgaattagttaaaaaacatatgattcatggcccatgtggaatattaaacccaaattcaccatgtatggaagaaattaccgacaaaaataatgttaaaattaagcgatgttccaaaggatacccaaaatcatttcaagaaaaaacaattgttttagaaaatgggtttactatctatgcaagaccaaatgatggaaattttgttgaagtaaaaatttttgatggaaaagtttataaattagataatagatgggttgtacctcatatgccatatttattaaaaaaattttcctgtcatatcaatgttgagaaagtcaacagtttatcttctgttaaatatttgcataaatatattcataaaggaccagatagaactggtgttaagttagttgaaaaaatcgattttgatgaagtgaagcaatttaccgacgcaaggtttgtaagtccaacagatgctgtttggagaattttagaaaatccaatttgtgatagaagccatgcaattaaaacattgcctgttcatttatcaggcgaacaaatttattattttgaggaaaatatggaagaagaagagcttagagacaaaataaacagaaatacggaactaatggcatattttgaattaaacaaaaatgatgaattggccaaaaataaatattatcacgaaattccagagttttttgtatttggaaaag

SEQ ID NO: 69539 - DNA, 857 bp, Heterodera glycines
  Genomic contig location: Contig_ID=SeqID_1188; Location=51..907; Strand=+
  SCN-specific regions: Sequence locations=1-345,367-369,395-456,479 -565,614-626,679-857
atgcgcacagaaatgaacggcagctttttggaaataaattcagccgaagaaaaaagacgaaccttcagaggtaagaaataccgaaatcagagtcgttggtaattttaaagtttacattggatccggaattggttgaaaaggatgccgaattcgcgatcagcgacccccgaaaagatttcacaccaatttgttgggggaggggggacaaactccaccaaattcctcaatgtccgaaatatcgcaaaaaataatcacaaactttccgagttgatttaagagttaataaaaaacaaagacgacagtttctggtgggttggcttcgtaacgactagagatcgacctggacctggatccaggcctggatttttcctggatccaggtccaggtccaggccatttttcggcaacctggatttttgtccaggaaatcaaggtccaggtcaaatgtgaaaaaaaatccaggtccaggtccaggcaaaacaggaaaaaacctggattttcctggacaaaattttagaatttattttttcaagtgaccgatgttttttcaagttttcaaaaaacagattaaataaatttaaaaacacattattattattaattagatatttttagatgcttctaagcaaataattaattttttcaaacatatttatttttaaaataaatttcaaaaaatccaggtccaggcctggatccaggtcccgaggagcctggatttttcctggacctggatttttgtccaggaaatcaaggtccaggtccaacatggaatccaagtcccggcttttttcaaaatgtcgatctctagtaacgacgatacattccccgcaatgggccaatggcgacgaaaacgga

SEQ ID NO: 69540 - DNA, 424 bp, Heterodera glycines
  Genomic contig location: Contig_ID=SeqID_1188; Location=2268..2691; Strand=+
  SCN-specific regions: Sequence locations=1-82,120-365,387-424
atggataggtgtaagaaagagaaaaaacagtggataattatttgtgggggaagtgcatattattttgaagacgcgacaattgcacttgggatgaaatttttaaaaaattgtaatgaaaatgttcaattatttctcactccaaacgccactattctaattacaaaaagaaatgtcaaagatgtgataccaattggagaaactcctgaagttgaacgtttgtcgaagaaaagtttatcgccaattcgatatgcgatgatatcccaactattcactgaacgattagccgccataattgtggtcaaaatgatatctgtggcgaatacattgccgacattgttgcaggacagcttaaccatgcgaaattcagcaaagaagtgaacacaacaacctttctgaacaccgggtcttcagtggtggtcagcga

SEQ ID NO: 69541 - DNA, 93 bp, Heterodera glycines
  Genomic contig location: Contig_ID=SeqID_1188; Location=5745..5837; Strand=-
  SCN-specific regions: Sequence locations=1-93
aacatgtcagagttagttccgtgcaagtgtcgcaatccatttttgagtgctctccatgtcgcctcaatgccttgagtgtgcactcttgggtca

SEQ ID NO: 69542 - DNA, 811 bp, Heterodera glycines
  Genomic contig location: Contig_ID=SeqID_1188; Location=5686..6496; Strand=+
  SCN-specific regions: Sequence locations=1-494,539-811
atgcaacagcaatacgaccatcgttgggtaaatcatcggatgtacttcgttgatcccaatgacccaagagtgcacactcaaggcattgaggcgacatggagagcactcaaaaatggattgcgacacttgcacggaactaactctgacatgtttgttaccaacctatctttatcagtatatgttccgtcggttccatggaaatgcaaaaattttccaaaatattctggaagaaattcgatatcaatatccactataattgtggctttacattgtgtatttcaattttaggctgacagtttgaaaataaaaattggactcaaacttttattaaaaaatcattggactcataaaaaaatgattggactcataaatttttataggactcataaatatttgattggactcatatattctgattggactcataaaactcgattggactcataaagtgcattagagccaaaaattttattcattccgttaattggagatggtaattattaaaagaaaattatgaattttaaaatcaaatttaattcaggtggaattgctccagcaatgttgttcactggcattgaccgactgattgcaattgctttttcggaattgtatgaaaaattacaatattatcaaattgttaagtacagtaactttcagtcatgatagccttaaaaagcgactgtatttggcactgttaactgtaatttctgtagcctatggtgtctgcttctctgctacggtgtaccaaaatgaaattgtagatggtgatcagatgaccaccggatcatatttggattttataaaggtttag

SEQ ID NO: 69543 - DNA, 551 bp, Heterodera glycines
  Genomic contig location: Contig_ID=SeqID_1189; Location=276..826; Strand=+
  SCN-specific regions: Sequence locations=1-139,162-551
atggtatccacacgcagtaaaactgataaattcaagaaaatgggaaattcaagtactgaagcaaatcgaaaacggaaggaatggcgccaggagcgtgctcgaaaaggcggctcgacgccaaaaagtgacgaaaattgacaaaaattaattttattttaaaacactgcatttttcagcgctaaagcagaccgaagccgagacaacaggggaattgtcgatgagccacttttgcgatcaatcaaatttgaccggataatcctggcgccttttcacgtcttccagggcattggaaatgcactgatcaaagagctcgaaggattaactgaaagcgcggaaattgcgaacggatttttcagaagcatcgcggccaggagggaagcgttcagaaaaaaagacatgacggggaattcaatcagaaaagttctgattcatgctgaccaattggagaggctttactcagctgaatggcctcaaatcatttgcaaaaccatgggacacttggcaaagatacaaacttttacaaaagagattttattttgtctttcttgaaa

SEQ ID NO: 69544 - DNA, 267 bp, Heterodera glycines
  Genomic contig location: Contig_ID=SeqID_1189; Location=1122..1388; Strand=+
  SCN-specific regions: Sequence locations=1-267
atgcctgacgaagaacaaatgcgtcaattgttggagcaccattttgtctcaaattggcttctcgagacgggaaagctcgacgaaatgaagcgggtcagtttggtgaaaattgggtttcaaataaaattcccatgcctcaggaccgtgaagaacaacaggaacaaatcggaggccgggagagcgacgaagaaagcgatgtagaagaagaacaattcgattttgaatagacacagttcgataaaaggtttttcttcgtttttacaggaa

SEQ ID NO: 69545 - DNA, 1730 bp, Heterodera glycines
  Genomic contig location: Contig_ID=SeqID_8888; Location=1130..2859; Strand=-
  SCN-specific regions: Sequence locations=1-138,164-251,274-280,302 -533,556-706,728-865,1160-1730
atgcccgcgccggtgcaaagtgtgcgcgttatacgctcctacacggacgaggtgggcgagcagttcaccatttgttattcatttcataatgcggtttttggatctgagaataaatcggccaaaagggcaattcggctttgcattttacaaataaaattttaaaaattgcaaatgttttcctcatccgagaaaatagagcattaaaatcccttttgttaaatttagtaaaaaggattaagagaataatgaactaaaaaataattttaaataaatccaactaaaatttggctcaaaacattttaatattagaaatttttcccagtatttccaagcctccgttttgctcggctttgggctgccaccaaaggccgactcggcacactttcagctgtacgaagtgcacatcgcatggtctccgggaaaggtgctgttttgtgttctaaaatatccattcaaaaataactctgtcctaacaaatgagtgccattgaaatgtgtgctgattttggcttttacttaattagttttgtatttatttgtgaaattatcaaaatgctttcagaaggtggtgggccggcaacaagttgtgttccgtggcgaacacattcaaaaaacgggcggcaaaagtgcggagggacgagtgaacatcaccggattggagccagcccgactgtacgggcacaaatttgaaaaatttgtcgttagaaaattaaaaatgaaattcaattatttttggaaaaaaaaaatttagtgcttcactttctataaatgcaaactgttcaggtacactttcgcagtgcgcaatgtgtcgcgcgagttggccgccaaatgcagtgcgcctttgggcgtacgattgatcacacgtaagagagagagagagcgggcagaggagaggcagcagagagagagaggggggggagagagagaaaaggggagagagaagagagagaagagagagagagtgagagagagagaagagagagagagagagaagagagagagagtgagagagagaagagagagagtgagaagagagagaagagagagagagagagaagagagagagagagagagagagagaagagagagagagagaagagagagagagagaagagagagagagagagagaagagagagagaagagagagagagagagagaggggtggggcgtggacgggtccatgtcaaaacgtaataaaaaaaattgctgaattaatttattctttttttttgactgtgtgtagccccggtgatcacttccaccatttacgcgggacagatctccacccattcgatcaacatcaattttggcgagtccgacccttcccatccgtttgatcagtacgaattgcattttgactcctcaagcggagcagaagcagcggaaggggacggagaaacagcgccaaagagtgggaaaaagttggaaaacggagacgaaacgccaaacacactgatccgaaggctggcaaaaaacgacacgtgagcaaaatgccaaaataattagcaaattcaaatggtgaccaaaatggcttttcattgtgccaattcttccacattcacatttttatttgttttgttttttcagcaaatcgttcactttcaacaaattggtgcccggcaaaacgtacactttcgctttgttcacacttctccacggcgttcgcagcagaccggtggacgtcaacatcacaacatgtgaggagcaaaagaaggaccgcaaaaaatga

SEQ ID NO: 69546 - DNA, 808 bp, Heterodera glycines
  Genomic contig location: Contig_ID=SeqID_41422; Location=221..1028; Strand=+
  SCN-specific regions: Sequence locations=1-31,53-495,517-648,675 -757,800-808
cgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 69547 - DNA, 630 bp, Heterodera glycines
  Genomic contig location: Contig_ID=SeqID_41423; Location=152..781; Strand=-
  SCN-specific regions: Sequence locations=1-78,100-203,225-559,581-608
agtgattctatgctatcaggatgaattattcggtgcaaataaaagttcaatttggaaagtggcacggcgttttcggcttaatgatttgtctaatttgcaaaatacaaattgtgccaaatatgaaaaggaaatccaagtctcaatacaaaatgggactttttcaattggaactgagcatttcaagtgaataattttgaacaaactataatattaatattatttttccaaaagaattggcaataatttgtcggagatattaatccaattaagctcaatggaatcttcatatgcaaaaataattacaaatgatagtaacaaactagaggtaaaattaagtggataattcgtattaaatttaggagaatcgattttatcgaaatttggcaaagaatttgaatcacaaattgcaaatggtgcttttctggaggaatattgaggcttttggttgatgggtgtggccattttgcgaaaaataggacagaaaggcacgaaaattagggtgaacacttcggaaaattgtgaagtgaatgtgatcagcaaatacgagcagcccaaatgccacacatttaacggcagaaaacgatttggccgacacataaatccactcgtaattaattttaaattaataaa

SEQ ID NO: 69548 - DNA, 1322 bp, Heterodera glycines
  misc_feature (12)..(12): n is a, c, g, or t
  Genomic contig location: Contig_ID=SeqID_41428; Location=1..1322; Strand=-
  SCN-specific regions: Sequence locations=1-104,126-911,936-1322
  Gene Ontology: Cellular component=basement membrane
aaaagctttctnttcagacgtttgtggcggcgaagctcctttgatgcagccaaatccgtgctcagcatccgatccatgtgagttttcgatgccaaatgcgattgattaattagttaattaattgacgagttcgctttgctttttatgtcctacgggctacggatgtcgccaggggcgttgctgccccagcaaaggcgtgtgcccggcggggagtccgctgggcggcatcactcagtgctcaaacgagcggggaaacccgtgccctaacaatttccaatgcgtgacgaacaatgggcaccagtactgctgcccatcgccaggtcagtcaaagtttggcactgttcggctgatcactcaatttgcgattttagcccctgaattatcagaagatctgtccgtttgtttgattttccctccgatttcagaccacgtttgcggactgccaaaggacccgggaattccctgccaagcgcgcggagtgccggcactttcgcgcttttacttcgacggctcaaccggctcttgccgttcatttcaggtacatttttagagctaagcatcttcaatattaaattgtttttctcagttttcgcaatgcggtggcaacgcaaataatttcgattcgttggagcaatgcgaaggcttttgctttgagagtaagttaatttccctttctggcatttcgtccattgtgctccctccttttagcccaatgcccccagggtggcattggccttcgtgccgggcccgcattggccacgtgtgtaccgggggatgccctgtcaaatgcgcatgactcgtgcccatctcagtacggctgctctcagccccgttttgggtccaatttcgtgtgctgttcaaatccggaggaagtgtgccgggtgaatgaaaacaaatccaaattggcactttttaaactgaaattcttttgaaaaaggagcccgtttctgctggcaatgcctgctttggtggattcgttacggttggttgaaaatgagacgaaaggccaataaaaagcatcaaagataaaccgatggagctacaacccggaaaaatcgcagtgcgaaccattccaatattacggtattgaaatgcttaattaaccagctgaaataagctaattactcccctctccacttaggcgcaaagagattaattatttccacttagagtaatcagtttaattaccccgcttatgtcgatcactcactcacttattttgtaattttgtcaggttgcggtggcagtggcaacaatttcctgaccaaaagcgactgcgaaagcatttgccagccgagcatcagaagcggtaagagcatgct

SEQ ID NO: 69549 - DNA, 690 bp, Heterodera glycines
  Genomic contig location: Contig_ID=SeqID_41431; Location=279..968; Strand=+
  SCN-specific regions: Sequence locations=1-183,205-238,260-526,549-690
aacaccattcgtcgtcctgcttcaacttctgctgtccctcctgtgccgctgaagatggaggaggacgaacgacggggcgaagtcggcacagacacacgacgacgacgacacgacggagggcacagcggaggaaagaagaaaggcacggatcggtcgcccacttcccgggcaaatgttttggacatggagcagctgcaggacgggggcaatcaggtgcagtttgttttttgttcgttcctttcatttaattcttcgtggaataatttgttttttcacttaatcataagtggacaggggggggggtcaattgcgtaaacagtacgagggtccgagcaatttgtaaaatttttaactaaaatcgaaaaagcacggtaaatatgggaaaattttacgaaattggaaaaaaagtcaaaagtttgtgcaaaattttttacgattttgaattgcattagttctatttcatcttttaaaaatttccatcgattttgcgtttaaaaattttacctgcttttttttcttcctcattttgcagcagcagcagcagtcgatgaacaacacgcaaatgcgcggtggtggcattgcgcagcagcaagcggctggcaatcactcgcagcaaatgctcgcctcgggcagcggcactggactgccacaggacccggagaagccgcagcagcaaccgttcaaacttaa

SEQ ID NO: 69550 - DNA, 427 bp, Heterodera glycines
  Genomic contig location: Contig_ID=SeqID_8892; Location=606..1032; Strand=+
  SCN-specific regions: Sequence locations=1-27,49-89,124-205,240 -311,341-427
atggagaaatctttgggctatcttttcatattaagtgtggtgtgaattaattgaagtttgaaccattttcatgcatttaagcgtccttacatttttgtatgcaaataaaaatatgacacatttaatttcttaataattgttttctgaaacaattaattttaattttcttgcaatgattagtagccgaaagatttctctattattctgttaaatttcaaaaaatttttggcttttaaaaaagttagggtcaaaattgcgcagtctaaatttttcgaaagtttttggttacaactttgtgtaaattttgcttgatttttaaaaaaattataatattataatacagggaggatacgtagagctacttttaataccaagattgataaattggttaagtgtttaagcaaaattttgatttattatttggcaa

SEQ ID NO: 69551 - DNA, 1912 bp, Heterodera glycines
  misc_feature (962)..(962): n is a, c, g, or t
  misc_feature (1168)..(1168): n is a, c, g, or t
  Genomic contig location: Contig_ID=SeqID_8893; Location=182..2093; Strand=+
  SCN-specific regions: Sequence locations=1-94,116-266,289-562,588 -969,991-993,1109-1399,1421-1620,1642-1912
  Gene Ontology: Biological process=digestion
atgtgggatgtcgtttctggcaatcccccgcccgtggaaaaaacgaattggactcgtgcccaaagggtcattcgccactttccgaatgatgccgatgggcaaacacttcgccaaggcattgccaaaatgccattcgccaattacgacatttggaccaacgacaacgacgaggtttttactgaacgcacacttcaactcttcacagagattttgactactgcctgcagcggtacggagttaatattttgtgccattgccatctaattcatttaaaatgccatttttgtctctctcccattttccgtgccaatttgccattcgccctaaaatgcagttttatttcgtagctcttcaccgttcttcccaactcttttctgcactcaacagcagcagttcggcgcctgcttttgacgtcgcaatcgccgaatggttcgacttttcctcgttggcactgttccatcggcttggcatccccacaactctgatcacttcggcgcttccgctcgattccgtccttgcgcgttatctcggcattccaatgccggcttatgtgccaagttggaaacacaatttttaaaaccgaaaatattttcatgcaatttgagttgtcaacaaagcatcccccgagggcaccaaaatggacatttggaggagatttgtgaattacattgataaacgaagaaacacgcaactcgatcaaataattaataccgtggccaactcggtgttcggcgaaaattttccaagcccgcaggaattggcacttcgtgccagctttttgttgctgaacaccaacgaaatgctggaccttgccaggccaacttccaacaaaatcaaacacatcggtaacgtcaaactcacaataaacttaaagaacaaaatcctcagaaattctaaccatttttatgagggggttcctggggtgatcaatcccatttccctccccaattccaactccattntaagaatggctttattttggaaaaagcactgaaatcaaattataaataaaattaaacaattaaataatatttaaatacataatggaataaaatgttacataatgttacaaaataacattacaaattaaatacaattaaataaagttgcataataatgattaagtgatcagcagaaggaaagatcgcacattaaatagacataatgnagaaggggaaaagtcattggctaacggaaaataattaaatgaaatgaaacgttgcattaaaatgagtgtggaaatagcgatcaatgcttcggcagtttatgttaattagcttatcattaaatcaagtccgcttttcaggtggttttttgctcgattccgactatccgaagaatgccgtggccaaaagaatggccaaagatccctccatgccttccgcttctgctccgtctgtttttgtctctttcggttcggtcgctgaccccaacaaaatgccaccacaaatgctccgtgcctttttgcacactttcgcctcgtttcccgagttggattttgtttggcgcttcccgacacagaaaggcaccgatgatgaagcacggtgccacaatggcactctgttcggcaacaaaatcccagcaaatgttcgcctcgtccaatgggttgatcaacacgcaattctcggttttttggattgaattggtcttcaattttactaatttgctaattatctaagcccatccgaacacccgtgcatttgtgtcccactgcggccttaatagtctgaacgaggccgccaccgcgggagtgccgttgctttgtgtgcccctttttggcgaccaaaattacaatgcggccattgtacaaaaccatcagaacggaattgttttgctcaagaagcacctgaacaaagagaggctgcaaagtgcgttgaaagaattggtggccgatgaaaaagcgaataggtga

SEQ ID NO: 69552 - DNA, 459 bp, Heterodera glycines
  Genomic contig location: Contig_ID=SeqID_8893; Location=4044..4502; Strand=-
  SCN-specific regions: Sequence locations=1-424
atggtgattgtgccatttgctgtcttttcagaaattcatttccatcatcctggcatcgaattttggaaaccgatggaatattccacgcgttttgttggcggaatgcaccggtatttgtttgttctgggattatttcaaattcaagacttattgggcaatttcttatgatttggccctttgttttcgattcactccaaaataattaatttcttttgactttaattaatccaattaaatttccagcaattatcgaccaatttcttacggcggaaaagaaattttcacccaaaaaacatttggacaaattgtctccgttgtcaacaacttgaagacgatcttcaacccgtccacttacaaattgctgtctcgaaattgtcttctgttcctccgaacattggtccgacaattaacgggtaaaaatggctaattaattaaaatgtacaaaaaatataaaataaa

SEQ ID NO: 69553 - DNA, 748 bp, Heterodera glycines
  Genomic contig location: Contig_ID=SeqID_41434; Location=51..798; Strand=+
  SCN-specific regions: Sequence locations=1-148,171-220,242-305,327 -378,400-748
  Gene Ontology: Mol. function=phosphatidylinositol transporter activity; Cellular component=integral to membrane; Biological process=nonselective vesicle transport
atgagaccaattccattaaacgcagtgttaattaaggattggcgttactaccaaaagttggaggaggagccggactttgacaaaccaaactacccgaagaaatggaacgaaatggccaaggcggccaaagaagccaaagatcagctgaaaatggcaaacaatggcaccaacgaaaacaacaaaaatggcggaacaaatggcaacggtgccgccaatggaaatgccaaaaatggaagtggggcgaccgaatgaataacggacgattcgcaagtgacaggcggaaattagggaccaatgcttttctgtttgttctgataaatgttttatagcaacatttctctgtattctccttttgtccaatgagttgttctctctgtgaatgatttatttttgttaattatgagcattttatatttttctctataagaaaaagggcatcgagcaatgatcatcaaagaatagtgagtttattatgacgactttaatttatcctttcttttcagtcggctcgttttacctatgaccgtcgatgagtatcaaatcggtcaactgttttccgtggccgaagcatcgcgacaggttggcacttaagcagacgaggagtgtgaacaatttatacgacttttaaggagacgggcggcggagaaggtgttcaggtgttgcgcaacgaaccttttgaaggggagagtctgttcaatggccagttctcttccggacaatatacgcataaaatttaccatttcgattc

SEQ ID NO: 69554 - DNA, 1023 bp, Heterodera glycines; identical to SEQ ID NO: 41436
  Genomic contig location: Contig_ID=SeqID_41436; Location=1..1023; Strand=+
  SCN-specific regions: Sequence locations=1-766,788-1023
  Gene Ontology: Biological process=response to oxidative stress

SEQ ID NO: 69555 - DNA, 505 bp, Heterodera glycines
  Genomic contig location: Contig_ID=SeqID_41438; Location=347..851; Strand=-
  SCN-specific regions: Sequence locations=1-1,23-126,148-258,287 -427,449-505
caaaagttttttacaaccacttattgccaatctaatttcttgcagatttagagctatccattgcctgccggttctcggcacagcaaagcactaatacggtgtttgactcacttcaaaaaataattcattacccaaaagttttttacaaccacatattgccaatctaatttcttgcagatttaaagctatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattctatacccaaaagttttttacaaccacatattgccaatctaatttcttgcagattgaaagccatccattgcctgccggttctcggcacagcaaagcactaatagggtgtttgactc

SEQ ID NO: 69556 - DNA, 926 bp, Heterodera glycines
  Genomic contig location: Contig_ID=SeqID_41439; Location=45..970; Strand=+
  SCN-specific regions: Sequence locations=156-290,312-393,416-748,771 -926
aaaaatgggaagaaaaagaagaagaaaggcgaaatgaactcaaaaaaagagaaataattcaaaaatattataaaataaaagagaaaattaagcaaaaaggaagaaaatattcaacaaaagaatggaataaaattgaacaaaaaatagcgaaaaaattgggaacaaacaattgttatattaaaaaatggattaaagaatttggtcttcaaaaacaaataaagaaaagctacaaatcaaaaactgatgaagaaaaacgtcaaattattcaaaaattcattgaaatgacaaatgaatttaaacaaaaaggaaaatattctttaaaagaatggaacaaaaattatgccgaaatttgtaagaaaattggagtaagcaaagggacaattatcaaatggaaaaaacagtttggcattagtcttaagagaataacggaaaaagaaaaaatggcaaaaatgaaaatttattggcaaataaaaagagaaaatccaaaaataagtgagcagaaaattgccaaaatgaccaacactcggcgaagaacttttggaaatggaaagccaaatttggagaagcgaaataatgaggaagaaatgaaagccaaaaaagaggacaaagaaattctcgaaattctcgaaaattcggaaaattatattttatgtgacttttgtttttgttcattaacagggctgcaaaaaatatgcaaatgcataaaaaacactttctttttttttgtgtttgcgtataaaagtcgggacttttatttgcatattttggctttatctgcatatttcatgcatattttgccatttttcgtcaaatattttccgattttttgcatattttgccatttttcgtcaaatattttccaattttttgcatattttgccatttttcgtcaaatattttccgattcgaatatctcaattttttaa

SEQ ID NO: 69557 - DNA, 412 bp, Heterodera glycines
  Genomic contig location: Contig_ID=SeqID_41440; Location=315..726; Strand=-
  SCN-specific regions: Sequence locations=1-250,274-412
atggaaagcatagaaaatggcattccgattatagcgaagggtcgggaaaatggcattggtatttacatttcgcttttttaacttgaataatttccaattcagatgcaaaacaggtcataaagcccgtggctggaccggcagaagcgacagacatttccacaaaacagcagcggatgccacgaatgcaagtcgccgccacccctcctacggaaaagccgaaaacacggaagcgaaagtacgaactcgactttttccctaatttctcaaatcattttattttagtgctttgttttttttattcaacttcattttagagctgatttgtccttcgatgggatgagagaaacggatgctgaatctgagaaagggcagagcgaaaaacgtgcgaggaattttatcagaaaagaatctg

SEQ ID NO: 69558 - DNA, 915 bp, Heterodera glycines
  Genomic contig location: Contig_ID=SeqID_41441; Location=96..1010; Strand=-
  SCN-specific regions: Sequence locations=1-399,421-775,809-915
atggacgactcttcaacgctaatcgaccgggatgaagtgatgaaaaatttcaaggaaaacttgtcgttcgtcaacaacaaataccaaatcgcattgccatggaacgacagagtggcacaattgccaacgaattaccatcaagcaaaggcaaggctcataagcctcatcagaaagcttcggacaataaacttggtcgacgaataccaagcaattctggatgaacaacagcagaattccatcatcgaactggtcaattctgatcattcttgtggtccagtccactacctgccacacagggcagtcatccgaaccgacaaatccacaaccaaaatccgcatcgtgatggatgcctctgcaaaacccaaatccactccgtcggcaccatcactcaacgaatgcctgcacacaggcccgctacttttgaaagacctgaccggcattctccttcggttcagacgcatggaaaaagtcatccttgctgacattgaaaaggcattcctacaattgggcgtcagagaacaagatcgcgatgccacacgattcctttggcttgctaacccaaaggaagcaaatctcgaacagctgaaacgagaagacttccgcgttttccgattctgccgagtcagtttcggattaaccgtgtcaccatttctactcaatgccacgatcagggagcacctggcacttcacgacacggatgttgcacaacgcatcagtgacaatctttatgtggacaacatcatggtggaagtcaaaccaagtgaaaacagcaatcaactggtcacagaagcaaaaatcatttttgaatcagccggaatgcggatccgcgaatttttcgggagtcacatcgacgggctaaaagagctcttgactcatccgaattggcccaagacctcgaaaacacaaagatgttag

SEQ ID NO: 69559 - DNA, 2637 bp, Heterodera glycines
  Genomic contig location: Contig_ID=SeqID_8894; Location=1096..3732; Strand=+
  SCN-specific regions: Sequence locations=1-59,89-303,329-1881,1903 -2170,2201-2590,2613-2637
atgtcgttggaagaccacaattattgcggcgagatgggcggcaacgaagaaacgcccacaaagagaagaaaaagaaatgatgatgatagggaacagaaatttcaaaaaaactgcattcgcactctgagcgccgacaaacagtacaaccaaaatttcaaagtgcagagcgtaaagtcgacttttgtcatcgaaaatttgcccgccaaccccgagtcaatgctgcgcgcattgttcgctcactgcatgtcaaccgccctggacgagtcacagcagaacgggatcacaccggatcaattgggcgctacaatctcttcagatcttctaaatccgagcatatggattcctatacgccgcatttccgacaacaccgccgactcaattatgaaccgcttccttgaggtggcacagtcaaaatcgcgggagggctctctgtggggctcgccgttcactgtgaccatcacaacgttggatgttgcgcagctacctcagcggcaacaggtgcgtggcagtgggaaaaggacagcaaattcagtgcagcatatcgtcaaagaaagtgctcttctgcggatcaataacaacgatgatgcatattgtcttttttacgctttggagacaagcaggaagtaccacatcaaagagatgagccgacagaccttttctaaatatattaatcggcagaatgggcgacgactggaagacgtgtttggactgatgagcagcgcaaacattcgcaccgatctgagagaatatgacgcggttgtctatgtgccgattgtcgtggactattggaatcggaaatacgccacagcaaaccagcgatttaaggtgttcatttttggcgctacaggcagctatcggccaaaatttcaatatgggccggacaattacaacgtcgaaatcccgctctaccatcacaacggccatttcgacggaattcgaagcggggtgggcaaagcggtgtttgggcgtgactactactgcttttcgtgtgagtgcccctacgataatgccaatgatcattcactgcagtgtaaagcaaagtgcataaactgcggtcgcataggagtggggcgaccgtgctgagcggatgacaacaacgacagttattacagagaatacacagcatgtggcaaggatttcatgagccaagactgtttcagtcatcatttgtcgagcaatgtgtgccgacaattcaagaaatgcaaacagtgcggagttgtgtggaatgtcaaacaaaaccgacgaaaaggacgcagcggacacgtttgcggtgagaaattctgctacacctgcaaatgttaccataagccggagcggggctgcttcatacagcagttgaaggcgcgccgccccacaaagtacagactgatcgcctttgactgtgaaacaacacagaacacgcgaattgagggcgaccgcagacttcattctgtcaacttcatctcatgctatgtcgtctgcaccaagtgcataaacgaaaatttatggcgaaattccctacaagcgccatgtggcatttgcggtcggcagcgcaccgtcacattctcccaccgcgcctatgaacgcacacaaaccgatgcccaattcatcactccgtgcccaatggcggcctttgctcaatggctgctcagcgaattcgatccgcgctatcccacaatgctcttcgcccatttcgggggtcgctttgacaacattatgctgtttcggcagttcttcctcaacgggttttgcccgcaaatgatccgccgtggtaacaaattatacgaaatgaaaattgcgaggggcgaaaaaaacccggaaatcatcgtaagagacagctggaaccttatgccggtgccgctcggcgctctgcccggagcgtttggactcaatgtgcaggataaggagttcttccctcatttggcgaatgttgaggcgaattatgggcacattctgcagtcgctaccgccaaaagctgactacttatacggcgggatgacgcccgaccgacagcgcagattcgaccagtggtacgcggaacaccgccatcagcagttcgacctatgtgaacagctcgcagcctactgcaccaacgacacgcgcatactaattgaggcgttggtcgcttttcgcacggagttcttgacgatcagtgacccgttggagcggcatggatgcttggatgacgacaacgacgacgaagaggaggaggagcaggatgacgacaatgcatttgaagtgatcggcggtggcattgacataacgtgggagccgatgaccatcgccagtgcctcaatgagacactttcgacttaatcacctcaagagggatcagctcgccattgtgcccgagtgcggctacgacactacaaacacgcaaagccttgtagcgctcaaattcatggactggtacgccaaaaagaacggggtgagcatccagacggcacactcgcccggcggagagaaaaaaattggtcagtacactgttgacggatacattgcgtcgaccgacaccgtgattgaggtcaacggctgccactggcacgcgcacgaccacccgcgtcaccgctttcagccccaaacagtgatggcgaatgggaaaacggcgcagcggatacgggaggacgatgcgcgacggatggccttcatcacatctcag

SEQ ID NO: 69560 - DNA, 672 bp, Heterodera glycines
  Genomic contig location: Contig_ID=SeqID_41442; Location=194..865; Strand=+
  SCN-specific regions: Sequence locations=123-135,342-357,455-456,491 -509,551-672
atgccgcgcccatctacctgcgctgactcaggaggtggcatgatgacgaccttaaccgctcgaccggaagccattaccttcgatccgcagcaaagtgcgctgatcgtggtggatatgcaaaacgcttatgccacgccaggcggctacttagatctcgccgggtttgatgtctcaaccactcgcccggtcattgccaacattcaaaccgccgtgaccgcagcgcgagcggcagggatgctgatcatctggtttcaaaatggctgggatgaacagtatgtcgaggctggcggacccggctcaccgaattttcataaatcgaacgccctgaaaaccatgcgtaagcagccgcagctgcaggggaaattgctggcgaaaggctcctgggattatcaactggtggatgaactggtgccgcagcctggcgatattgtgctgccgaagccgcgctacagcggtttcttcaatacgccgctggacagcattttgcgcagccgcggaatacgccatctggttttcaccggcatcgctaccaacgtctgcgtcgaatcgacgctacgcgacggcttttttctggagtatttcggcgtggtgcttgaagacgcaactcaccaggcggggccgaaatttgcgcagaaagccgcgttgttcaatatcgaaaccttttttggctgg

SEQ ID NO: 69561 - DNA, 525 bp, Heterodera glycines
  Genomic contig location: Contig_ID=SeqID_41443; Location=3..527; Strand=-
  SCN-specific regions: Sequence locations=1-169,192-277,299-525
  Gene Ontology: Mol. function=3'-5' exoribonuclease activity; Cellular component=CCR4-NOT core complex; Biological process=poly(A) tail shortening
atgataaagaatattgcgccaggaattttcgatttgcgtcatttgactgcgctctacttgggcaacaatttgttgcagcgaatacctcccgaaatagcaaaactttccaatttatcactactggacttatcgcacaacaaattgcgcagtttgccatccgaaattggtgacatggttagtgttcaataaattgttggcaatcttttacaatttcgatcccgaagagaaattctaaaatatttcgaaatttaatgttaagctcacaatcagaactgcgaatagcattttttaaatccagaaaaaaacatcattttattttccactggaaccataatttgtaaggattaccaattgcgggttatccattttcaaacacataaacatttttagatttcgttgtgccacctttacttgaactccaaccaacttcgagtgttgccctatgagcttggaaaattgttccgactgcaaacttttggtctgagagaatattctatggctttaattggtaatttgtttgtctga

SEQ ID NO: 69562 - DNA, 294 bp, Heterodera glycines
  Genomic contig location: Contig_ID=SeqID_41446; Location=41..334; Strand=-
  SCN-specific regions: Sequence locations=1-169,191-256,278-294
atggaaatctttgacgaatttattattattggcgaaaaagcaatcggtaaattcgcgattactggaaaatcttcacattgggaaatgatcgaatttgttgaactgtaatttcattttttaattttcatttataaacccatttttagtgagttcacgagtgtgacaaccgactttaaccaagcattggaaatcgcggacattggcaatgcttcttccaatccgtcggatttggagccattggcacaaattgtccgttggcattggaaccaaaatgggacgcaacaaatcagtgaa

SEQ ID NO: 69563 - DNA, 330 bp, Heterodera glycines
  Genomic contig location: Contig_ID=SeqID_41449; Location=655..984; Strand=+
  SCN-specific regions: Sequence locations=1-262,285-330
ccgggactcaaatgtcccgctcaggccaaaaaatttttctatttccgggaaaaaatcgaaatttttccgaaaaaaataccagtcgatagagctcgaaaaactatgttttggaagtggtctccgtttttctgggaaaattcgttaaaaaatcctaaaattcaaaaacccaaaaaccgttttttaggcctagctcgaaaaattttgaaaattttcgaaattttaaaatctgaaaaaatcgagcttattgaactctacaataagtctgctggccaccctgcgctcaggtcaaaccctaatgagttattcgcctggtactgaagtgggaaaaaa

SEQ ID NO: 69564 - DNA, 856 bp, Heterodera glycines
  misc_feature (577)..(577): n is a, c, g, or t
  misc_feature (788)..(788): n is a, c, g, or t
  misc_feature (803)..(803): n is a, c, g, or t
  misc_feature (812)..(812): n is a, c, g, or t
  Genomic contig location: Contig_ID=SeqID_41451; Location=53..908; Strand=-
  SCN-specific regions: Sequence locations=1-20,89-107,155-172,379 -420,455-489,563-677,701-732,788-812
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcnggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctanatttgccaagcccgntcccttggnctgtgggttcgctagatagtagatagggacagtgggaatctcgt

SEQ ID NO: 69565 - DNA, 2495 bp, Heterodera glycines
  Genomic contig location: Contig_ID=SeqID_8896; Location=545..3039; Strand=-
  SCN-specific regions: Sequence locations=1-629,652-1160,1193 -1204,1226-1228,1262-1480,1503-1534,1609-1856,1937-2194,2216 -2341,2371-2385
atggacaccgacatcgaaacgattgttcgcgggtgcagccaatgtcaacaagcagccaaacaatcacccaaacaagagccactccaaccttggccagcaacaacttcggttttcgaacgcattcacattgacctggctggtccatgcagtgatggcaacatttacctggtggtcatcgacacattttcgaaatggccagaagtttttcttctccgtcaatcatcgtcacaggccatcattgaccaacttcagtggttatttgatagggttggtattccaaaaacgattgtttcggacaatgggccccaattcctttcacaaaatttcaaaaatttttgtaccaggaattcaatcaagcacattttctcatctccgtaccacccgcaatcaaacggagcagctgaacggtatgtggatttcttcaaaagacaattgaagaaatgcaatggagataaggattggtttaaaaaaatcacttttgtcataccgttccaccccaattgcagtattgagtaacagatcaccgtcagaattgtttttgggtcgcaaattgcgcactcacatttcactcatgcgccctgatcaaagtcaaacacgcacaggaggaaacaatgccaacgcacacaaaatgaaaacacagtttgacagaaaattggagcaaaaaggattgagttcaaaataggcgatcaagtacagtttgttaattaccaaaacggtaaaacagtttggctttttggtaaaattgtggcaaagaatggattaattcttaaaattcaatccacataattagcacataagatcatcacacgtcacgcaaacgcagtgaggttatcggcagcaaatggcactgatcatgagtggtcaaccgacgaatgcaaccacaagaacggactgatcagatggatcaacaccaagaaacagaagaacaaacaccggaactgcgacgatcaaaaagaacaaccaagaaagttcgatttttgagtccaaggcccaccggccagcgacatgagatcagggatcgtgattaagatttttgtaagaggggaggtgttatattattgccatttcatattttcttggcattatgtttattgacacgtcaccactttcatcgcccataaataccgctctcttccctccttcctcgcttcggacttcattcattcattctcatctcatcatttgcatttcaccacacacacaatttgtctctcttttctcctctgacttatttattatttatttattattgattatatttgttgttattgataaacgacgcaacatattcagtgcgcaaaattttaggtatttacctaaaaaaggaagccctaataattatcaatttgcttcgaagcgcaatttgcattaagtatatttataatacaatccacggcttaagctgcaattctgctggcctttacatattgtttagttgatttttccttagaccctgacttttaacaatctttgattatacaataatttaataaaaattatttcactttttgtagtgtatttatggtaaattgggttattttaacaataataatttattaactttataaaacatatttttaaattttaattacttaaatttatatttttcgttttcgggtggttttttggtctgattttttggtcagttttttaatatttgagttttctctaaatacccaaaatttttaaaaaatgcttaaagacatgttgtcgtttgtaagtttaaatttacgacgaatcaatatcactggatagatacagttcaacggtgctagtgcgttttataaattccgccacccatgcacatatttttattttattaccatgcgcgttttataaatccgacagcatatatgattttaaaaaatcattataatattttatataagaaacattatgattatattaaaaatatttttttaattaataataaattgcataaagaggtaatggaaatacagaaatacaaggtttcagaacactaaatatgttttattttcctactaagatagtttaaataagaataaaataacaaattttatatgtataatggcatgctaatttatgttggcggatttataaaacgcgcaaacacattttggcggatttataaaacgcgcaaacacattttggcggatttataaaacgcgtcagcacgcactaatgaaaatatagttaatattctaattatatatttttcagctgtatttgtgtgatgatttattaagtgactaaatcttttatggatttaattagataaatcgaattaatagacctaatcaattattattggcagacttcttacaaagtttctaaagatttcgtaatttataataacatttgcttattgttttaattaaaattattttgcatttgaattggttgtattttttgtttaatataaaagtttaaatttttattatattgtttataaatatgaaaaatttgaaaattcaaaaaattatttattttgcatttttaactaaaaaaataaa

SEQ ID NO: 69566 - DNA, 887 bp, Heterodera glycines
  misc_feature (211)..(211): n is a, c, g, or t
  Genomic contig location: Contig_ID=SeqID_8897; Location=73..959; Strand=+
  SCN-specific regions: Sequence locations=1-401,424-461,494-798,854-887
atgattgaagcacttgaaaaagtgttcaaaaaagccggtatgatgcgtaacaaactgtaagtgaagcaggtttgagtttccaagcaaaacggatgattgaatgctggaagcaaaaggacataatcaaaaacataatgtacagtcctagcctgcattcgggtgtggttgaacgggcgaatcgaacactcaaggagcgcttatacaaatattntagcgaaaataacactctccagcttctataacctttaagaatgcttcggcgttaaaaaaactcctatataaagaacaagctgatgacaaggtaatcaaagtaaaggcaaaattcaaatttggcgatattgtaagaattagcaaagagaaaggacaaatttcaaaaggttactaacccaattttactgacgaacttttaaccaaaatcgtcaaatttcgtgtcttgggactcctaaaggttcttaacaattatttacggctgtttttacggttttcagtcactatttctcgattttaagcaactaataatctgttccttattcataaccggttagtttttgcctttcaataactgcaaaatagttcgttccattcgaatctacttgatgagtaaagcacaaaaaaacatattttctaagcatgttttcggtttgcgttgtgaagaaatttggaattttaaaagattatctgggatttttaggccgattcgcgtagtaatttcggaaagaaactaaaattttatgtagcataaaaatgaatcggaaaaatgtaccatcttatttaaacctactagtaaattctttaatgtataaatttattttttatagattttaaatagaaaaaaactattatttaaattattcggataaacatatatgtaaatataactgaaacca

SEQ ID NO: 69567 - DNA, 466 bp, Heterodera glycines
  Genomic contig location: Contig_ID=SeqID_41452; Location=320..785; Strand=+
  SCN-specific regions: Sequence locations=1-10,32-124,146-206,230-466
atgtttaattttttgaaattattattttatgagacagtatgtcattagaagccgaccggttactgtaatttgaaaaaaaatccaccggttcattcactgtcaataacttttagaataattttagaaatttcaacaaacattaatattgtaataatcaatcaggtgacagacggagtaaatcatgcgacaacaaatctgagtgttgaagttttggatgtgaatgacaatggaccacaatttgttcaaccttacatcgaaattgaacggtcaatggatgtgccaattgggcacattttaacaaaggttgaggccatcgacggggacatgtccaagcacaattcacaaattcgctacacattggaaagtgctgctgcttttcaaaatttgagcactgctgatttggattggctttcttgcggccaaaataatggtaattgaccgataatttaaaaaattttaaccgtca

SEQ ID NO: 69568 - DNA, 56 bp, Heterodera glycines; identical to SEQ ID NO: 52733
  Genomic contig location: Contig_ID=SeqID_41453; Location=807..862; Strand=+
  SCN-specific regions: Sequence locations=1-56

SEQ ID NO: 69569 - DNA, 659 bp, Heterodera glycines
  Genomic contig location: Contig_ID=SeqID_41453; Location=65..723; Strand=+
  SCN-specific regions: Sequence locations=1-659
aacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaac

SEQ ID NO: 69570 - DNA, 157 bp, Heterodera glycines
  Genomic contig location: Contig_ID=SeqID_41454; Location=758..914; Strand=-
  SCN-specific regions: Sequence locations=1-157
acattctgtccacgctgttcaccgcgtcaaaggcggtgacattggcagtcttttgggcgctttggccggcggcgcagatgtgaacgccaaggacacatcgagcggcaacactctgctgcaaatggccataatgacggggatcaccgaaattgtgaag

SEQ ID NO: 69571 - DNA, 326 bp, Heterodera glycines
  Genomic contig location: Contig_ID=SeqID_41458; Location=505..830; Strand=+
  SCN-specific regions: Sequence locations=1-253,277-326
  Gene Ontology: Mol. function=DNA binding; Cellular component=nucleus; Biological process=Malpighian tubule morphogenesis
atgcacaaatatcagcccgtcgtcagtcttttccgacttgtcgatcgtcaagcgatgcatttgtgctcatttgagccaccggaaacacaatttattgtaagtttctaatggctttatttgttgtgaaatggccaaattggcactaatgagcggggcgtggcgttgacttttaagagctaatagtgagaagtgttcattttaggctgtcaccgcctatcagtgcgaagcaatcactcgccttaaagtggagcacaatcctttcgccaaaggcttccgcgagggctcttcgcgcaagcggacgctttccccgtcgcccattttcgcag

SEQ ID NO: 69572 - DNA, 786 bp, Heterodera glycines
  Genomic contig location: Contig_ID=SeqID_41460; Location=24..809; Strand=-
  SCN-specific regions: Sequence locations=1-786
atgcacaaatacgtgtcgccgaccgtcctcttcgactggcgcagaaactttttccaaatcagcgccactggttttgcccgagagtccgaccacttacagcaattcgccggacttggtcgacacgtttactggtacaactgggctggcacacgcctcgccccgatgggtcgtccagtgggtattcaaattgagcaaatgggaaatcaggatggggaaaaatttcgtcaacgaattgatcacggtggtgtggggggggggggggtgttgtagatcaacggacgggattttacttttcctcgttgccttttaattgttctgatcacatttttccgttttttagtccttcactcgtgcggtcggcccggtcaagtacatggtgctcgcttcgttcgacgtcaactacacccggcgtgaacaaatggtgaacattcggacggaggaaaagctgacgctgtcgagcgatgtgcatcaaaggccggatggtggctttgtgtcatctgtgaagattctacgctgtccagcggtgttcacggaagcgaacgtgatgtcctggttgcgtctgccgcgtgtgtcgagcgaatggcatccgaatttggtgaccattggcttctcagatgacgaaattgggtatggacgagttgaacaaatttatgattcagtattcttatttccttcgttttcagaccgatgccttcgaacagaggaaccgatcgggctgagaactgagaaggataactgcggatcaacaacagctgagccctaagcacaatggccatgcggattaaa

SEQ ID NO: 69573 - DNA, 79 bp, Heterodera glycines
  Genomic contig location: Contig_ID=SeqID_8898; Location=3644..3722; Strand=+
  SCN-specific regions: Sequence locations=1-79
attcatttttagtgaaaaagtgcagttgttacccagcagtggaaaaaaagttattggttaaatagcaaaaaaaaaaaaa

SEQ ID NO: 69574 - DNA, 617 bp, Heterodera glycines
  Genomic contig location: Contig_ID=SeqID_41462; Location=161..777; Strand=+
  SCN-specific regions: Sequence locations=1-2,24-176,198-433,455 -562,589-617
atggtttattttttgaatttaaaaaccaattaaaaagtatagtaggcacaatttcattttcttccattctttttgtctatttgaatattttaaactatagaatttttttatttttggtcaatattgtagccatacattttttactaaaaaatgaaccatttttgcgattttgagccaattttttaagaaaaattgggaatttgggggccggcggtgccgataagcgccctcgggaaattttttccaacttcattaattagtataacaaatagtgccaagatttgtatattttgaaattgcaggtcccttggcattacactgttccaattggccaccggccgattcccctacgaatgtgtgaacaacgcaatggagttgatgatcaccatccacaacaatgacccgccgcgtcttgagcctaaccaagtgggatgcatttattggagaaaaaactaacaaattttcccccccataattttaggatggtcggcaattcagtgccgagttctgtcagttcattgccgactgtttgcagaaggacatgaacaagaggccgaagtacagggaattgcttgtaagttttagaaaaaatcggttttacattgtcattaacaaaa

SEQ ID NO: 69575 - DNA, 509 bp, Heterodera glycines
  Genomic contig location: Contig_ID=SeqID_41466; Location=268..776; Strand=-
  SCN-specific regions: Sequence locations=1-43,68-72,145-158,200 -222,268-509
atgggcataacaattataaaatgtaattattggattataaagtaaaaatatttttaatgaaacaaaataaaataatttttaaatttaatttaattaaattataattatcttcaatttattcaaatattttattattttatttaaaaaaaacatttctcaaaaaaataattttatattaataatttaatacataatatttgcgctttcaattaatgaacctgcattttaaaaacaaattaatattttatttaaaaaacattaaaaattctttctttttcagcgtactcagttgtcccgcgcttcatgaacacgagctgagttggcccatgaccgcctatgggcaaacggcacaggtggcatgcccgccgggcacatatggtcatgccgaatggcactgctcggccaagacgaagcggtggaacacggaggaggggccaaacatggccaaatgcacgtcggaatgggcacgagacttgcggcgtgaacataaggacgatgagacggggtga

SEQ ID NO: 69576 - DNA, 1378 bp, Heterodera glycines; identical to SEQ ID NO: 8900
  Genomic contig location: Contig_ID=SeqID_8900; Location=1..1378; Strand=+
  SCN-specific regions: Sequence locations=1-77,99-327,350-552,584 -746,769-1179,1201-1378
  Gene Ontology: Mol. function=glycine transporter activity; Cellular component=plasma membrane; Biological process=alanine transport

SEQ ID NO: 69577 - DNA, 1198 bp, Heterodera glycines
  Genomic contig location: Contig_ID=SeqID_8901; Location=330..1527; Strand=-
  SCN-specific regions: Sequence locations=1-115,137-314,336-574,596 -990,1012-1198
tcccacattattggagatcgcgaatgtcaagtgaaagtcccattttcaaaggtttgctttttaccccctccccccccccctctccctaaattatctcaaaatttaagaatgcgctttcctcaaaaatatttgttggtcgactccaagaaggagtcacgcccattgaattgaaaaaacgctttatggaagaagcgcaaaggatcgaccccgactcatcggtcaccgacgtttacattccgcgtcctttccgttccttcgctttcgttactttttcgacgcctatcgttgccaaggaattgattaagttggtaaaaaatccagttttcaatttaaatgtttttttagaattggccaggtcgacttcaaagacacctccgtcagcatttcttccgcccacagcactcgtccccaggactcgaccgttcactctgtccaccatcactcttcctttattccgccccacccacacaatttcgtccctgaagatgtaagaaaaaaagacgataatgtgtggtaattaattctttgttttttaggatagttattctacaagtgaactgtatagtaattatggcacaaacacaaaatgggaattcgatgaaatggcgtcgatggcaatgccaaagcatcagctgatcacatcgactcccggcattcagcaaagccgaaccgcgggcccaatgttttccggtcggttgtcatttctctctaatagaattgattggtcgacccttggaagtgaaatcacgcattttattttacacttttatccactcatctcaggttcagtacagcaacatttaaatcagccattctctgctcacaatcaacagcacccgccgattgcggctggtagtcaaatgctcaaccaattggagacactgaatctgaacaacattggcatgccacaggaagtcgtcaatgccgcgatcaaagtaattggtttaaataaacagtaatgctccatttatctcatcctaggccattgtcgcggctgctgcttcctccgctgcccattcgcacggcgatccctcccacagtcagcgcgcctcttcctcccatctctcacagcaacaatttgtgcgttatcagtcgctttcgccaccccaacccgctgtgccggcatcgtcagcgccaatgtctcgtagtccgatgtattcccaacaaatgacataccgacaacaaaacggccgaggag

SEQ ID NO: 69578 - DNA, 533 bp, Heterodera glycines
  Genomic contig location: Contig_ID=SeqID_8902; Location=48..580; Strand=-
  SCN-specific regions: Sequence locations=1-9,80-344,366-533
atggacagacgaagcggagcgaaaaacgaggcgatgcgaagcggggtcacgaagcgacagcagggcgcgacaaagcaaaaacgaatgatgggcaaagaggcgccggtggggacgccctccgcggtagggacggctcaacgcgagcgagaggaggaagacacaaccggacgaattgtcgacctattggtcatgggattgccattcgagctgagcgaagaacagctccgtgcgcactttgagtcgtttggtaaagtggtccattgcgaggtctgttctttctctacgtaccatttagtgaacatgaaaatgcattgggtctcaattttttgcctctgcacaataaattgcatttgtttgtgaggctgattttgttattctatataaaggacataagagagttctgctcacaaacccttttacattaaaatttttttatttagatcaaaacccaaaagggccatctgtccaatcgaggcttcggtttcatccaaatggccgatttggaggcacagaagcgagtgctcaaacacaaa

SEQ ID NO: 69579 - DNA, 968 bp, Heterodera glycines
  Genomic contig location: Contig_ID=SeqID_41472; Location=269..1236; Strand=+
  SCN-specific regions: Sequence locations=1-562,584-709,731-769,793-968
aaggtctttgcccgctcgttctgcccaccccgtcgtgctgttccgttgtgatcgtgcggaaccgatgttcaaccccgagttcccgctggacaagtacgagttggacagcacgtctccgcttgtccaaaacatgctcagccgacgggagcccaacctttgctggcaggtcatcacaattttggcccaaaaggggggggggggaagggcgggtgaatttcaacagcgataaacttaacatttttttggcatttttgtattgcgtctgtaaaataaaaataatacgaaggcaaaattcttgtgcgttttcatgtttataatgaaaagtttcaattttttgcatccgaatttgagtgcatttccttaccattttcaggtgttcgtcgaggggtccttcaaacagccgggaattgggcttccgtttggctatttgaaggtaaaaatacccatggaactgtgattaataattgcctagttaattcaaatccctaatccgaaggtttcggttttttaaattactatagcttacaattaggtattaggcgtttaatgaatagagatgccagatttatggttttatgatcagagtgatcccaaaaactctccgagaacaaattttgatgaccggacatcatcataaaacaattattgcaaaccaaaagagtggatttaatgattttcaaaaagcgcaaattttcaagtaatgccaacttttttaaaaatttattcccggctgtgttttgtcctattctgtcatttcttaccgtcctcccattttttaaaaattcatttcccccgttttcaaggtgtcctcctcctccaccgtcaatctgctggtgatgccttacaattaccccgaccttctcacgctgttggcccaggccaaagaagggcccgaaatgatcgccagcgtccccttccaacaacgctttgacaaatatttgaacaccgtcccgccctattattacacg

SEQ ID NO: 69580 - DNA, 330 bp, Heterodera glycines
  Genomic contig location: Contig_ID=SeqID_41474; Location=87..416; Strand=+
  SCN-specific regions: Sequence locations=1-330
agcgaaaattcacgctgatcagtgaccccgaaaagcttgtggtcatttttgtggacggaccagccgaaacgtcagatgatttgccggaagattggattcacctttggaatgaagcagctttaaaggtaagaaagaagcgttttaatccaattaaaagcttaatctaaatttaccaattcatgatttcgcatagctctctctctattcaagaatttgaggtcgagaaaattttcatttttatattagctttgtgattatattaatttttttgtaattatcagagcccggaattgggatttggtactgtaacggggtgttggatctgacgta

SEQ ID NO: 69581 - DNA, 535 bp, Heterodera glycines
  misc_feature (13)..(13): n is a, c, g, or t
  misc_feature (16)..(16): n is a, c, g, or t
  Genomic contig location: Contig_ID=SeqID_41475; Location=316..850; Strand=+
  SCN-specific regions: Sequence locations=1-117,139-143,165-245,267 -311,351-362,384-439,461-505,527-535
atggagaaagagnctnaagtatttaatttttttaaacagaactggtggaaactgaaaaaggtcgaaccaaatgcaaatgccgccggtgtttccgattcgttttccaaagatgccgaagaagaggaggacaaagacaaggaagaggcggtgaaggaaatgccggggcagcccaaaaaggtgggaaagagaagcaaacggagaaagagcctcaagcatttaatttttttaaacagaactggtggaaactgaaaaaggccgaaccaaatgcaaatgccgccggtgtttccgattcgttttccaaagatgccaacgaagaggaggacaaagacaaggaagaggcggcccaggaaatgccggggcagcccaaaaaggtgggaaagggaagcaaacggagaaagagcctcaagcatttaatttttttaaacagaactggtggaaactgaaaaaggccgaaccaaatgcaaatgccgccggtgtttccgattcgttttccaaagatgccgaagaagaggaggacaaagacaaggaagaggcg

SEQ ID NO: 69582 - DNA, 522 bp, Heterodera glycines
  Genomic contig location: Contig_ID=SeqID_41476; Location=215..736; Strand=-
  SCN-specific regions: Sequence locations=1-142,249-321,511-522
  Gene Ontology: Biological process=N-linked glycosylation
atgtcgggacgcaaatgtccgaaaatggcccttaagaaatgggccgcaaatgtccgaggcgcaaatgtcgggccgcaaaagacggaccgcaattgtcgtttttggctggtggccgcaaatgtcgtgacacgaaatcaacaacagaaaaaggaaacagcgaagggggaggagaaggaagagaaaatggggggaaaagagagaaaaagggaggagaaaaaggagcagcaactgaagaagaggaaaaagaaaattgcagctgaacaccatcagaaacaacaacatcagcagaagcaagaacattggaaggaggagagacggaagagaaagagagtaaaatggaggagaaaaaggagcagcaactgaagaagaggaaaaagaaaattgcagctgaacaccagcagaaacaacaacatcagcagaagcaagaacattggaaggaggagagacggaagagaaagagagaaaaatggaggagaaaaaggagcagcaactgaagaagaggaaaaagaaaattgcagctga

SEQ ID NO: 69583 - DNA, 1029 bp, Heterodera glycines
  Genomic contig location: Contig_ID=SeqID_41477; Location=1..1029; Strand=-
  SCN-specific regions: Sequence locations=1-883,905-962,984-1029
  Gene Ontology: Mol. function=protein C-terminus binding; Cellular component=membrane; Biological process=endosome transport
ccattaccattccatgccatcaaacagtgaacgccaacggggagcaattcaccgcctattccattcacatggccggaaggcatctcggctcacgacggtacagcgaatttctgcagctgaacaaattgctcaaggaagaattccccgactttccgtttccgaaattgccacggaaatggccatttcgtcactcggagcagcagttggacagcagaagacgcatgttggagcagtacttggagaaagtgtgcgcagtgaaagtgattgccgagagtgacactgtgcaggtgccgtggcactgcttttccgacttctttcccaatgcctttcaggagtttctgatggaggattccggcggtgctttgtcagctccgttcgtcgacgtttcgttgcgcgtcattgtctgtggcaacactctttcgttgaacatcaaaaggcacagcgacacgcgcgaagtgttcggcagagtgtgcgaggagttgaagttggggacggaggcggcgcatttttgcgcattgtttgaagtgatcgaggtgaaaaatcatccaagaattgtcaaaagcatggctaaaacgagactttttaacacaaatacccaatttggggcgctaaaattctttgaaatcgcttaaactttttcttatatgcttgttcaaatggtatattaaactagaaaattccccagaacgccgaatgtgtctgattttaaggattcattcgcacgtaaattgcacgaccgcgagtgtccccacaacatttatatacaaaattactcttcggctgcttcttcttgcctggccatgcgcaaattttgtttcgacgttgagaaggaaaagcagttatgcgagaaggacaaattgtttcgtagcatttgtaagtttgggaatgagggacatattttcaatttcactgttttatgatcaatttaaaatctttaggcttctatcaagccgttgaggacgttaataatggcataataaagggcggcgagcgattgtaccaattaaagcactgcaaagggacgacgat

SEQ ID NO: 69584 - DNA, 154 bp, Heterodera glycines
  Genomic contig location: Contig_ID=SeqID_41478; Location=694..847; Strand=+
  SCN-specific regions: Sequence locations=1-91,132-154
atggaattggtattgaaaatcaccaaactggagcttaaaaatgtgagtgttatttaaagtgtcatttttttgaaaattaaatgggaattgctaattaattttgaaaaaaaataaattttttaatattaaatgattttagaagggactccaataa

SEQ ID NO: 69585 - DNA, 523 bp, Heterodera glycines
  Genomic contig location: Contig_ID=SeqID_41478; Location=984..1506; Strand=-
  SCN-specific regions: Sequence locations=1-451,473-523
ttgaattcaatcgattcatatggtctgttgcccgaggcaattgcgattggtgacgatttggcacacaccgagaaaagatggccaacccaagcgattgtgttgcacacttttgaacgacaagtgtacttcgattgggtcaacaatttcaagaaggtatggtcccatatttttttgcatattactgattttgactacttctatttttattttccaaattgtttagcaatttctccgtgccaatgccatttcttccgtcagttaccaaattcattttactgttcatgcgccatcaattgtgacatttgaattggtgaacgaatggacaaaggaaaagctgacattggccaaagcaaaggaattggacaaccgatggataatgaaacgatgcaaaattggggaggccgtgacggttcagcagcagaagaacgatgaaaattgggataacaattggtgttctttttgctttttagtggcactaattgtgttgggatcttcggaaaatccttaacaaaaatgcaataaa

SEQ ID NO: 69586 - DNA, 789 bp, Heterodera glycines
  Genomic contig location: Contig_ID=SeqID_41480; Location=1..789; Strand=-
  SCN-specific regions: Sequence locations=1-325,347-737,759-789
ggcaggacaagaaaagaatgaagttgatacctcatgaaactcggaattggttatgtttagtcgaaaatatccttacataatactcataaaaaatacaaataattcaacccacctattctatgcccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaaaaaaatggctaatatgtaaaattggcgtcttgaaatttttagactaatccgaagcaaagcacgaatgaattaaagaggcgaaagaattcacagtatcgtttctaatagggaaatattgacaggatattcggctaaaaacgggtttgatcag

SEQ ID NO: 69587 - DNA, 1375 bp, Heterodera glycines
  Genomic contig location: Contig_ID=SeqID_8903; Location=152..1526; Strand=+
  SCN-specific regions: Sequence locations=1-268,313-427,449-822,851 -1073,1104-1128,1151-1251,1339-1375
atggcatttttgcattttctcacgccttgtggccattttggtaggtaaaatgggaatgaaagggcaataaaagtgagtgggcacatcgcagaacagaaaatttatgcgtggtttggtttaacatttaaatgcgttaatataattatcagggctcgcaagttgaaacaatattttattagcctaaaaaccagggctgctaattgaaacttttcaaaatagcatttggccaataggaaaatcatcatttggcgtcaaaatcagcattttgataatttaattcaaaatgaaaaaataattgaaaatttttttttacggcgcgctttttccaaaaaacttttggtgaatgggggggggggggtgtccggcggtgccgatagatgccgccgggaaaattttcgaaaacttgaatgcaatttgttaaaagattttcaccaaaaatgaccaatttttgagattttgagccaattttgaggaaagatagacattttgactattttttaacagattttctctgaaattttggttattttacactcaagaaaatgaaataatctcttaattcttttcaaaaacgaattaattcaaatattcgcttcaataaaaatagtcaaataggtcattcaaattttgcatttttttattttcaaatccaaaaataagcacaaaataagcacgtaacgctgaaataagcacaaatcttagaaataagcacacttgcaagccctgtattataatcaacccttaattgtttatttccgattatttttgtttaattgttaaccaattaacagaaagaattcccgtcaaaaatgaattttcatctaaaatataaattataatttttttaatacaatacaatttgtcagtgctcacttgccttttcgtcagtttgggcttagttttcgtgcccaaattgctgttcatttaccactggcccgaacttaccaaggaggagcaacagcaaagcacgcagcgccaattgttggaggtgtcagcgccgaaccgtagcgaacagctacggtatcagcaactgttaaaggaaaatgcggagataaaacgtcaaattgaattggtaaaaaataaaaaaataattctatatattagtacactttccaatatttgaaatttaaatcaaaaaattttcaattttcagaggaaccttcgaattcaagaatgtcgtcggattttggagggacatatcacattgataaatccgctgaacaaagcaaaaaattcgacggtacgcagaagacaaaagcagcaacagaacaacaacaacaacaatgccaacttaggcaacaataaaaatgccaataataataatgataattataaaaatggaagcgaaagaggcaaacgaagcgacaaaaagtga

SEQ ID NO: 69588 - DNA, 483 bp, Heterodera glycines
  Genomic contig location: Contig_ID=SeqID_8903; Location=1653..2135; Strand=+
  SCN-specific regions: Sequence locations=1-285,307-362,390-483
atggacccgaccacgaccattacgttgctggagcccacaacaaccgcgtcgggtggcgaggaattcgatgaagcaccacccaattacacaactgaagaatcggaaggtggaggaatagctggagaaaatgtggtggaattcgcatcgccgccacgcattgggaagggcaacgccgggggcgaacagagggcaatcgcacggcacgcggaccgacccccggtggaggcggaggaagagcgggagaggggtggaagagcggcgacgcgaggcggagaagacacaggcgggacaaaaattgggggcaaatggaatgggaaaatgggacaaaagtgcctttttgtaattccaggagtgtgcagcgattatgaagaggaagaagatgaagcggacggagaaggaagcggggagaaggtcgaactgatgtcgacagagtccgacgacgccaattggccaaatggcgatgaggaagaaatactgctttaa

SEQ ID NO: 69589 - DNA, 657 bp, Heterodera glycines
  Genomic contig location: Contig_ID=SeqID_8903; Location=2176..2832; Strand=-
  SCN-specific regions: Sequence locations=1-9,51-469,514-627
atgctttcgccaatgcttctcctcctcctcccgctgcttctcctctctctgatgcccaacattttgtccgaggcgcggccccaatggcttttcgggtccgggtcgtacgccgacgcgatgaccagcggcaccattttggacaatttgtggtggggccgcaaatgaaggaacggatggacggaagaagaggacaattaagggcgataagcactgaatgaatgacacgataatacattaatatataaacaattactgattatgtttatttaaaatatcgaattttaaaaaactccaaaaaactttagtaagttgttgagcttatttaaattaatatttgcaacaattacaatatattaaaagagtttatgaaacttttattgttgataatattggcaaaaaaacggcgtataaattgcatataaaatatatctattataaatctctattatttattaggttggcaaacaacattaaaataaaaattttatttaaaataaatagataaatatttttgcagcgttttggtagtttttaggaaactcttatttgatttgtgttatggacaactaagaaaagcgaaatgatgagatgttattttttgcttgcagaagaattctagtaatttctctttagaaaatttgaattttttaaattaaa

SEQ ID NO: 69590 - DNA, 1137 bp, Heterodera glycines
  Genomic contig location: Contig_ID=SeqID_41483; Location=93..1229; Strand=+
  SCN-specific regions: Sequence locations=1-623,647-688,710-739,761 -942,964-1137
  Gene Ontology: Mol. function=G-protein coupled receptor activity; Cellular component=integral to plasma membrane; Biological process=G- protein coupled receptor protein signaling pathway
ggggatcagcagcagcaaaactgcgaacagttggtcacgcttttcgaggggatgaacaagttcttccgggaggaggcgatcatccagggctcggaacattcgtccgttttggtcagtcgtcccaaatggatttttgagttttccgagttcagtttggcattttgattctgtccgcctatattttggtcatcgcttttggcgccgttggcaatattttgactatttttgtggttcttcgcaacaaacagatggtctatttcatggcaattttcaattattccgtacaaatttgactttcagcgatcagtgcgcaactttttcattctcaatttggccatgtccgatttttttgtgtgcacagtgaccggtgggatttttttttagaaattttcgcttcccccgggcgattaaccattaaatgctgattggtatcggtcagctgctgctgatcagtccgtgatcaatcagaaactactctttcagcacccaccactttgtacaccgttctctacgtgttttggccctttgggacgacgttgtgcaaaattgcgggtagtctccagggattcaacatttttctctcaactttttcaatcactgcaattgctctcgacaggtgaaattttatcattgtctttctctaaataaatattccgatcaactctgatcactcttcaattttaaacaattgatttactttccatttgatcatatttttcaattttacacatactttggatcataaaagggaagaagctttggttggacggttaaaagccataaggcggggttgaaaagactcattaggagagatggctaatgcgtcttcagtcggcgggagagatcccacgacctccgccggtgcggcgattgctctcacccaaaagcaatgccatggccttccatctctcttaggtctctaatgagcattttaaaaccctaaaaaggtattttctcgtcattttcccgacacggcatcagtgtcagcaacgcctttcgctgctgttcttttcaatgatttggttggcctccgttctgttggccgcccctttgtttcttgcggccgacttgcgacccgttttccagcaaaaaagctgccaaatcgaattgaatctgtgcagtgagcagaacgaacgg

SEQ ID NO: 69591 - DNA, 58 bp, Heterodera glycines
  Genomic contig location: Contig_ID=SeqID_41486; Location=23..80; Strand=-
  SCN-specific regions: Sequence locations=1-58
aaacaaatttaaaaaccggtcgcgaagcgcccgcccaagcccaacaaaatttgaaaaa

SEQ ID NO: 69592 - DNA, 136 bp, Heterodera glycines
  Genomic contig location: Contig_ID=SeqID_41488; Location=409..544; Strand=-
  SCN-specific regions: Sequence locations=1-136
atgcacattgcgccattggagttacatccattggcacgcctggttcagggtcgttaccataaaatgcactgcttgtgcgttgcttcgtgggatcatgtacttgtacgtgttcttacgttacttgctcagctcggct

SEQ ID NO: 69593 - DNA, 68 bp, Heterodera glycines
  Genomic contig location: Contig_ID=SeqID_41488; Location=1268..1335; Strand=+
  SCN-specific regions: Sequence locations=1-68
tgttacgacttttgcccggttcaagccactgcgattaaatcggttccagtctgcataccgaccgaagc

SEQ ID NO: 69594 - DNA, 999 bp, Heterodera glycines
  Genomic contig location: Contig_ID=SeqID_8906; Location=1260..2258; Strand=-
  SCN-specific regions: Sequence locations=1-481,510-628,650-654,676 -722,762-854,877-999
atggttcaagaggtttggaattctgatagaagaggacggaaaggatttgctgagccagcgaaagttaggcttttgcttggaaaactctctgacgaagagtataacaagtacagggacagcattagaccaacgcaaccggacacagtcaattggaaagagtccattgacaaattgaagggtttgttttccgaaacccggtcattatttgtccgccggtatgaatgtttccggattcgtcaacagccaaatctgatcaccatgacatgagacaaaaatgtttgaaaatgttggaggaggcagagaaaagtggcgcacggatttcgctcggacaaattgaagaagagttgaaaaccatgcagcttatcaaggacagtgcattggctctcctttcgcctccgatatcaacaaatgccatccaactttgcccacaacaatggatagagcccaaatcaaagaaaggaaattacaattctggcaaaacgacagcaaaccagcacacaacgggaggcaaagcaaatcaaagaaatccgacctatccatgcggtgcttgtggcaattccgatcattggcgatcagattgcaaacaaagtggcaggacattggttgaacgtcggactgaatcgcggtcaaattcttttagtttataaattaccgttcaataacacaaaatcaaattttataggcagctttcaataagtataatccaattgtgttttgtctatttttctctgtaattctaaaaattaagtttgttttttaaagcaaaaattctgattacatgttttcgttaggtatgttataacttacggccttttcttgtttgttctcacccttttttggttttttacttatggaccatgtgatggctggccccttgctttcgttgatccattttgtgctacaaacttttccacaaaaattacagtccgcttcatttggtttatttttttataaaattccaaacatatgaagtcatatcttaatagcaaagataataaa

SEQ ID NO: 69595 - DNA, 211 bp, Heterodera glycines
  Genomic contig location: Contig_ID=SeqID_41497; Location=827..1037; Strand=-
  SCN-specific regions: Sequence locations=1-211
atgttgcccaattcgtcgtcaattctgctgttgcacaaccttcgaaaacagtcggtcaacgcgcttccgcttggtcgtcaagcagtgcacaacgatgtccaattccccaactttgacgcgtatcgcaacgaattgaccaaagacccagcgcaaccgtctcatgtgactgaggacaggcgcaaaggcgtgtcaagcttcatcttttatggag

SEQ ID NO: 69596 - DNA, 486 bp, Heterodera glycines
  Genomic contig location: Contig_ID=SeqID_41498; Location=199..684; Strand=-
  SCN-specific regions: Sequence locations=1-199,221-299,323-486
atgccaaagtcgtcgctgtcgttcagtcattgcagaatcacaatgccggccttggctttacttattccgctgtcactgatcgcagtgagtaatgcgaggtcagtcggtcattctcccctttcccctccattcatttttgattttggcagagtgttcacttccatggccgacttgctggacgagcagcaccaccagcagttgcacctgcccctgtggagatcggcctcggggctggcgccaagtttcagtccgttccgttcgcccccagcggccgctctttctgctgaaccaactgacgacgaagcggaagagacggaggaggacagcccaatttcagtgccggcgactgcatccggcgaagccaaacagaagcgaaggcttgtcgtccgagtgccatttgcgcagaacccggacaatcttcacctgagccgtaagtggtcgaaggaaaacccaattcaattagcaaaatggttgactggctattaa

SEQ ID NO: 69597 - DNA, 56 bp, Heterodera glycines; identical to SEQ ID NO: 52733
  Genomic contig location: Contig_ID=SeqID_41500; Location=591..646; Strand=+
  SCN-specific regions: Sequence locations=1-56

SEQ ID NO: 69598 - DNA, 1696 bp, Heterodera glycines
  Genomic contig location: Contig_ID=SeqID_8907; Location=653..2348; Strand=+
  SCN-specific regions: Sequence locations=1-311,333-630,663-854,878 -1272,1295-1696
atgatgagggcaaagaaagttggtgcaagaatttcaataatgatcattaacaaccatgaaaatgatcaggaatcaaagggcatcgccaaagtgtccgaccttttgatcgagtcgactcggatcatcgccagagggtgggccaaaataaaaatgagaaaacatttaaatgattaagagacaaattaccgaatggagtgaaacttccaaatttggatagtggtaagtaagtgttcacaaaaatgatgaatttcatcatttcattggcatttaaattgaatattccatctttggcactgaaatttttttatgtgtcaaatttctcatctttcaaacattgaaaagaatcgttgcaacggcttttgcccgaaattgacgtgtcgtcctttgttgccaatttcaccgcttttctcagcgaagacggaagtgccacgacggaggagtaagtgaagaattaagaatcaaaaagcagcaaattttaatcattgtttatgttactattatttgtaaggttcagacagggcctgggatccggcaaaacgcattggttttataatggaaactctggccgagtttcatttatgggaaaaacataattcctttgcatttttatacattcaactaatcaaaccatttgtattttaattattattgtgttctaattcgtggtatatttgagagataacaataaattgaatcgtccgaaatttttttgaaatttgcccgggcctccctgagcatgggtttacccctttgtttccataatttaacctctaaaaatgattgttttttctttccatcgtcagatgtcttccgcgaatgctcccatgcgaccatttaagcaggtttttgaactcaaaataaaggaaaaacagaaaatgggggcaattgaaacattaagatttcgttcattctccggatggtgcaacaatctcaagtaataagcaaattattaccaaatttgctaattatacaaataatttagacacccattttatggcaattcgttcactcccttgcgccatttgttgccgccggtttatgacgacggtgagacatttaaaatcatattaaaagactaagtagggtaatttgtgacacaatttttaactccatggctaacgaataccgattgttttaattatactaattgaattaattacttttcaggttttgatgcaccgcggaatcgtgccaaaagtggtcagtctcaatttattgggatggagttacgccattcttttatcattggggaataaccaacaaatgtgatcattgatttgaacaaagcaaaaaattaataataatcagttggatgatcaatcatcgggagtctcgagatcaatcaattcttagtataaacaatgattttgattagttatcagtggggggggcatatttaaattttaaaaaacgacgaaaaatatgtaccattttagccaaaaagttgctacgtttttcaggcgttccgttgccctccccccggcgcatttccaacgcggtgcacgtcgaccgcgacttcagccatgccaagttcacacacatggtcatgcagttcggccaactgttggaccacgaactgacccactcgcccatccaccggggaccaaacgacgaaattctgaactgcacgcggtgcgactcgcacgagacaatttcagtgcattgcatgccgatcagagtggagcgcggcgatccg

SEQ ID NO: 69599 - DNA, 437 bp, Heterodera glycines
  Genomic contig location: Contig_ID=SeqID_41502; Location=509..945; Strand=-
  SCN-specific regions: Sequence locations=1-437
aaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 69600 - DNA, 1010 bp, Heterodera glycines
  Genomic contig location: Contig_ID=SeqID_41505; Location=83..1092; Strand=-
  SCN-specific regions: Sequence locations=1-140,198-300,385-414,448 -1010
  Gene Ontology: Cellular component=extracellular space
gcgtgcacggggctatgaagtttttgagcacaaaagttttgctgggcgattggtcccggggccgagcttatgcccgcgacattctcaacgatttgcgcaattgggtggtcggatggactgactggaatatgtgtaaaaccattttttaaaaatatataaaaataataattttaatttaattttttaaattaaattttcaaggtttggatttggagggcgggcccaatttggcacggaattttgttgactctccggtaagaaaaacattaagtcgaatttatgcgtgtataaaggagaaggattttttaattttcatacaaaaaatagattaaataattttaaataaaaatgaaaatatattatttatcaaaaattaaaatatttctatgagcgtaaaaaggaaaatattttccgtattattaaattataaaaaaaattgttttatttgtcgaaatttttcgaatttacgaagaggggtaagggttacggactgggcaacctatacggggtacggacttacgggtttgatagatccataggccatgtcgaacaaatagcagatacggacttacaggtgctaaaaaactcgagtctgtgccgaaaaaatacgggttgcgcgcccgtaaaaacccatatacggacggacggtccgacctgtattcgaactccaattattaggtggtgctcgagagtctcccgtttttttttttttttgtttttgcgtcttaactcgggaaagtctgtcgaaatttttggggccaccagtctcgagagtttgaatgtggggaattttggtctcgagcatcactatatatagtaattaaatcattaatgaatgtttgattcccccataccgtaatccaaaaagacacatcgggttactgtagcgccggtccatttttcaatttgtaattggcacactattgttttttttttttgcagatcattgtgaatgccagagctggcgagttctacaagcagccaatgttttatgcgatgggacattttag

SEQ ID NO: 69601 - DNA, 375 bp, Heterodera glycines
  Genomic contig location: Contig_ID=SeqID_41506; Location=344..718; Strand=+
  SCN-specific regions: Sequence locations=1-375
atggaaaaaaggaaatatccaaataatttaatgaattattgctgggggaggggaccaaaaaacaaaacgaaaattaacaacaaaaaggaggtggtcagttcaaaagtggagaaaaaggggaaggtgagttagattttaccagcaaatttataattaaatatgcaatacagcccaaacgcagcagtctgatcattctgaagagagagaaacattgggagaatggaaggagaaagacaatgatggatgtgttgcgacgaaattggcaaattatgatgcaccaaagtccaaaggatacgacttagtgaaaaacgtcaatttgcttgctaatgactttggtgcataatttgacaaagagagaatggcgaaagaggagga

SEQ ID NO: 69602 - DNA, 94 bp, Heterodera glycines
  Genomic contig location: Contig_ID=SeqID_41510; Location=175..268; Strand=+
  SCN-specific regions: Sequence locations=1-94
caaaacgacggacgaccaacagcagcagcagatggacacggcactgacaatgatgagagggaattgcggctcacaaacaatcggacggatgtga

SEQ ID NO: 69603 - DNA, 242 bp, Heterodera glycines
  Genomic contig location: Contig_ID=SeqID_41511; Location=409..650; Strand=-
  SCN-specific regions: Sequence locations=1-242
gaaagggtccgtgcgtttcgtgtcagcaaagcgaagaagtcaaccgccagttgatggccgcgcttctgaaggaccttggaacttcgctcgtcaatttcgccgcgaaattggagcagccgtcgaaatgattggacaaatcgaaggacgaaaaagtgacgaagcgaaagacggaccgactaaagacccatttattaactgtgttcagttcctatctaaagtccttatcaattttatcataatac

SEQ ID NO: 69604 - DNA, 444 bp, Heterodera glycines
  Genomic contig location: Contig_ID=SeqID_8909; Location=1095..1538; Strand=-
  SCN-specific regions: Sequence locations=1-444
atgcccaggtatcctcaaacttgaggtgtcaaaccgctttgttataaaaataattaaggaagcatttcatcttacattgcgaagaaaattccaaaatatgcatcctccattatcaaagtaactattgaattttaaaaaataagacacaaagtacacatttttagattaattttagttttgaaagaggaagaaagaattgctcaagacaaagttaggacttatgagttggacccaacaagcggtttgaatttgcaacctaggcgaaggacatactataataatgatgtggccatacgcactcttgtcactagatttgatgcacttgcaaaccccgaaccagaccaaattgtgcatcacttaagagcccttcaatatcgcttagcatccaatggatttgacaatttaatccatgaataatgattttatattttatcgattaataaa

SEQ ID NO: 69605 - DNA, 1180 bp, Heterodera glycines
  Genomic contig location: Contig_ID=SeqID_8909; Location=1577..2756; Strand=+
  SCN-specific regions: Sequence locations=1-286,328-446,481-853,884 -948,970-1180
atgattccaactcaagacgaatttcgcgttgaagatttgttcaaaaaaatcgcttcttatatggaccgtgagtcacttaaggaaatatgttttttcggtaataattgtataggaaatataaatatagaatagctattaagggaccgatggacaaataaaaagagcaaaatctgacaagcatggactgacaacattgtttttatatgccattcaaaatgacaaaaaacttgacctacttgagtgtctctgattatatttaaattgccagttgggcctttggcaagccattaataaatttaaaatattaattaatcaaaaaatttatttgcttttttttgtttgtttgtgtgcgctttttaagttagtgtgtctacggttgggccgaaacacacgtaattagttgctttttaaccggaagagaccgtactgacgaggcccactcttccaaaaaattttcttaaaaaataatttttttttattcagaaaccgtccgcaaatgtccctccgcaaatgtccgtccgcaaatgtccgtccgcaaatgtccgtccgcaaaagtccgtccgcaaatgtccgtccgcaaatgtccgtccgcaaatgtccgtccgcaaatgtccgtccgcaaaagtccgtccgcaaatgtccgtccgcaaatgtccgtccgcaaatgtctggtagccaaaaaaagagacgccgtttttcgatgagaaagatttgttggatgtgaggtgaggataggagagcgaacattgccaacaaccaacataaattttatttacatacattgatttattttttggtgctggttctatcacgaaaatgcaaaaatatttacaatacaccaggggtgtgatctgtcctgatttatcagatttgtcttgatttgaagggtccaaatctgataaaataataatgtcctgatttgtttgatttttccggcggcacctatcggcaccgccggaccccctcctctcacccatttgtctaaagttattttagaaaaatgcgccgcaaaaaattatttaaaatctgattttttgatcacgaatgcattaaaatttacgatttgctaatcccaaaattgttaattaatgggagatgaaaaaatattatttgataaattgtaaaaataattgatttgtaagcaatttcgcaaaatgtctgatttaaaattgttattaaa

SEQ ID NO: 69606 - DNA, 444 bp, Heterodera glycines
  Genomic contig location: Contig_ID=SeqID_8909; Location=2879..3322; Strand=-
  SCN-specific regions: Sequence locations=1-444
atgcccaggtatcctcaaacttgaggtgtcaaaccgctttgttataaaaataattaaggaagcatttcatcttacattgcgaagaaaattccaaaatatgcatcctccattatcaaagtaactattgaattttaaaaaataagacacaaagtacacatttttagattaattttagttttgaaagaggaagaaagaattgctcaagacaaagttaggacttatgagttggacccaacaagcggtttgaatttgcaacctaggcgaaggacatactataataatgatgtggccatacgcactcttgtcactagatttgatgcactcgcaaaccccgaaccagaccaaattgtgcatcacttaagagcccttcaatatcgcttagcatccaatggatttgacaatttaatccatgaataatgattttatattttatcgattaataaa

SEQ ID NO: 69607 - DNA, 310 bp, Heterodera glycines
  Genomic contig location: Contig_ID=SeqID_41512; Location=417..726; Strand=-
  SCN-specific regions: Sequence locations=1-310
ataactcgattaggctttgacctgagcgcggggtggccggcgagacctattgtgaggagctcgatggagctcgatttttgcgatttttaaaaatttcgaaaattttcaaaatttttcgagctaggcctaaaaaacggttttcgggtttttgaattttaggattttttaacgatttttcccagaaaaacgaagaccacttccaagcaacagtttttcgagctctatcgactggtatttttttcggaaaaatttcgattttttcccggaaatagaaaaaatttttggcctgagcgggacatttgagtcccgg

SEQ ID NO: 69608 - DNA, 661 bp, Heterodera glycines
  Genomic contig location: Contig_ID=SeqID_41515; Location=506..1166; Strand=+
  SCN-specific regions: Sequence locations=23-57,79-87,124-218,242 -351,374-399,421-661
  Gene Ontology: Mol. function=heat shock protein activity; Biological process=response to heat
atgggcaaggactactataaaatccttggcttatccaagggagcctcggaggacgacataaaaaaggcatatcggaaaatggcgctaaaataccatccggacaaaaacaaagaggcaggggccgagaataggtttaaggtactcttttgcttttcaccaaatgcagttttaaataaactaatccgttttttatgatgtggcggaagcatatgatgtgttgtcagaccctaagaagaaggaaatttacgacaaatttggcgaggaaggtctgaaggctgatggtgctgctgggcagggagcgcctggtcgtgcgggcggataccattacacattccagtgggtttaatcttctttattttgattttctattaaacattgtggtctaacagtcactaatcgttttttaataaaataaaaaaacatgttgaattctttgagattgcatgaaacgccttaaacagtctgtctttattaatctcctgcaatagttgccagttatatacatgaaaaatctctaaacaaagttcacttccaattttgttctaccattttcaggggtgatccgatgcaaatgttcgcgcaagcattcggtggaccaaacggaatgttcagcgagttcacttttggtggtggtggtggtggaccggaggtcgaaaaatga

SEQ ID NO: 69609 - DNA, 526 bp, Heterodera glycines
  Genomic contig location: Contig_ID=SeqID_41516; Location=97..622; Strand=-
  SCN-specific regions: Sequence locations=1-145,169-234,257-383,420-526
atggccatgacgtttgtcgtgcgttcttctgcgtagcgagtaattaaaaaaattattcaaaaagattagtgatgaacgatgctttagaaatttactggccaaattaaccctaaccatcaatcggaaactgcttcttacattgacattagcagttttagtttatattttgccgattttctgtcatacgtattgattgggctgatcatttggacacgatcaacacaaagtcttgccttttattaaaaccaaattttaacgagtttttggcattgacgcattaaataatgtaaatttaaataattagtttcggcacaaacgaaaaaattgaattttctgtcagttttctcatggcaagtgaactcatctgctttattttggtcagcatattaaatgtttaataattaaacttaaatattaatcatttcagaatacactctttgctcgtttcatatttccattgctcaattttgacgcatttgcaattggatttttcgttatccaattagtagaggtgcgccgtgactga

SEQ ID NO: 69610 - DNA, 583 bp, Heterodera glycines
  Genomic contig location: Contig_ID=SeqID_41518; Location=222..804; Strand=-
  SCN-specific regions: Sequence locations=1-583
  Gene Ontology: Mol. function=catalytic activity; Biological process =nucleotide metabolism
atgttgacaaatatctacgggaccgattcgttcacccaggctgtccaggacggtccgcacgccggccaaacggtggaggtatgaagggcaagaatgataattccattccatggtctttaattttcagcacgtccatgtgcacgtggtgccgcgcaaggccagcgattttggcggagacatggaccgtttttacaccgaactgcaggggcacgagaatgagagaacggcacgcagtgccactgaaatggcgacggaggccaagacgtacagacaatggctagcggaaaacagtggaaaagaataagggacgaaccgatggaagcaattttttaaaatttttttggaacagttgtgccattttcatctatttgtaaatttgcccctccccattccaaaagatccttccaaattatgtgctaggtatcagattttcataaatttaaatatcataaagtgaaaaacaattttcccgaagttagaaatgtatcgaaatcagaaaaatggatgtggacgagataggaaagaaacaactgacaaatgaaactaaaagtaacaggatggtggtcttcacataatgaataaa

SEQ ID NO: 69611 - DNA, 212 bp, Heterodera glycines
  Genomic contig location: Contig_ID=SeqID_41520; Location=435..646; Strand=+
  SCN-specific regions: Sequence locations=1-24,75-212
atgcgggaatgtatggcgcaattcaaaaataactaaatttaattaattaattattaaatttaaaatttatttaagtccaaccaccggtgttgtggccgaaactttgctgggccccgttggttataaattcttcgccggcacattcattatttcattgggtagcacctgttgttatgtgtccatttttatgttcatccgatgcaaaaatggcg

SEQ ID NO: 69612 - DNA, 281 bp, Heterodera glycines
  Genomic contig location: Contig_ID=SeqID_41521; Location=48..328; Strand=+
  SCN-specific regions: Sequence locations=1-281
atgtgccaatttgtgtgcccacctgaacgccgcccggtacaacccttcgatggtcaaatcgtatggactctgttggctcaggtcgtacgccatttcttcctgaacgctcaaaacgtcccaggacttcagtgccggctgaacgaactcgccaagaacggagatcgcaacgggagacattgtacgaggcttaatttgaaaaatatacaaaattttcagggcgtaacagggggaaagtggcaaataaataatacacatcatgaaaccccaactttcttgaaaaa

SEQ ID NO: 69613 - DNA, 155 bp, Heterodera glycines
  Genomic contig location: Contig_ID=SeqID_41521; Location=70..224; Strand=-
  SCN-specific regions: Sequence locations=1-155
atgtctcccgttgcgatctccgttcttggcgagttcgttcagccggcactgaagtcctgggacgttttgagcgttcaggaagaaatggcgtacgacctgagccaacagagtccatacgatttgaccatcgaagggttgtaccgggcggcgttcag

SEQ ID NO: 69614 - DNA, 83 bp, Heterodera glycines
  Genomic contig location: Contig_ID=SeqID_41521; Location=535..617; Strand=+
  SCN-specific regions: Sequence locations=1-83
cctttttcacatcgtccgcagtcactgtcttcagaagggcaatgaaatcgtcgggtgtcagtgcggtgccctggccaacaatt

SEQ ID NO: 69615 - DNA, 646 bp, Heterodera glycines
  Genomic contig location: Contig_ID=SeqID_1191; Location=147..792; Strand=-
  SCN-specific regions: Sequence locations=1-187,226-437,459-646
  Gene Ontology: Mol. function=phenylalanine-tRNA ligase activity; Cellular component=phenylalanine-tRNA ligase complex; Biological process=phenylalanyl-tRNA aminoacylation
atgccgactatttctgtgaaaaagcgtttgttggacaaacatttgcgcgtttcgctctcgcaacagcaagtcgatgatttgtgcttccaatacgggttggaagtcgatgacgtggtaattgttgggcttttaaattgttttgtcaaattaatttgctttggatgtatttttagttggttgaaaaagacgagaagacgggacaggaggaggaagtgtacaaaattgagatccccgccaatcgctacgatttgctttgtgtggagggattggcacgggcattgctcattttccaaaataagtacgaagtgccaagtcatcgaaatgccatcgttgatcatttgtttgcttttcctttttagaattacacctcccgtttattctctgacgaatccgccgaaaacccagaaaatagtggtagatcaatcggtaaaaaagcagaaataaatgtttccatttcccactaaaattatgcattttcaggtgagtgccgtgcgtccctttgttgtcggtgccattctccgcgacgttcactttgacgccgatgcctacgcttcgttcattgacttgcaggacaaattgcaccaaaacattggccgaaaacggacattggcctccatgggcacccacgacttggacaccatcaaag

SEQ ID NO: 69616 - DNA, 1843 bp, Heterodera glycines
  Genomic contig location: Contig_ID=SeqID_1191; Location=3454..5296; Strand=-
  SCN-specific regions: Sequence locations=1-138,160-222,245-510,532 -628,666-830,852-860,882-924,946-1613,1641-1646,1668-1678,1700-1843
  Gene Ontology: Mol. function=calmodulin-dependent cyclic-nucleotide phosphodiesterase activity; Biological process=cyclic nucleotide metabolism
tccctcgaaggacggacggcaacacggcgccggtggcgatgttcccacggtgtacaaagcggtcaatggcacaacctttgaccgggcggagctggagcgtgacccggccctgggacagatccaggaatggagtttccccatttttcggcttgccgagaaacacaagaggaccgtgttgagcagggtaagcgggaattacttagaacatctcgagaaaattgggaccaaaataaatacgcacattatctgtttgtcggccccgactccgggcccacggggacaaacggcacatgaacaaaatattttctcagttaaaaatattcccctccccccgaatgtagacttttcgaaaacacacaccttacacttcgaactgaaatcattctgtcgacaaacaaaaactgttgaactgttagaatatggggggatatttttcggctcccgaaagctagaaaatcttgattttgtggggtcaaagtcttaatatttgagtgttttatgcttaatttgaagaataaaataatttacaataccgaagctaattcaacaaccttttcctaatactcaaaagagttcgtttcgttcagttgacttacgccatcttcaaagaggccgacctgttccgcaccttcaaaatttcctacacaaaattcttcaacttttttcatgcgctcgaatcgggctattgggacattccatgtacgaatttcttttatttaaaagcacccagttgcaaaattaacatttttaagatcacaatcgaatccatgcggccgacgttttgcacggcacttactatttgacgtgtcatcccgtgcacgccttttgcaggcaaatgccatttgattttggcaattatattgagtccattttgaaaaattcatttgttccagttaccattcctctgaattggaggacgaagacgagttggaggaggacgaagaggcgaacaacgacacggcgacagacgccgcctactccacggaacagccgttgaccaaccacaacggccagccgaccacgtcgacgacgaatggcggtggtcgccatgtgctgcgacagcaacagtcgaacaccgccaccggcgctactcatcgcaattgtgaggctcacccacagcagcagacgttcgattcggcggctgttgcgcttgcgcaaagcatgagcccattggaggtgagacggtgggaacatattaggggacattggatggcatttgtggatttggtctaattacagtcactgcatttctaaattgtaactttttttttaaaatttagttgatggctctttacacggccgctgcaatgcacgattatgaccatcccgggcgaacaaacgcatttttggtggcatccgaagaccgaaaagtgagtgtgaatggctgccatttgtgagggggtggggaagagacaaaatgccctattccgttgaattttcgaccatttcgtctcccatttaaggccattctttacaacgaccgttccgtgttggagaatcatcacgcggcggagtcgtggcgactgctcaattcccatgctcaattccaattcatcgagaatctcgactcggcggaaacgaaacgatttcggtgcgtggaccaagcgaaaacactcatttttggacagtttttaattgacggcatttaaaaatgaatattttttgttattttccaccgttttgactttgcagctatttggtcctggagtacattttggccaccgacctcaagcagcacttcgacatcatcatgcagttcaacgagcgagtgcccgacatggacctgaacagcgaatccgatcgtgtgctgatttcgctgatgctgatcaatttgcggacataa

SEQ ID NO: 69617 - DNA, 1937 bp, Heterodera glycines
  Genomic contig location: Contig_ID=SeqID_1192; Location=62..1998; Strand=-
  SCN-specific regions: Sequence locations=1-569,592-1019,1041 -1057,1147-1296,1357-1401,1435-1476,1498-1583,1605-1815,1838 -1903,1935-1937
atgcttttcccggcattcgccgaagtggatgaatatgacagaaagggggaaaaggcggatgaaagtgaggggggaggggagaggtgggctttattttgacttaaaacattggtgttccctcccttccccaccttcctgtgccaatccatcataaaaaccgaaaaaggtcggccatcctctcaaaattgtgaacacttttggcaccaaaatgtgtttatgccgactgttgatgggttgtttctatgcgacccatactataaatgccaattagccccctcctccccctgtcgtttcggcgcgtgctaatttggcaccaccagcggcagattgttgatgttttgttgtattcctttctccgtttgtttgccaatgccatcctccgtcaccgtccgtccgttatgaaaactatgaagggcttcttccttgctcatgctgtatgtgtcagtatgtccaataatctccctatcccgttacaatttttttccatcctccgtttaactcttcgctccctcccccttgtctcacatctcattatataaatgtttggttgtaatgatcgcattgccatttttaaatacttataattttttggcatcatattttgagccatccatttatataactttttgtttttttaaatctcccacaattatttttacagactgcaaagcctcgtgtctccaatattactttttccacggtcacttcaggtgagtttttatttccccttaatttatgtccgacatttacaaatgattttattctttttagccacgggtttaccaaccattgctgtcgaaccgtctcgcccgcgatcaagcaggtggttactgtgcaaatgggctatcaattagcaaattgtaattggttttcaacgggaacccaattcaaatcccgagattcgtttgccacatttgttgtagttcgttctttctgcgcatacttttccttatggccaaattgacggacggcacccattcttttttcacttctctctcgctttatcctcatccttttctattttctccatctctcactcattttaacttcttttcaactttctctctctttcttctctctctcttctctctctcttttctctctctctctctctctctctctctctctctctctcttttcctcccttgtcaccactgaagtgtctgccctctgttgtcgagaatctcgaagacgaccaatgtgtggcatttcttccatcttgctctgatgtatgcctttggccaatccttcctccacctgtcattctcggctctttattaaatctggcacggcactttctctctctctcgctctctcatcatttactctcctctccttttcacccctctcttctccgacaaaatcctcatcctccttatccgttgcctcctttctccaacattattccctcttcctttttcccatattttcattctaatccaactgaggatggttggttggaatttgatgaaagttaatggcttacaaattaggatgaggcgggggcgaggcaattctttccttattaggagtaaatataatgagaaattaaccctgccctgaaatagaatttgattagataatcaaaatcataaaaccaactcttttttgtcagttgttggaagccctctcacgctcacaccattcaaaaccatggcggccatcacggcggtggcattgcgaccaatttcagcaacagtttgccacaacgcataaatttgtacgaatatgaggacgaacttcacggtgaacagcaacaacatgttgagcaaattgcgccgaatgacatggcatggaaggagcagcagcacaatgaagttggggaccaacacaaacagcaacagagacggcggtcacagcgactggtgaataataatgaggacggtggtgaaccaagtgggcaagcagtacagcaacaacagcagcagcaacggtaa

SEQ ID NO: 69618 - DNA, 2767 bp, Heterodera glycines
  Genomic contig location: Contig_ID=SeqID_8911; Location=705..3471; Strand=+
  SCN-specific regions: Sequence locations=1-51,73-157,179-276,312 -365,394-515,539-566,589-742,764-793,900-1091,1313-1579,1602 -1994,2080-2168,2200-2391,2483-2510,2532-2767
atgaaagcgatgggaatgacgacacgtggaaaaaatgggagttggcagatgaatttgggaatttatttgtcagagcatttattaagcccatatcgaaagaagaggacagtcaggtaattaggtatttttccctctaataagtgggtttgttcaaaagttattaattaattaaattattgccattgttcggttgctcaaaaatttttcgaataaaatgaattaaaagaactttcaagtttaataatatttacacatatttattaagcttataagatgataaagaatacatttttaaagaaaattattaaattaacagtgatttttaagtttagttcaattaaaaattgcttaacctaatacttatgaaaataatttaaatttcttttatttttagtcaattttcttagcaaattttgtaaaaattcaaaaaaaaaaattcacccattcctacctatcacactaccgatgactttttggactttgataaacacattttctcagtcaaaaattagggtttttgagtaattagttaattaatcaagaaaaagcttttgtctatgtattcattggattggatgtttttgtgggatttgatgaattttttattttttagattttttacggttgtgtgattgattttccaaagcacaatgaacatttcggttttccgaaaagtgttgcaatcaaacaagtgttcttcaggggtgacgaatattataaggcaaaagaaatgttgatccatgaagttgaaatattgaaaatggccgtacaaatggaggccatttacgtgatcaaattaattgattagtaattttttaacaaaaatatgctaaaatttttaataatattttagagaaaaattattataattatttttaaattaaatatatattttttaagcattaccgtaccaaattcactggtcatggtgctggaattgggcgaagaatcgctaaagcatcgcttaaatcggttgaaaattgagtggaaaaaacatgggaatttggatgtaataaattcggatatcaaatccattttcatccaaatggtcattgctttacgtgatttgcatcgatgtgagttggactcacaaaaaataaaattatattattgggataaaaaacttttcatttttaaagtaattattttaatattacatatacatttttaaatattaagtatttttttatattaattaattaccttagtaattctatattatacccaaaattttaaaacgaaaaaaaaacatgataaaaaaattattttctaaaaatgattaaagatttaaaaaataataatttaataatttcagttgcaatccatttggcactgaaatccgaaaattggctttatgtaaaccgaaatggagaaaaaatgttggcactgattgactttcaaacaagcgcactaattcaaacgaatggcacaattgataacagtagcaagatcaagcggaaagaattgaggtaatcatcagttttaaaagttgtaaatattaatttaatatttcgttatgaaactaaacattaattgttagaaatacttaaaaaccctaataaaagtgtttcttgattgcttaattaaaaaataattgtttctttcaactctgccagcctccaaagattttttttaattttgaagaatttcttctctgtaacatttgaagaattgagaaaattttcctgctttttatgttcccgttctcaactctctagtctttaaaatttcgaatcccgtctatctctgtaattataggcaaaaacattttagttacctttagtcaaaaacattggatttagcatttttttcttttgactataaatagcggtgtattattttttaggtcctttatctgtaaaacatttgtcggacgtacccatctgccgcgaacacgacgttttgccagtccggaacacaacaaattttgtgaatctcatggtaaaaataaggtaagtgggatagatgagtttgtataaaatatttaaaactgcaaatataattatttaataaaaaaaatttaaggtttcattttcaaataattaatattaaatttggttaaatttaataaaatttaaacaaaatcattttctgattaagctcgatgttcaaacggacatttggtcacttggcatttcgttgttagagattttggcatatacaccacaaattgatgccgttttcgattttgaattttctgttgaagaaaaaagaaaattcaaaattttgcgaaattcttttgtcgaagaaaatgaaaacaaaaacaaacaatttgccgaaaaagcgaaaatggcagtttcagaatatttccccaattttagtgtgctgattaaggtaaataaatattaattatcaattagcaaactacttaaaaaataaaaccgatttgggaataaaattagattttcattttaaaattaaataataaaagtagtaaaagtttatttttaaataaataagatatgtttaatatgtaattaaaggtattaattaatgagttatgttttctatttaatgccttttatatttttagcaaatgttaacaactgacccaaaaaatcgaccaacagttgatgaactgctaaatgaatttcttgattgaaatttcaaatttttccaacggttaatttttattcactgttaatttagaattttagaattttttttattggttagattatttcttgtataaatgctataaatatatttcaaatttatcagtagcttcttgatgtggtgtgtttgaatatggattcccaattttgaa

SEQ ID NO: 69619 - DNA, 583 bp, Heterodera glycines
  Genomic contig location: Contig_ID=SeqID_41522; Location=261..843; Strand=-
  SCN-specific regions: Sequence locations=1-247,285-358,380-493,523 -557,579-583
atgggacataattcagaggtgtcacgaacaatgttcgaaatcggaacttcgggatcaaaaaatcagatttttgggtcaaaaactgtgttattttacaatttattcaatcaaaaaatcaaatattacgcttcgtgtaactcaaatcatgataggaataacaaaaaacaaaaaactgatcgaaacgcattcgcccaatttgtttacccaaattataaataaatatggtcaatatgcttgacgctcattcattttttaatgatttaaaaaacatattttattttaatgtaccaaaatttggctatgaatttgagtattaagtgatcgaaatcactttctataaccaatagttttccagccgatttaaattaatttattttttgcataaactgtgaaaaagtcgtgccattgaaaaataattcgacaaaattagaacttagggctcaaataacagttttttgagtcaaaaatcttaacaatttgtaaaactgggttattttacaatttatttaaaaacaaaaatgtgccaaatattatattttcagcccactcattaccaattttaacattattggagaagttataa

SEQ ID NO: 69620 - DNA, 665 bp, Heterodera glycines
  Genomic contig location: Contig_ID=SeqID_41523; Location=54..718; Strand=-
  SCN-specific regions: Sequence locations=1-317,348-537,575-665
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 69621 - DNA, 163 bp, Heterodera glycines
  Genomic contig location: Contig_ID=SeqID_41524; Location=438..600; Strand=+
  SCN-specific regions: Sequence locations=1-163
gttccttagacaatgtggacgatgcgcaattggacaccgtggagaaactgctgaaagaagcggaaaatcgtttcgattcgagcggcaacgaagtgaaaatgcgagaacggatcatacaagcggagaccaaagcggtgaagcagaagaggtgatcggaaactaa

SEQ ID NO: 69622 - DNA, 284 bp, Heterodera glycines
  Genomic contig location: Contig_ID=SeqID_41527; Location=708..991; Strand=-
  SCN-specific regions: Sequence locations=1-28,50-62,84-136,187 -232,255-284
atggggagaacaaagggagcagagggagcagtgtctggtgaggaacagcaggtcggacaatggcagcaacaacagcaacaccatcggagagcgaggctttggcctaacggacggagggatttgggaattttgtcggttttaaatttgaaaaatcattttgttatttttttaaattatttttttatagtcggagaataataacaccgccgcccgtccatcaaaatcaaaatcattcccttttcttttctcttatcgatcaaatttgggagagcaaataaagaaaa

SEQ ID NO: 69623 - DNA, 858 bp, Heterodera glycines
  Genomic contig location: Contig_ID=SeqID_41530; Location=1..858; Strand=-
  SCN-specific regions: Sequence locations=1-810,833-858
tctttcaatgcttcttcattcctcagcagttcctcctcgaaactttcacctcgcgtggcttccgaatgcttttacagaggcgccttttaccatttctttgagggcggcccccgctcaccgcttttccccggcagaagcgacggaaaaactttcaaagacggggaccgatgtgttgaggcgggacgttactgcaaaagatcgccggaattggacttttggtgggccaatggcaaagaatgcgaaccaatcacagaaacggaaggtacccctgcaaagaaagagcggagagtgccaatgcgagtgcctttgagggctgttacttcgggcgaggacccctccaggcaaacgccaccaaataagccaatctacgacatcttttctttcgtttagctttcctggaattataattacgggcaggtcgaactgtcgaatcgtttacgatcagaaggatttttcagtttcggcattttcttcgaactgaaggcgttgaagtcgaccttctgcaacagcccaaccaattgctaacccgcctcgaccctccgctggcaatgctttcggcactttggtccgcccattccgttaatccttctcattcatttgccgtgcataattgtttcaattggaaggttttataatacgccacagcccccgaaaccatcgatgcatgaggtaaagattggctaatcgagaattattgaaagcaatgatggccatttggtcaatgatttttcgataatgaccgggcagtgggtccccagcaaaagaaatcgtcgaatagctacgaaggatcagtgtttgggtaaatggcagttaaaaggaagaaaataaatgagcttttcgcacagatttagaccaacc

SEQ ID NO: 69624 - DNA, 258 bp, Heterodera glycines
  Genomic contig location: Contig_ID=SeqID_41531; Location=424..681; Strand=+
  SCN-specific regions: Sequence locations=1-162,185-258
atgtcttcttcaataaatgatctggcaaatgaaacaatggtgcgttttccagggatttcttggattggttcatctcacttatactcattcgtttttcaatttcagtctcttattttccaatatcttcctccaaatgaaagagttcgtattgaaagagtgtgccgccgttggtgttttgtgtcgcgagaactcagttggtacaaccaaaagacacttctgctggatggtcaggaactcgcacaaaattttgatctgacg

SEQ ID NO: 69625 - DNA, 1324 bp, Heterodera glycines
  Genomic contig location: Contig_ID=SeqID_8912; Location=1037..2360; Strand=+
  SCN-specific regions: Sequence locations=1-612,634-1324
atgggagacaaaccgatggtaaaaggcggaaatgagcagcagaccgagcacaatgccaagcgaaaggagggcaccgaccaaaggggcgacggtgccaagccaaaagtcgagcaaagactgcgcacggaaaagcgactcctaaagggggtaaaggaaaagcattgggggaaatgggggggggggggagcggaccggaagcaaagcgaaaacggacggagagcggacggaagcggaacggaactcgcaaagcaccgcctgttggcccaggggacggagctcgcgcgaagtgacgcgaacgccagcaacagaccaagcgcgagctgaaggggagacggtgagaaaagggagggcaaaaatgggatgccaatcaattggaacgatcgatcaattggtgggaaaaggaccgatcgatcattggggaaaatgatcaatcaatgaatcgatggaaaaagagtgaacgatcggtgattaattcatgccgtttttggtgcaagcactaatcaataaaaaggtaattaagcatcaaaaactaataaattaagaatgaacttagcacaaaaatcgggaaaatgttcacgacaacgcactttgctgatcaaagaatgcgcatgtcatattttctccgtccacttctccgttggcttccgctcgtctccccacgctttgccgttgcgtctgttgccgtgcgctccgtttgtccgtcctcaatcccaccacaattcgcaatggcaccgcctcccccgtgccatcgtccgcccttttgccttccatctgccgctgatcacttccgtttttgtttttcattgcctccatttctcccttttgtgtccatttgatttccatcattagcaacggactgtgcccatttaattgcggcaaaagcgtcgaattgcgcatgcaaattgccctcgcaacggcgtgcccttcgggatttggagtgccgaaaaagggacggacaaaacatgggccaaattgtaagccatcctgcagggaaacgaaactaaaattagggaggaactgggaatcaattagacattttgttgctgttcgattggtaaatcgtcgccgttttgtgccggggacggcaaaatgtcccacgttcgcatttgaaaccccccggcggcactttgcaaagagaaaggcacctaaatggcatatgatcaattaaaaaataattaatcatttatcattacaggtagtcgacgagcgaattcccgagaatagtctaacaaatgggcgcccatttgcgttgcatttcccccggcaaaagcggacaaattacgagagaccaaagagtcgagcacctaaagaaaagccacactaa

SEQ ID NO: 69626 - DNA, 294 bp, Heterodera glycines
  misc_feature (293)..(293): n is a, c, g, or t
  Genomic contig location: Contig_ID=SeqID_8914; Location=1148..1441; Strand=+
  SCN-specific regions: Sequence locations=1-3,44-66,273-294
atggaagagaagggaggggaagtgaagaaagaagaggagaagaatggaggaaggggaaggaaaagagagaagagaggaactgaagggaagagaagagaaaggaagagaagggagggaagagaggaagtgaaaataaaagaagagggggaaaagaagaaaagaaaagggataaaaagtgcagagaatggatggagaggggaagggaagaaaagagaagtgacgggaagagaggggatgggaggagaagagaggaagggaaagaaagaggagaaccaggaagagaggaagtgaana

SEQ ID NO: 69627 - DNA, 505 bp, Heterodera glycines
  Genomic contig location: Contig_ID=SeqID_41534; Location=78..582; Strand=+
  SCN-specific regions: Sequence locations=1-1,23-31,53-163,185-265,287- 397,419-427,449-505
caaaagttttttacaacaatttattgccaatctaatttcttgcagattgaaagccatccattgcctgccgatactcggcacagcaaagcactaatagggtgtttgactcacttcaaaaaataattccttacccaaaagttttttacatcaatttattgccaatctaatttcttgcagattgaaagccatccattgcctgccggttctcggcacagcaaagcactaatagggtgtttgactcacttcaaaaaataattcaatacccaaaagttttttacaaccacttattgccaatctaatttcttgcagatttaaagccatccattgcctgccggttctcggcacagcaaagcactaatagggtgtttgactcacttcaaaaaataattccttacacaaaagttttttacaaccacttattgccaatctaatttcttgcagattgaaagccatccattgcctgccggttctcggcacagcaaagcactaatagggtgtttgactc

SEQ ID NO: 69628 - DNA, 811 bp, Heterodera glycines
  Genomic contig location: Contig_ID=SeqID_41535; Location=36..846; Strand=-
  SCN-specific regions: Sequence locations=1-129,152-178,200-416,438-811
atgggcaacgacgacgctgttgttcaggagtttttgacctcaatgaaacccgaagagtcggaaaagggcgagggattggagcgaaaattgtcacaacaaagcgcagcactttcgtctttctcagaaacgaaagaagccaaatcaaagggaacaacacaacccgaaaaagaagcggaagagaagcagcaaaatggggagacaaaaggcaaaggactgatcgagaaagaggcattgttcacggggaaggtgaagtacaggtgggagaagcggaggttggcaaaccaatgccctgaggcactcattcagcgtttatttggattatttgcgtgccattggcctctgcacctgttttctatgccttctcatcttcttctcctccagtattctcggcgtctcgtgtctcctttggcttgctaattggtcagaccatgcccaagaggtaagaaaagggcttttcagcggacgacaaaacctgcacttcggttcagttgcaaaacgaaaatgacaccatttctttggcgaccatcacacatctcggcatttacacggggcttggaatgggtcaaggtcattccatccattttttaccaattaataattccgtttaagcctgttttttggcgcttggctccgttgtaatgtctcttgggatgtctgttttccattcctcacttttatttggcatttcacaaattttagggtttttgccagttattcgctgcatgaaaaaatgcttcggagtattttgcggagtccgattgcatttttcgacatcactccgctcggccgtattttgaatcggttcagtaag

SEQ ID NO: 69629 - DNA, 314 bp, Heterodera glycines
  Genomic contig location: Contig_ID=SeqID_41540; Location=138..451; Strand=-
  SCN-specific regions: Sequence locations=1-175,197-245,303-314
atgagcgcaacagtggcaaaattgaccattcggagattaggccaattaattagaattaattaccggtttgcccggctcatcccacgggtttttgatttggtaatgtttgtccgtggccaatggctccgattcgccctctttgttcagcgctttgacccggaatttgtagttgcccttgtccttcagtcctttgagctgcagcgacgtttcgccaggcccgacttggccaaccggcacaaatttgccaccgccatcaacatcctgggaaaaaatattttcaaataattttaaattattttattggatgaattaaa

SEQ ID NO: 69630 - DNA, 216 bp, Heterodera glycines
  Genomic contig location: Contig_ID=SeqID_41540; Location=191..406; Strand=+
  SCN-specific regions: Sequence locations=1-65,87-216
gatgttgatggcggtggcaaatttgtgccggttggccaagtcgggcctggcgaaacgtcgctgcagctcaaaggactgaaggacaagggcaactacaaattccgggtcaaagcgctgaacaaagagggcgaatcggagccattggccacggacaaacattaccaaatcaaaaacccgtgggatgagccgggcaaaccggtaattaattctaattaa

SEQ ID NO: 69631 - DNA, 447 bp, Heterodera glycines
  Genomic contig location: Contig_ID=SeqID_8916; Location=501..947; Strand=+
  SCN-specific regions: Sequence locations=1-89,111-227,261-447
atggccaatttgagcaactccggcaatgatacggtaattatgtggtaaaaatttttatcacatccaaatttgcagttttatttggccttcaaagatgtccatcccagctggtctctgattggatgcgcactgacttatggaaccattgcattaattggcaccatcttcaatttttctgtgatttttgtcaccatcaaaacaaagtatgagatgattttatttgttcgaaattataattttttataatatttaaattttttggtcactcaatggcacagccaattacctcgtggcactttgctctttttatgaattgattcaacaatttggcatttttctgtttgtgtacaccatattttctggccaaaacttcattaaatgtcgcctggcagcaaaaatattattcattccattgattgcacttggtaattaaaattccctcataaa

SEQ ID NO: 69632 - DNA, 2839 bp, Heterodera glycines
  Genomic contig location: Contig_ID=SeqID_8916; Location=1472..4310; Strand=-
  SCN-specific regions: Sequence locations=1-398,483-758,780-787,895 -911,933-1020,1058-1083,1105-1234,1272-1548,1571-2057,2100-2164,2186 -2292,2314-2466,2501-2730,2752-2839
atgcgttggcacacggacaacgacagaaatgtaagctcagccatcacacaaataatcagagcaatacagaccagtcagtcggggatatgtcggaatgccgattttccgctgatttcaaaaattttttgggcactcggattccgattgtcgagattgtttgagccgtcgaaattccgattgtcaattgccgaggttttttgagccgttggaattccgattttcaaaaaaaaattttcggcctcggatttcggtgccgatttttgagagcgtacgcacatatccctgctgctgcatatgcccggttctgatcagttttaggggttgcttaagaaaagaatgcagtctgtacactattttctaatgacgaaaaaaatacaaagttttttcttaggattttcaaaatttaaatttaaaaaataaatatattttcaacttttaaatattattattttttttaaaatttaaactaaatttgaatttttgtaattcttagggcttccatttttaggcaaatgcctaaaattttgcgcacttgatacgcaaagataagcacaaaaagcgcgttttccgcttggtttgaggtgtctaagatgactcttataatgcctatttttgcctatttcgtggtttttgtgcctaatgtgcctattttaggattttcgaaaaaatccttaacaaaaatgcaataaaaacgaaaaatacaccccctaagaaatgacccaaaaaatttttccagaaaatacaccccataagaattgaaaaaattttcaaaaattggtcccaaaacttaatatttttttcttaataaaaattttttgggtttaaaaatttgttcatattcgaaaaaaacattaaaatatttaataatttcaattgaaatatttaagatttaaagtgttttgttacctaaaaagcgttaataaaaaattttatatgcctattttagcgcctatttgaggatttttgtgcctatttaatgcctatttcgcgattttttgtgcctaaaaaaggaaaccctagttattatcaatataaaatatttgttattttaaataatgacttcaaaaaaaagatttgcaccaatttttgttaaaatttttattatcattatttcttcccttaggatttttttgaggtattttagtggcaaatgaggatttttatggctgaaatgaggattttcaaaattttgagatcgaaactctgctcttgcctaattaatggattgttaatgaatttaatattaaaaaaaaagattctttttttaattaccctgctggttgattttgggaattttgtgccaaagggttcacatttggcatttttgttatagaagaaattgacgaagcattggcatgaacgggttttgttgaattgcaaatacattcttaccggggcctttaaaattcaaaaatgaaaatttacaaaaaaaaaatctaaattttactcagaaggtatttgacgtttcgaaaatatattccaatttatgaaaaaataccatttttctgctgctttttttttgatgataaaaacccaaatttatttcacaattaattaattttaatttgttggtcatatagaatttgtatggtaaaaaagctaaagattaattgattttcaggttaatccggaataaatctaaattttccttaattacatactaattcccaatgcaaatgatttgaccaagaagttaatcaaaaatataatgaaggaatttttattcaattaattaattttcttggaactcacaaaaacaaaaacttaaattaaaaagtaaaaaccctaatcaatttgtcaaaagttattttaaagccctttacgtaagtgtatttttcgggacgaattcagacaattaaaatgcgggaatctttcgagcgcatattttaaattgttcaaacaattattgtaagcaataattcttagttcattaaggcaattatcgtgccacattttgtcaataataaaatgcctgcgataaattgttccgtccgtcagtaaatgcttggcaacactttttattttaacaacattttctttttcttagcaaggttttcattaaatgttaaatttatttatttaggatttaaaaaatttatcggtaattcctttattttcgaatttataaatttaccttttatctataaattaatgatggacaaagaaaaattatttaaaaatttttcagtgaaattttcataatttcaacaaaagagttatatgtaaattcattaattagttgtaattttaatacttattgacaacaattagacaaactgatgtcatttcaaacttttaaaaagtggctattaatatcagtaagatttaaatttcatttaatttttcaaagaaattctcatgattgtgtattctgcagtggaataacttgagttacatttgaaattcgtctgaaaacgaatggaaattccgcttggaatgcctgccgataatccgtactaaaattgcaaataaatgttaaatatttttaaaataaattttagaccttgtaaaatataaaattggtccgattgacgctgcgccaatgttcaaaggaattgagataattacatggcaaaaccaatgtgtgattggagaagaaattatgggaagtaaaagcaagaacacaatagtagtgaaccaataaccgccgacattcacagtgataatgaaaaaaagtgcgcgaaaagtgcgacgattgatcgaatcagcggacggcaaacctattaaaaagatagataattaagcaaattaactggcaatgcataccaacattttcaattgtgatttctaaaaaatatatatcccaatctccgggcgttgcctcccgttttttaataaa

SEQ ID NO: 69633 - DNA, 839 bp, Heterodera glycines
  misc_feature (391)..(391): n is a, c, g, or t
  Genomic contig location: Contig_ID=SeqID_8916; Location=5076..5914; Strand=+
  SCN-specific regions: Sequence locations=1-336,359-613,635-839
atggaggacaaggcttataaccaaaataccgattttctaagaccacctgcgcggggtgacaggacgccaaaagtggtcaaaaagccggtcagtgcaacgatgttgtcaaatgatgtgctgatttgtggatggattactggtgatcagagtgagtttaagggctgaatttgtgagaccagccgagggcatttttggtgccggacatttaaagtgccgtaattttgtttttatggtttgaccaagctttaggagctttttgtattactcaaaggcttttcacgcgcaaaaaaatgctaaaaaaaagaaaaaaaaaatcgaaaaaatcatgaaaaatagagaaatatttgaaaaataattttttcatttggtatgacaaccccatgagcttaanaatttttcgacatttattttggtcatgaattttgggtgcgcgaaaagccacctggtcaatataatgctgtccagccccgaatcggtgccccgttgttctttgcgaagacgaagaatgatcgggctgatcacggccagggacgaagcgcacaaagcaaacctttgggatcatagatcagtgttaattggtcataaatcttggcagattaagcactaagggctcagtttatggtagaaacttgaaagagtacagtagtaataataccgtaatggctaaaaacaaacccaaaaaggattgaagcaccaagtgggagatggaacaggaaatgcgaggccaacacaatgatcaaacactcaaacagagggcacacaaagccaatgccaaagcacagagtcttgggggggggggcaaaaaacaaattatttgcgcaattaaatcaatattttga

SEQ ID NO: 69634 - DNA, 545 bp, Heterodera glycines
  Genomic contig location: Contig_ID=SeqID_8916; Location=6015..6559; Strand=-
  SCN-specific regions: Sequence locations=1-133,157-178,200-382,404 -473,518-545
atggctgatcacgaccatcgatcggtgcctgatcaggatcaccatctttcccgccctgttgtctcttcatccctcatttctctgttcatccttctgtctctctcactgctgcttggccgtcttctctcctatttcttcattcccttcatcacaggtgtggcatttcttccaattttggcacaatttcacaaaacccattttaggaccaatactgatcggcattctcttcacaaatttggtctcattccgttcactgttccactatttcccgcattatcaactgtcaacactgatctacgagatcgcttttctgttgatcatcatccgatcagcgtttggcattgatcagtccactgtccggcaattttatgttggattttgaattttaatatccaaatttaaatttcaccaagtttggaaatattcaattatcttaataggtcctttctctcaaaaaatggggcttaattccgatttttttttttgaaatttttaatattcaaaattttataaaattgctttattgattggataaaaagattaaa

SEQ ID NO: 69635 - DNA, 272 bp, Heterodera glycines
  Genomic contig location: Contig_ID=SeqID_41547; Location=114..385; Strand=-
  SCN-specific regions: Sequence locations=1-272
acttatatttttaaatattggtatctttaaagagtttaatcttttgaacaagtctagatcattgggaattaggccggataatattaacggaattcaaatcccggttttatcgggatcttaatcgcgtcaactgatggattcaaatcccgcttttgccggatagtgatcctgccatttttcaaaaggtcgggatgtggaccactagaaaatttggacgcgattccaatcccgtcagcctctatttttgatataatctgctggatatgaataaa

SEQ ID NO: 69636 - DNA, 304 bp, Heterodera glycines; identical to SEQ ID NO: 51570
  Genomic contig location: Contig_ID=SeqID_41550; Location=162..465; Strand=-
  SCN-specific regions: Sequence locations=1-304

SEQ ID NO: 69637 - DNA, 278 bp, Heterodera glycines
  Genomic contig location: Contig_ID=SeqID_41550; Location=668..945; Strand=-
  SCN-specific regions: Sequence locations=1-278
attgcgcaccgccctccctatcatgctcgatagtatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 69638 - DNA, 342 bp, Heterodera glycines
  Genomic contig location: Contig_ID=SeqID_41551; Location=452..793; Strand=+
  SCN-specific regions: Sequence locations=1-39,184-244,266-278,305-342
atgcctgctgagtatagaatttggcaagatgagaaaaggtaataaatttaaaactatttttaaatatatgaaatcgaataaaattcaaataaatgcttaataaaaaatcaatttagtttaacattttaatcatatattataatgaataaaataaactttattctaatttatattttaaattaacatggaaatattagaagataccgctcattgtgtcaactgctcaatgattttactacaagagctgcttttgaaagtaactcagacctaaaattcaaatgggcatgcttttcattattaaaataagaacgtttcaaaattaaaaaagaaattaaaaactta

SEQ ID NO: 69639 - DNA, 2269 bp, Heterodera glycines
  Genomic contig location: Contig_ID=SeqID_8918; Location=744..3012; Strand=+
  SCN-specific regions: Sequence locations=1-124,146-205,227-1156,1219 -1784,1825-1840,1904-2269
  Gene Ontology: Mol. function=ATP dependent DNA helicase activity; Cellular component=nucleolus; Biological process=DNA replication
atgttggatccggagtacgttaaatctcaaatcaaaaaattgggcggtgcttctccagtttttgaacagcaaacaaagaagcggaagcgttcagcaagctccgcttgtatgtaaatattcgtaaaatggaaaaaaccaaattttaaatggacatttaaacattttttttttgtgatttgggttcaaatgaaccacaattaacagtaagaagcaattttctttaaccaaaccttaaaaaattcacattaaattcctatttttgagattaacaaaaaaaatttgtcgaaaaaaagaaaaaaaaattcggcctcataaccttggcccatttttagcttccattgcaacaatctcccattctgtgagcagtgccaaccatcgcaattcgacgggtgccgccaaaaaacagtcgacgatggacaaatggctggtgccgaaaagcaaattggttgccgcggcggcggcgttcacaaaacggagcattggcggcgttggaggccaaggcattggcggtggctgcggtgcaaatgcaaagctaacaaaaagtgccatcgatgccagcggaattggcacggaaatcggcgccgttgatgaggcacaaatggtgaattttcaaggcatttttgtaaaaaaaaatttttctttttacacactatcccataattgtcattttttacattttcggtctttgggttaaccgctttttcgtacttatttataaaagcatccttaattaaaaaagttggtgttttcatcatgaaaaaattaaaaaaaaaatcaatgtttcccctaaaaattaagtggagtgggttatcaatacgaaaaaaccaaaaatttttaatgaaattctagttttcatttaaaacactggcccttccatttcgttaaatttttgagtcatgtaagtcgtgaaaacgaatttcaatggcatgtcatttgtcattgtatagaaagcagcacgaattgctttcccgggacggaacctttgcagaccgacaaaaacattaaaaatggtgaaaatttttcagaaaaaacgagtcagaaagtcgcccagaatttcaccggcgacaattgatcaaaaggtggagacaaaacggcgcaatgtgaagccaatcggaaaagtgacttggctggaccaggtcaaacaaaaaatttcaagatttttttttaaaatttcgttttacaaaaaaaaattgtagttttttttttttttaaatttttcagccttcaacaagtcatgaggacagcagccacagtttgatgccaagttcgagtgccaaatttccatcgaaatcggatgtccaatgggtgccaaattcgtccggtcaaaacatgccgaattcggatgtccaacttgtgcctgattcggatgtccaatttgtgccgaaatcggatggccagcaagtcgtgccgccaaccacgggtggagaacaaccaatgggcacggcgacttctgccgttgcattgctgttgaacgaggcgcccgagccgagcacgtcgaaagcgcgtcgcgaccgactcctccgcgaagtgtttggccaccggaagttccgcagcagtatgcaaatgcaggcaatcaacgcggtgatcggaagtgcgttatatacacaccccatcaagggcctgtgattagaaaaattagaggggaaacccgaaatcgaaaacttttttttttttgctttcccccaattttaggagtaattgcggaaaaatattaattcgcttttaatttttgtgcattttgggtcaaatagaaatatttaagcaatttagcggataatttagttggtaagttttctaagtttgtctgatttgtttaataaaaaagccgataaaaatttccaaaaaaaatttttatttagtttttttaaaactttctctcaaaaataaaaataaaattttttttcaattttcatgccttgcccataaccaacgaggtcgggtggggtgaagaaataatcgaatttgacccaaaaatcttcaaaaattggcacatttttaggcctaaatcttccaatacattgcctgataaaatgccatttccaatttaatccccgactttttgcaaaattccgtgccctctctctcatccatttccattttttctcctcccattcttcagagaccgtcgacgtgttcgtctccttccccaccggggcgggcaagtccctgtgctaccaattgcccgcctgcttccattccggcctcaccattgtgttctccccactgctcgcgctcatccaggaccagctgagcgcgctgcgcgcgcgcg

SEQ ID NO: 69640 - DNA, 321 bp, Heterodera glycines
  Genomic contig location: Contig_ID=SeqID_8918; Location=27..347; Strand=+
  SCN-specific regions: Sequence locations=1-42,79-137,159-321
tttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgaca

SEQ ID NO: 69641 - DNA, 1035 bp, Heterodera glycines
  Genomic contig location: Contig_ID=SeqID_41552; Location=246..1280; Strand=+
  SCN-specific regions: Sequence locations=1-434,473-529,565-575,597 -885,908-1035
atgcaaatggtccgtcccgccgttgaacgcatggacgaacaggtgaagaacaccaggaagagtcagctgttcttggccaatcacatcgaccaaacatcagaaagtgggtgagcaattaaccatatcaagtcaaaagagagtcgtgtaaatgaacatttttaaaacgttatggtgtaattgttgaagcaaaaaatgctgaacatatttagagttaaagaatttggtggatgaacagcttttgccctatgatttggacgcgtacgtgcgaaaattggatgagagtcgaaagcgaatcaacggaatcggccaaaaacttcaggtagaattctaattctctaattgaggcgatatttatgtcccatttagatactccaaaatcgaatgggccaattacagcggggaattgcccgagagacattcagacagaaacaataattagcttttatgaataaaagactaaaagcatgtgttattcctgccagtttcgtttaccgttttcacagtctcgcatctttattttctttttccctattttatttgttttttatttaattaaaaatttttgcacattaagaaatgcacagaacttcaatttatgcgaaactgcaggtgaagtatagtcgtcgtgccaagtttaccccgagggttgctcgcccgtggcgtcagcgggtcatcgcctgggccggccccgacgccttctcacgcgaccggtcagtccaacgcctatctttggtgtttcttcgatttggcaatctgtttacagcttttatgaactagactcgtggtacaaagcacggattcagagacccgaactgctgcccaagttgcatatcattgacccggatttaatcgtggacaattacgaaagcaaaattcaacgtaagacgaggggacgagagggttacattcatttgtattttgaaggacgcaaggaacggacccttgacattgggtttagaaagaatgaggcggcgcctgccaaagtgacggaggaagcgatgcaaaagttggaagagttgtccgcaatgaaccaat

SEQ ID NO: 69642 - DNA, 651 bp, Heterodera glycines
  Genomic contig location: Contig_ID=SeqID_41554; Location=68..718; Strand=-
  SCN-specific regions: Sequence locations=1-171,195-296,336-568,590-651
atgatttttgctttgaattgtggcttaatggcaatgttttgtgctgcttttgaccgactttttgctgttgtgtcgccatttaagtatgaaattaattcaacaaacactaattaaccctaattaattctttgatagattatttattgtaatttttccttttttagacattcctcaattttcactaaatacaaattaccgtatttgcttagtcatctgttaatttgtgtaatttacggtgcatttacactgaattatgtgctcgcatttgcattcgaaaatgcgggaaagtatggcgcaattaaatcaaaaattaaaattaattaatattattttttcagtccaaccaccggtgttgtggccgaaacttttctgggccccgttgggcataaattcttcgccggcacattaattatttcattttgtagcacctactgttatgtggcaatttttgtgataatccgatgcaaaaaaggcggtaaattcttaggcattttgccaaaaaaaataaaccgaaatattttttacagtaacccaacagacgaacacacgagttttacggtcattggtcatcattttgtctattaatattggcggatatctgaccaatttggccatatatcagttgctgtatgcatttggttcaattttggg

SEQ ID NO: 69643 - DNA, 277 bp, Heterodera glycines
  Genomic contig location: Contig_ID=SeqID_41554; Location=975..1251; Strand=-
  SCN-specific regions: Sequence locations=1-87,110-277
atggcatcaattaataccagctcaaatgacccggtaaaaacaaaggatttaactattttaagttatttttggaaaaattaaaccaagatttatttaaataaataaaaatgttttcatttatttctagctttatttggcctaccgtttcgccggtccgtccgccgatttgattgtgccggccgttgcgctgtatttggttgttttggttggcattgtgttgaacggcacagttttggtggtcactgtcaaatccaggcaaatgccatggcatttttaa

SEQ ID NO: 69644 - DNA, 101 bp, Heterodera glycines
  Genomic contig location: Contig_ID=SeqID_41559; Location=111..211; Strand=-
  SCN-specific regions: Sequence locations=1-101
cttgtggatccaaccaagacaaagccttgcttcgacaaattcagtgcttatgtcaaagattggctgtcatgtgttgatgcaaaactggtcaaggaatcgag

SEQ ID NO: 69645 - DNA, 513 bp, Heterodera glycines
  Genomic contig location: Contig_ID=SeqID_41560; Location=205..717; Strand=-
  SCN-specific regions: Sequence locations=1-513
atgaaaaggaccggcgggagacctgttcaaatcctggtccatctagaaaatcctgatcctaagccgggttttttaaattcaaaattccagctgtattttaagtcaacttaattttggcgtcttcatttttatgggatccgggcaatccgtcagtggacaatccgttaacggataatccgtcagtgaaggacaatccatcattaagggacaatccgtcaacggataatccgtcattaagggacaatccctcactggacaatccgtcaacagataatccgtcagtgaaggaaaagccatcattgagggacaatccgtcggtggacaatccgtcaacggataatccgtcagtgaaggacagacaatccataattaagggacaatccgtcagtagacaattcatcaaatagatttttttgtgcaatgttaaaaatttttcgaaaataggttgtatagttgttactagtttttgaaaacatttctcattataaaaatttatttatgatcatgaataaa

SEQ ID NO: 69646 - DNA, 118 bp, Heterodera glycines
  Genomic contig location: Contig_ID=SeqID_8920; Location=4348..4465; Strand=+
  SCN-specific regions: Sequence locations=1-118
atgaccaacggaaaaaaaggggcggaagtgattgtccgaccattggccaacagagcgacaaatgccatgggcacggaaaatgccaacggaacgatggcattgggcgacggcgcgacag

SEQ ID NO: 69647 - DNA, 235 bp, Heterodera glycines
  Genomic contig location: Contig_ID=SeqID_8921; Location=1..235; Strand=+
  SCN-specific regions: Sequence locations=1-119,141-235
atttatgtgacaaaaggcgttgaaaaatgttatgtgcccgaaaaaacggactcaaaataaatgcggcgacacaaagggaattgtgcggaaatcaaacgaacggtaaaaagcatttgaattgaggaaactgctgaaaatggggggaatcctgcagatttagcgaccgacgaaggctttcttccgaaatcgctgctcttcaaaggcccttgtcagcttcggctgcactctctccgac

SEQ ID NO: 69648 - DNA, 479 bp, Heterodera glycines
  Genomic contig location: Contig_ID=SeqID_41566; Location=599..1077; Strand=+
  SCN-specific regions: Sequence locations=1-135,157-257,282-283,305 -305,327-357,391-422,453-479
atggactcggccgcctattcctacctgctggagcagcaccttggcggcgtctgtccggaggacatccaggacatcaacacgtactcccaggttggttgtgctcccgccggacaatccgtcggcgataaaatcccatccattttttaaaattaaatcgaacaatcgcaatcgcaaattttgatcatttctcgaaaaaattttttgcaaaataatgtccactgacggattgtccattatgaccgattgtctgaactccgctggttggttggttggtgatggtgaagtctcaaaaatactatttttaaaatcaaattttaaatttcattcttcagcatgcactgatgaggccggtccaagtggacgaagaggaggaggaggaagaagaagaactggtcgaagaccacgacgtcgaacgacgacaacaccactaccagcagcagcagcagcggaaatactgggtgggacagcagcaacagaag

SEQ ID NO: 69649 - DNA, 451 bp, Heterodera glycines
  Genomic contig location: Contig_ID=SeqID_41567; Location=91..541; Strand=+
  SCN-specific regions: Sequence locations=1-40,63-125,155-451
atgttcgcttcggtgctgttatcggaaaagcgtataaggtaaaatgggagaaaatatttcaatggcacggaccctcggaaaagggtaaaaatgccgagagtttagagtcgagaaattccattttcaaaattaatttgcacaaatttaatattttttgttgtaatttccgaactttaagggcacaatgtgctcctttgagttcagcggaggtgtcatcgttgaccatgccgaactgccggcatttgttgggctgaccgtagcgcatgaaatgggccacaattttgggttggcacagccaattaacgctttttcaccactaaaacttattttcttttcagaatggaccacgatgccggctatcccgagccttgcaaatgcccggcgcagcaatgcatcatggcaccggccagcagcaagttgctactgttttttggataatttaatgatggca

SEQ ID NO: 69650 - DNA, 438 bp, Heterodera glycines
  Genomic contig location: Contig_ID=SeqID_41570; Location=474..911; Strand=-
  SCN-specific regions: Sequence locations=1-438
aaaatgtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgc

SEQ ID NO: 69651 - DNA, 1168 bp, Heterodera glycines
  Genomic contig location: Contig_ID=SeqID_8922; Location=596..1763; Strand=-
  SCN-specific regions: Sequence locations=1-31,53-220,242-544,569 -781,803-805,828-1168
atggccactgcttgcaagttggaaatgagcttgggtaatttttcttttaagtatcttacaaaatgtcacatttaagacgagatcatcaaagcaaataagagcaagaccaaccaggcttcaattaatgggcgaaagactcaaatgactggaaagcgattgattcgcggcaatattgcgaagggaaagccattcatccgaaagcaaatcaatgggcagaatcagaccaaggtttgtttttaaccctcctgtcattcattacttaaattttatttggaagaagtttggacttaaacgcgttggaattaatgttcgccgtggtcgccctttgagaaagtctaaccgtgttgttgtcatgagaaaaaatttcgctgcgaagaacagagccgtaatttccgctacaaagaatttagtgaataaactcgtcaaggtatggtatgggaagagagcaattttgtgttaaaaaaatcaacaacatccaatttctcagaaagctcttaacaaatcgaatgtttcgccccgtggcatggtttgttcgtttttcctattattttatcttattttcattccagcgttttatcgctaattctgcccgtcgtgtccgcacaattatgctcaacaaagtcagtccccgttctcgggtgatcactcgtcaacgccagcgaattgttgccgtacaaccgcaacagcagcccgtttttgttcaacgagttgtccgtgggcgtggtccaattcgttatgcgtccgatgctgcgttagttcctcagacgatgaaaatgtaagaaaaggggttcatgtgaaaaagtaatataaaactgagtaaatttaatcagtttgtttagggttccgaagcgacgtttccgcatcaatcctatgcaacaacagcagcctgtcctacttgtacagaatcaatcaccgaaacgccgttttccgtccttttcatcgatgagtgttcgtcaacacgtcaatgcattgcgtcgtgcgactactgtgcaacaactccagactcagtttgttaaccagcagctaccgattcgtcagcagtttcgagggcggcaggccatcactacccccgttatgccaaatcgcagtcgaggcaaacaacaattcattcttgaccaacccgtgcaagcaggacctcaatttatggtacgagtttgtagagatgtag

SEQ ID NO: 69652 - DNA, 467 bp, Heterodera glycines
  Genomic contig location: Contig_ID=SeqID_8922; Location=1787..2253; Strand=+
  SCN-specific regions: Sequence locations=1-250,272-467
atgaccacgattcgagcatgtgcgctagagccattatttgacgcgtattgcgtttccgctcgccagtaagtggcaagcatttggaatgtttctgctctgggtcttcgcagttttgaaagccattttgttgttgtcacattcaccaactggctttgcgacataattagccgcacgagatcagaacctcccgcccgagcgacttttaaacataaatcctgaaaatcgaccgcctccccattttggcaggattctgtcaaacattaaggttaaaagaaaactatgggtaaacattcaaacggatgaattgaagacaaatgaatgtgaaaccaaaacaccaaacaaaggattatctaacgacccaaacgcttactgaacaaaaaaaaattgatttttcaattagaaacttaaattagaaaacatcggtgacttaccctttttgtgtcaattttgtcgatgaagacaacaga

SEQ ID NO: 69653 - DNA, 382 bp, Heterodera glycines
  Genomic contig location: Contig_ID=SeqID_8923; Location=469..850; Strand=+
  SCN-specific regions: Sequence locations=1-382
atggatgttgagtgccatgctccgacaccctctacttcggcctcaaatttgaatgaacccgaaatactagccaatttggcagcttttgaatccaattttgtttccgtaagtttgtccaatttaaacatgcgttatttgtgatttccttgaatataattgctatgcttccgcagttcctaagttcaattttcaggtcatctctgaacaactcggcacggacattttgccatccagcagcagtgccgtcgctttgcatgtctcttcccttattcgtaacgtcctgcgattggctcggaagttccaacggagtgcccgacggaaatggctttcttcggaggacgtcgaggcggcgttggcttattacggacacaccgtaatttga

SEQ ID NO: 69654 - DNA, 507 bp, Heterodera glycines
  Genomic contig location: Contig_ID=SeqID_8925; Location=1276..1782; Strand=+
  SCN-specific regions: Sequence locations=1-212,335-507
  Gene Ontology: Mol. function=SH3-domain binding; Cellular component =lamellipodium; Biological process=response to pathogenic bacteria
atgcccaggcgtttctcccgtgccgcgccgggccctccgcccgacatgccgccaccaccaatgtcggcagctgttgcgcctgttcttcggccgccctcagctgcgtccatgtggggtgccattccggatcctccctccgctccgcttccgccgccacgcagcactttgctcagtgagttcgctgtggacgcgcgtgttggtgacccgccagtacctccgccgccaccaccgccacaaccggaaccaccaccaccgccagagccaccacagccggaaccgcctcaaccgccccctcctccgccgcctccccctccgacaccaccaccaccgccacacccggggatagaaactgcatgtgcaaacagtgattctcatccaaaacaatcttttatattcttcaagaaaaagtacggctacggctatcagaaattcggaggacctccgacatacgctcttccgccgcctcaaactgcggcgacacattttcttaatattttttcagaatga

SEQ ID NO: 69655 - DNA, 304 bp, Heterodera glycines; identical to SEQ ID NO: 51570
  Genomic contig location: Contig_ID=SeqID_41574; Location=111..414; Strand=+
  SCN-specific regions: Sequence locations=1-304

SEQ ID NO: 69656 - DNA, 304 bp, Heterodera glycines
  Genomic contig location: Contig_ID=SeqID_41574; Location=617..920; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcgagaataaaagggctattgcgcaccgccctccctatcatg

SEQ ID NO: 69657 - DNA, 473 bp, Heterodera glycines
  Genomic contig location: Contig_ID=SeqID_41576; Location=64..536; Strand=+
  SCN-specific regions: Sequence locations=1-275,298-354,387-473
ggtttgtccatctgcgcgttggcactttctctctttgcgttgctcctcgccgagacggactcggctctggtgaagcagttgatcaacaacaacgacgagacggagacggaacagcaccagtgggacaattacgcatatgaagaaaaaacagtggtgaagacgaaggacggctctgagcatgagcacgtgcgccaaaatacaattggtaattaattggtggatgaaatgccgggggaatgatcccaaaaaagcgaggatttgtggccaattagagggggagggccaggttggcttgttcgtaaaatcctcctgtcgtcaagcccagcttgaaagtctcgggcttatctcgggctggattcctcccacttttttctcacgttttctcacaatttttttgccaaatttccctcggcgtttagcgactgcgtggcgccactacgctcggcggttggagctgagcggttggctgcgcg

SEQ ID NO: 69658 - DNA, 823 bp, Heterodera glycines
  Genomic contig location: Contig_ID=SeqID_41579; Location=41..863; Strand=+
  SCN-specific regions: Sequence locations=1-559,585-823
atggcttttcactccccgtccggacaatgtgccgaaggtgttcaaatgctggttgtacatggatgcttggacttgcccgtcaaatattgaacaattcaaaacggtgcttttattatttcattttcgttaatcaattttcccgtattttaggcctttgcctcggcttcatctcctgtcaatttcatcgtttccatttgcattccgttgccttttgctgactccgttttgctcttcgatctgaccaatggatttacgcatgaacaattgacgttgacatggatgaacgatatcggccgttttctgctgatccgtcgtccaattgtgcgcgatgaaagcaaatgggcaaaatgggagaaggatgcgattggctggcaattttatgaccaatggaatcgaatcgacatttgggtttcgtgacgctatgatcgacccaagtaatcagcagaagaagtggatgaatgaactgttaagaagtgatcgaccaatttggattgcggatgaatttgagcccatttgacgtttataaaattgttattttgtggcggtgatcacaattgtattatgtatatatgtgtgtataatatgcctctatgataaattaagagatttcctgaaattgcaggctcattcttttgggtcgggggtcgttttcgtacgagcagcacaagtttttagctataacttttttctttgctaaccatttagttagaatgctcgagaattatggataccgaaccgagaaatatgccggttttttcagttatcggtgcgatggcataaattaccgtatttatcgattaacccttttgggaagggttgagca

SEQ ID NO: 69659 - DNA, 655 bp, Heterodera glycines
  Genomic contig location: Contig_ID=SeqID_8926; Location=142..796; Strand=+
  SCN-specific regions: Sequence locations=1-100,136-312,337-514,537-655
tcctctgccggaggctacgaatcggacgagcattcgttgggcagctgctcagccgaagttgcagcaatcaacgcggcggatcagcagcgccggcggcgccacaaccaacaacagcagcagcaggcgaagaaaaaggcaccggcggcgccggcacttcagcaaaaggtgggggaggaaatcagtgatcactgatcagtcgagaattgtgattaggcaaaaaatccggattaaaatagcaaaactgttatcccattgtcaggcggtcgcaactgttgccgccactgcgtcggccgtgtcctccaaagcggcaccgcaacatcagcagcagcaacaactgtacgccaagcaagcaaacgtcaacggcaccgctgctgatcgaccgatgctgccacaaattgttgccgctccgtcgtgcgcgacttcaagaccgcaaccatttcggccccaaccgcaacttggcgtgctgccgcccgcgttaattgctgctgccgcgtcgacaagcggttatggtgatcagcaacaaatgctgcaaaaagtgccgtccattgaacagttgcggttgatgcgtagcagtcaagagcgggctggatctcaggtgaagcagcaaatcagtgggggcgtgatcaatcttggacagatttatgttattgattga

SEQ ID NO: 69660 - DNA, 77 bp, Heterodera glycines
  Genomic contig location: Contig_ID=SeqID_8926; Location=2494..2570; Strand=-
  SCN-specific regions: Sequence locations=1-77
ctcgaaaagtagcttaacaacagcccaaaaaaacatgtttttcgtgcgtttcaggccacggggatctcaggaaaaaa

SEQ ID NO: 69661 - DNA, 1102 bp, Heterodera glycines
  Genomic contig location: Contig_ID=SeqID_8926; Location=1253..2354; Strand=+
  SCN-specific regions: Sequence locations=1-232,254-311,333-368,418 -494,524-938,961-1102
atggccagctcagtacactcccaggacggtttccggccggcggccagctgtctgtccacgctttcgctgcaacgcatcggactgatgggcggcagcagcggaagcggtgcctttcactcctacacgcccaccacagcgcagcaaaaacagtcctccgtgccatttcagccccaaccacaacagcaccaattgaagggctccattcagtcgttgcccgactctgcactttgcacagctgctgctgctgccggactgaaaggtgcgcctgcccggcatttttttgtctcgggacggcaccacaggcagcgcgggcatggcacaaaccatggctgattgcgagaccggtgcacccctcaaaacggcgacgcaaaaaaattaaaatttttaaaaatctcaaaaaaattcttaaaattttttgaagttttttggaaaacctaaatattactgaagataaaaatttatatttcccgagaaaaacgaacgaaaaaattccctgaaaattttttgttttgtttcttgaaaatttcgtaataagtttttttgaattaggttaggtaacgaaaaatccggttttttaataattttttccattccaattccatttttttgcggcaaccttttgccctgtccgggcgctgagacttttcttagcgctgaatgcctgaaaatcttaagaatttctcgcctttatgatgacaccgacaaagacgagacaatagattctcgaggaaatattatttttgttgctttaggctatggtgccgctgtttactcccggcagcagccgtcttcgtttggcaccggcaccaccgtcatggcacagcaacaacagcagaagcagccggtgaacggcattaccacaaaccatcgccaatttgccacacttgcgcgtatggactcgtccaacagccggcccaaacagggcgctggtggtggttcatctacagcaacaaaggctgcagcaacatcaaattgtctccgaccgacagcgcaacggcttctgccaacggcggtaacaacaacagcaacaaccgcgcctgctgaccacgcgtcggcaattgacgcgctggtggccgagctggagctgaacacggcggacaca

SEQ ID NO: 69662 - DNA, 1658 bp, Heterodera glycines
  Genomic contig location: Contig_ID=SeqID_8927; Location=531..2188; Strand=+
  SCN-specific regions: Sequence locations=1-415,440-506,529-889,911 -1060,1088-1127,1150-1505,1527-1561,1583-1658
atgcagacggaagtggccacacggacgaaggcggccaaaattggcggcactaccgtagtcacacggcaacaactaccatcccacaacttcactaatcggtgtgcactgttttattacgataatccctgggtatagaggtgggattttctgatcaaaaaaaccatggattcgaagcacggagtcagcaatttctcaaacagctccactaagcattaggaaaatgccggtttggccactacggtattttgtaccaacgtcagtaggcgcccgacggggggagactgactgtaaacaaagtcattttcaggcctgcgcagcaagagaatggcagcagtaacagaagcaagccgttggaaaagctgaacgaactgatctccatggacgatgagtcatcgacgacgaggcggcacagaacggcacaacagcagcagcaacaatcggctgattcatcggcaccggcaccgtcggcgggtggaaatcggccatttgaaactatcaaccaggagaagctgaacccgtccaaagtggacgcaatggcacggatgttcaatggcaagcagcagcagcaatcggcaactaccgccgcaacatccacaaagccattcacaagcggtggatcagccggcaataatgccacatccgatcatcaggggtgggccacgcgtcgcgcggcaacaatcggaggccgtgctgcggcaccggcggtgccatcctggtccgtcggttcgacgacggcacgggcatggcggcaatgtgccgccattgcttacaaatggacaccacgcgccaccggtgacggccacgacggcacggcagcataaccaacaacagcactcggcgttgaagaagcagtacacgctgcccgcaatggcatccgtggcggccgctgctgccacaatggcaccgctgtcgtcacgaatttatcggggcaacggtgcggcagctggactgcttgaactcggcgggacggccggtcgatgccgaacaaatggcactgggaggacaacaactgcggcggcaaagcgtgatggcgccggcacaccaacggtggtggacgacgaccatggcggcggcacggcggctggcccaaatcggcaagaagggaatggcattggcatttgtgccggcagcaccggccgaagcaacttctacgacaatgtgcaggtggcgtttgccaaatgaatgggcatcgagtttcaaaatcattttgtcgggaccgggaaagtcccgactcgcgactttggcatttgtatgcctttctctgttttatcattttgtaaatcattttcatagagtgccgcgcggaacggacgctgcggcggcgggcgaacatcgccggctggctacagcttcagcaacgactccgtgtcgttgtgcagtcagtcggacgcggcactacctccggcgacgagcaaaggcggcacaaatgctgccagcaatggcacgggcggcggagcgggtggccgcatcggacagctgatcagaaagttgggcagcagcgttggcggaggcggcggaagcggtgccaaagtgccgtccagcgccacctcaaccctctcgttgaacagggtgagccccagccaagccaatcggccatgatttgatcaaaatgggttcagccaaatcaatcatcccacccggatcgccaaaagagataa

SEQ ID NO: 69663 - DNA, 372 bp, Heterodera glycines
  Genomic contig location: Contig_ID=SeqID_8927; Location=2957..3328; Strand=+
  SCN-specific regions: Sequence locations=1-102,124-372
atgccgattgaccggttcccgaaatccgagaaatttctcgacctaagaaccggagccaatagaaaatcatccgatcggttcttgccatcctttggctgtgtgccaacttgccctttcaaaatttgatcagattggcttttaggtttttcgcataaatgccggttgatcgataagtccctgaaaatcccgatcactctgatatacttcatcacaaaacaaatcatatgtaaatccagtgatcaaaaaaggcttataatttgcagccaagcaacttcaccaccacaacaacaaccgcaacaaaacggcggcatcggaaaccgtttgaagcagaccattttcgggagtgccatccgtcgtcgggtgccaacctaa

SEQ ID NO: 69664 - DNA, 533 bp, Heterodera glycines
  Genomic contig location: Contig_ID=SeqID_41582; Location=162..694; Strand=+
  SCN-specific regions: Sequence locations=1-56,95-235,258-322,345 -348,386-456,478-533
atgtttttaaatcttttattattactgagcttatcatgcatttgtcaggccgaaggtaaaatattaaaatattaaccaataaataaataaatttgcagtattaaattcgatgaaaatgatggaattggcacgtttagctgtcccttttgctaacaatgctaatccaaacaaacatttatttatggaatggattgataaatatgcatttcgcttattatgccagaaaaactttttggaaataaatgcaaaaaattattttgtaagtgaattatcaggatggtatgaattaggaaaaattcaaagcaatttttgtgaagcatttgctaaaggggaaatttcaaaagtaacagaagaaaattgggaaaaaatgacaattaaatttgcaaattattttgacgagacgcaaaaaaatgaagaaaatattcgaaagaatattcaaaaaatcaatgataaatttgtgaaattctttggaaaggaaacagacaatattcttgataatgtttttgatgcactcaaagtgatagcagacatag

SEQ ID NO: 69665 - DNA, 1260 bp, Heterodera glycines
  Genomic contig location: Contig_ID=SeqID_41585; Location=36..1295; Strand=-
  SCN-specific regions: Sequence locations=1-161,183-251,273-279,302 -860,882-934,956-1043,1065-1260
atgtcacgacatcgtgagcagcaaatggcgggggaagacgcggcagcgtttgcggcgatacattcaaagtaatattagcacaggacctatggcatgctgaggggcgtaatgaaacccgaaaaatgaaaggagcgagggggcaatgaaatctaaaaaaaaaattaaaatcttactaattatttttcttacgatattcaacttttctccagtgcgggcttttttcataccaattttttcggagcgctttccatttttcagaaatttcccccttcgctatgcaaaaaatttaaaaaaaaaatttgtgaggtgggacgattagctgttgccaattttcggcttttgtggctacggagccagaaacagtcagaaaattgagtaaagtcccgaaaaagcgataaattgaccagttttgtaagaaatttttcaaatctaactgggagctacagacttttttttaatactgagtttaattccttttattcagaaatgatgcacagcaacaacacattggcaaatggctgttctacgccctgttgatgctgttgttgctcttttccggctacacattgtacggcgatcgacgccttcgtttggccggcaacaaaacgcaacagcaacaatcggtggaggaaattgtgccacaaatccatggaaaaccggaccgggagcagttgttgaaactgaaacgtaaggcaaaaaattaagggtatagaaaatgtaactgctatccttaaaagttgcctatttccctaaaatttacctaatttatcccccccccccccctctctcctcacctcccggtttaatggcaaaccgtataaaaacgcatagcatgtttgtttaaccagttactaccaagccacaaaaatttgaaaatgaaatttctggactttcaccccctcctccctattccatccccggcaaaaaaacaatcaaaggggcaaacaagaaattttgtagaaaatcagcggttctttccatttatcccatatttgtcctttagcatccgatgaacttcatcagacgcatttggctcagcccggcacaccaaaaaaggacattgtgatggaccaaccggagcttcatttgacgcaatcgcttcatccttcaccgccgccgccgcgtggcgaagtgccaattgtcgacgaaatatcggcacaaccgcaattcatctaccacacgacaacaccgtacagcttctacgaacattttgacagagctggccaatccgtctgggaattgatccgtataacattttaa

SEQ ID NO: 69666 - DNA, 59 bp, Heterodera glycines; identical to SEQ ID NO: 52421
  Genomic contig location: Contig_ID=SeqID_41586; Location=81..139; Strand=-
  SCN-specific regions: Sequence locations=1-59

SEQ ID NO: 69667 - DNA, 59 bp, Heterodera glycines; identical to SEQ ID NO: 52421
  Genomic contig location: Contig_ID=SeqID_41586; Location=211..269; Strand=-
  SCN-specific regions: Sequence locations=1-59

SEQ ID NO: 69668 - DNA, 59 bp, Heterodera glycines; identical to SEQ ID NO: 52421
  Genomic contig location: Contig_ID=SeqID_41586; Location=341..399; Strand=-
  SCN-specific regions: Sequence locations=1-59

SEQ ID NO: 69669 - DNA, 59 bp, Heterodera glycines; identical to SEQ ID NO: 52422
  Genomic contig location: Contig_ID=SeqID_41586; Location=471..529; Strand=-
  SCN-specific regions: Sequence locations=1-59

SEQ ID NO: 69670 - DNA, 59 bp, Heterodera glycines; identical to SEQ ID NO: 52422
  Genomic contig location: Contig_ID=SeqID_41586; Location=601..659; Strand=-
  SCN-specific regions: Sequence locations=1-59

SEQ ID NO: 69671 - DNA, 59 bp, Heterodera glycines; identical to SEQ ID NO: 52421
  Genomic contig location: Contig_ID=SeqID_41586; Location=731..789; Strand=-
  SCN-specific regions: Sequence locations=1-59

SEQ ID NO: 69672 - DNA, 59 bp, Heterodera glycines; identical to SEQ ID NO: 52421
  Genomic contig location: Contig_ID=SeqID_41586; Location=861..919; Strand=-
  SCN-specific regions: Sequence locations=1-59

SEQ ID NO: 69673 - DNA, 59 bp, Heterodera glycines
  Genomic contig location: Contig_ID=SeqID_41586; Location=991..1049; Strand=-
  SCN-specific regions: Sequence locations=1-59
aacatttcctttctctagtctggctctaccaaacactcacacgatatttgaaatgctaa

SEQ ID NO: 69674 - DNA, 913 bp, Heterodera glycines
  Genomic contig location: Contig_ID=SeqID_41587; Location=330..1242; Strand=-
  SCN-specific regions: Sequence locations=1-295,344-382,405-416,438 -503,526-878
atgccaaactttttaatgatgaaataccagtggtgtagcggtagtgcactagtcagtcgcgaccaatgattttgtgaaaaacaaaacagaattcagtgtaatcgtaataaggattgaaatcccggaataccgtcctaatccttttgcgaagcgtgattctttgcgatctcttctaattaattggaatttaaatatacaaaattatttaagagcacttgtggtctgagttattggattcaaacgcaattaagaagcttcgagtacttttgactgaggtgatcaaagatcataatacaatttaaaattaaaaaatttatttatttttaggaaattaattatttaactccgcccgaatttttgtcttcgtcctcatcagaaaaagagcttttttgggaaacacaaaacgaatttgaaggagaaagggaagaaagctgtgccaaaaatggacaaaccgtaaaaaatgaacaaagtgccgaaacgcaaaacggacaaatcgccaaaacagaaagcgaaatttggcaaatgataaaaagcactgaaaagaatttggcaaatgaaaagaaaaatgatcaacggaaaaggaaaaaagtttataaaaagtcgcaaaaaaatgagcaaaattcgatgaaaattgagaaggatggagaaaaagaatttaaacaaacgccgaaacagaaaaaggacaaagtgtcgacaggacaaaatgtaaccaatggaacagttaaaaatggaaaaataaaaggcgaagaagcggaaaatggacaaaaaaataaaacaaatttaatggaaataaaagaggaaaattcagaggaaatgagcaaagaagaaaagggcacaaaagaagcattggaaagaattggcatcgaaagaatatttggtaaataaaatataaaatggaaaaaataataataaa

SEQ ID NO: 69675 - DNA, 1836 bp, Heterodera glycines
  Genomic contig location: Contig_ID=SeqID_8928; Location=204..2039; Strand=-
  SCN-specific regions: Sequence locations=1-167,189-391,413-835,858 -988,1028-1028,1051-1188,1215-1293,1317-1836
  Gene Ontology: Mol. function=serine-type peptidase activity; Cellular component=Golgi apparatus; Biological process=EGF receptor ligand processing
atgtacacccactcagtctccgctgattctgaacccgtgcttaaaatggcaaatctggcgatactttacatacagtcagttttcgccgtttcaattgaagcacaattatttgcatttttagtgtttgtacatgtcgggtgagtttttttaacattttataggagacactttgtttaagtgttttctttcttacagttttgtacatttgctcaccaatctcgtcgtgcaaattctattaggggttccgttggaattggtccacaaatacggccgagttggctttttgtacctcgctggtgtgatgagcggcgctttgctcttttttgtcactgacagagaagtatatttggccggcgcgtccggaggagtgtaagaaaagagagttaaattgaatctttttaaaataatttgaaaaagcatgattcacattcattttcattgattctaagttcagttacactctactttctgcgcatattgccaatgtcatcattaattggagcgaaatgcaattcaattgggtccgtgcttccattctttctactttggttacggccgatgttgtgattgccgtttaccagcggtactttagcgacatgccaaatagggtgaggaaaaggcatgacaaatggggaaaagggggacgaaataaattggcacaaatgaattttatccaacaattcgcccgtgtttataaaactttccaaggtttcctatgtttctcacattggcggctttgtgactggtctgttgcttggcattgtgcttttacgcaactttcgcaaattggaatgggaaaagtacgcgtggtggtgtgccctcgtcatcttcgccctttttgtggctgtttgtttgttgataattgttttccgcgaaatctcttcaccggaccctcaaatttgtcgttttcacaaaagtctgtgagtgttcaaactttggaagttttttcgcacttaaatctctcctcacttttcccataatatttacctaatttattttattatttatttttcatttttttattaaacattcaaatatccacttaatatcacttcgtcttactttgctgatatttcaaaatctattttggtccctttttgtgccttgattttattgtatacacgccattattgtattaaaattaaataaattccactgacaaatgatttatcttaattatctttccgtaaaatttatttaaaacatttttgggacggaagtggtcttgtttttttggtcggcgggtggtaatttggcgaagttggttcccaaaaaagattgaaccaaccaatcataatttaaaaataattatatatggatgggaggccgggcatagaaaaataaaagctaaagcagagaaactttggccaaacaccaaattttgttttgaaatgacgtgatttataaaaattctaacctttaaaaaggaccaaccgggctaatctttaatcttttaatagtcaactcatcaatttgcagtggttatgaaatataaaaccaatccgattaaagccgattacaaaattggcaacaatgtgagtttattgtgtgtttgggtggcattttcaacaaattcacaaaaatggcatttagaaataattgacgaatccatcccaaaatctgattgttttgaggttaataaataatggcatccgtatttttaaggttcttggggtcggaatcaacggaaaagtggtggaatgcgaacatcggacggacgggaagaaattcgcattgaaaattctgcgggacattccgaaggcaaagcgcgaggccgaattgcactttgtggccagtgggcacgcgaacattgtgaatgtttacgacatttacgag

SEQ ID NO: 69676 - DNA, 787 bp, Heterodera glycines
  Genomic contig location: Contig_ID=SeqID_8928; Location=2781..3567; Strand=-
  SCN-specific regions: Sequence locations=1-24,46-729,751-787
atggcaactgttagttcatctagcaataatacatgtaaaccaagtgaaagttattccgcctcaaaaatacctcaatgtgcggaaacaatcaaaaaaatgttccacgaattgggaatcaaagagtacgaaccgcaattagtcttacaagttagttattaaagatctacccaatattatccacgttaaccactttcagttgtgtgatatttcttactcattgaccaaggagattctcgtcgatgctcgttctgtttccgagtttagtggcaagaaacaggtggacagaagcgacgttgaccttgcgatcaaaacatttggtaaatttttgtgcttttatcgatctcagctttttttctatcttttaagatgaaaagcacagtaatgatcgcccaccaaaagcttttgtgtcggaattagccgcagaaaaaaatgcactgcctttacatccgatacgtcaaaattatggactccgtttaccgaatgaccgtttctgtcaactgcagcccaattacatatacatcggagatgatccgaacaacgaagaccaagcagtccatgtgattttttttatttcctttttgcctttgtaaaatattttttaaagatggaagagcggcccagacaaaatggatcgtcgaaattcaatgcaataaacaattttgatcctgaatctgtgtccaatctcttgatgacggacaaaaatgctactcaaagaaagaggccatatacaaacggagaaatgcagaaacatacgcaagaagaagattacgacgatgaatatgattga

SEQ ID NO: 69677 - DNA, 324 bp, Heterodera glycines
  Genomic contig location: Contig_ID=SeqID_41592; Location=357..680; Strand=-
  SCN-specific regions: Sequence locations=1-266,288-324
atgacgaaaaacggcgcagaatttggcccagctcgatactgggatgccctgttggaacgcgaagcctttgagttgaaccgaccgccagccaacatttccgaggcagccgacgccaatgagcaggttctgcaatcgcacttggtcgctgatgatgatttcgaggagatggatgacgacgacgatggcgaggaggacgaacaagacgagaccgaagtcgagggaggcggggagttggccgattttgacgtctgttatttctgttgtgttcacttaagtgcaacattttgtttaggacactttgctcgactacgtgacagactttaa

SEQ ID NO: 69678 - DNA, 144 bp, Heterodera glycines
  Genomic contig location: Contig_ID=SeqID_41594; Location=167..310; Strand=-
  SCN-specific regions: Sequence locations=1-144
gcgatggccgaccaaatcattcaccgcattgacgagatgacccagcgggtggacagcctggagaagaacatcaccgaaatgatggcctccgactcggcgctcgtggcgagcaccagcggaacagtggacgaggacaaccaatga

SEQ ID NO: 69679 - DNA, 314 bp, Heterodera glycines
  Genomic contig location: Contig_ID=SeqID_41597; Location=241..554; Strand=-
  SCN-specific regions: Sequence locations=1-268,306-314
atgatgttcgcttctgctgtgtttgggtcgatgttccgttttgatgacaaaaactcaaagactaaaagtaaacaaaaaaaaataccgaaaatatttctaaaaataatttttcatcattttttagcctctgccgactgtcctcacgtaattgaggtgcctgatgttgaagcagaagcgttcaaagcgatgttgagcttcatttacgcggaggatttaagcgaattgaacggacaaaatgccatggcagtgctttacgccggtgaaaatgtttaaaaaatattaattttttaatttttatttattaagcaaataaa

SEQ ID NO: 69680 - DNA, 907 bp, Heterodera glycines
  Genomic contig location: Contig_ID=SeqID_41598; Location=195..1101; Strand=+
  SCN-specific regions: Sequence locations=1-657,679-801,823-907
atgacaaaagcattgtacagaaaagcgaccagcacaaaggaaagccatccgacgtacaaagagccttcagaatgggaaaagcgatcagaaacagtgaccaaaggagcgaagaagcaccgaaagtgtcaatgtgagaaggcaaaaggcgcgacggagtggccacaatgtcctccaattggtcaccctttaaattttcaatagtttttaggccccaagtcattcagtgcccccgggggatcacccggtgcagtccgatcagtgacaccagcgatgcttttgcccccgcttccgagtccgccaccgtcgtcccctcctcctccgcgcgttcgtcgtccggcgtcggctcgcgcactaactgaacgtccagcaaaagtcaatgaatcggctttccctcccaaatgctcttctcattttacctcgtcacgaactgcagaagtgcgtcttctaaggtcgcgcgcaaattcgtgcagtttttccttgacaatgaaagaaagttgagaggcggtgtccgtgtgatggcgggaactgaaagaaatggacgaaaagccgagtaaaaaggccggggggggggggagtggcgccaaccttgcggaccaggccgttttcgcgccagcgcagtttttgaagtataactttttttcattgtcaaccaaatcaaaacagaaaacttcaaaaaactggttttctaaacatttttggccggaacttttttgaaacttaatgaaaatttcacaattttgcaggctaatagaggaaatatagggctatcgaatgatagcaagaaagttggatttggttgacaatgaaaaaagttatagttcaaaaactgcgctggcgcgaaaacggccggcgcgaaaacggcctggtccgaaaataggtttttcaaaaaaaattatatgcttaaaaa

SEQ ID NO: 69681 - DNA, 828 bp, Heterodera glycines
  misc_feature (120)..(120): n is a, c, g, or t
  Genomic contig location: Contig_ID=SeqID_41600; Location=146..973; Strand=-
  SCN-specific regions: Sequence locations=1-64,101-266,288-346,405 -411,433-501,524-828
  Gene Ontology: Mol. function=sodium:bicarbonate symporter activity; Cellular component=integral to membrane; Biological process =bicarbonate transport
taccgtaccggggagacttttcgggggactgatggccgacatacggtgggattggggaaaaaacaaaaataaatattccaaaatataaatatataattatcccaaaatataattcccccnccttcttcatcaggcgcaaattgccttggtttccgtcggatttctcggatttcttccgcggccgtctcagccaatccctcgccgccaccatccttctgttcttcgccaatctgtccaacataatcactttcggcgccattatggagcgttctttccaccaccaaattgcttccattgaaaatacgtttgaaaattacagaattaattactcatagttgttctcctaaattaattaatccaactaattaattaactaattaccccaattaatttgttaattaattgtctctctcttttcaaatataatttgtggcgctctgtccggccttctctttggcctattcagtgggcaaccgctgagtttgtttccctaattctgtcaatgttctctcccatccttcagatgttctgtccgccaccggtcccactttgatctttgagaaaattctttttgatttttgcacgtaatttttcaattttttttaaaatttccgccatttccgcccttccctttcagtaccaatcattgggagtttctgccctttcgcttttacgtcggcctttggatgagcttttatctgatcattttggtggccaccgatgcgtccgcgttggtcgcactgatcactcgcttcactgaggaggcatttgccactctgatctcgatcgtgttcatcatccaagcattcgaaaagttgttcgagatca

SEQ ID NO: 69682 - DNA, 370 bp, Heterodera glycines
  Genomic contig location: Contig_ID=SeqID_41601; Location=160..529; Strand=-
  SCN-specific regions: Sequence locations=1-116,185-370
atgcttcttcttcttcggtcatcaaacccaattagcgaaattattcatttgtcagcaaaacatataaaaaaacgtaaagcaatgtgtccaattaactgtgatggtcaatcaaccattggtactgatgatgctgatggtgttgttgttggtacagctgcggtggctgctgctgatagtgctgctgtgccatcgaagcggcatccaacgccacgcgtctgtgctgctcgtcacgcgcccgggccgcctcagtcatcgcattgcgcagccagtcggaccagtaccaggagatctcgtacagcttcaagtccacctgtggtgatgggagaatggcaatgtgtgaaaaaagtaaggaaggatgaagttggagcag

SEQ ID NO: 69683 - DNA, 1222 bp, Heterodera glycines
  Genomic contig location: Contig_ID=SeqID_8930; Location=597..1818; Strand=-
  SCN-specific regions: Sequence locations=1-187,209-435,458-682,704 -1222
atggcgcccgcaccaaatgcgggctccgccggcgtcggtaacattgaggcagctgaatagcaaaaacagtttaattggctccttctaacaaggaaaacacactcattttactaattgattattagctaaggaaatatgttcttattttaaccaaatggctgcttaaatttttagactctgtcaaaaatagggttggggtcagttccatactgccgtttccataccgccatttccataccggccgtttccataccaaggcatttaggccatttccataccaaaagtttaagacattgaaattaaaaatccaagaaaaataacattttatctgtttcaaatcacggtctcatttcataatttcgagaaattccgatcaaaaaagcaataataaaatgatgattaaaaggctgatgaattgggaaaatgttggttttactttattatgtcattttcttcccaaaaaaaaaataaatttcagattctaataggaaatgccaactgttcaaggaaatatttgagagttctgcaaatgaagacggcgtactgaatgttaagaggactgacgcagaacaacaggtgaaaggcacttcgaccagcaacaatttgaacgtcgcttcgagcgatgatgaataaaattgtgagtctgttcaattcaaaggtggcgaaacaaactgaggagcgctttgtcttttgctttttgtttcattattttcaggcttccgattaatcaaaaacagaaaatatggtagctgattcaggtgcgaacaacgcaattgaccagctacagccaaattgggcgacaacaatttgatgaccggcattttgggcctaaaagaacatcaccatggttaagcttcatcgctttatgatgctgagacgaaacgaaatcagatgaagcgcctgatcaaggagaagccaaaaaagaaaccatgtcaactccgcgcacaaaattcggactgacagtcttcgaattgctcagcaccatgaagcgctcgaccaaatggcgaacaggtcgacaaaattcagagaaaatgatgatattggggtggaaactaagttctgtcatagctgggagaaattctttattaaaatttataacaaatcaaaacgaaacccataaatcactcaaagtatctccactgattctccacaatcttctgccatttttgagaatttaaaaatgatctattgattaaattcaagatagtttgactcaaataaa

SEQ ID NO: 69684 - DNA, 133 bp, Heterodera glycines
  Genomic contig location: Contig_ID=SeqID_41602; Location=81..213; Strand=-
  SCN-specific regions: Sequence locations=1-133
gcgcaggatcctgcagattttaaatgcaggattgcaggatttgcaggattaatcctgccggatcctgtcctgtaaaaaattttgaattccaatcctgcaacaggatccgcaaatttgaaatttccggtctcta

SEQ ID NO: 69685 - DNA, 140 bp, Heterodera glycines
  Genomic contig location: Contig_ID=SeqID_41602; Location=904..1043; Strand=-
  SCN-specific regions: Sequence locations=1-55,79-102,131-140
gagtgcctaaaataacttgcaaataaaatttggtgcgtttcagagcagtttctgaaaaaatatttatgaattcattttgctaaaaaaataaaatagtgaagctttaaaaattaataaaaaattttaaattcagaattact

SEQ ID NO: 69686 - DNA, 399 bp, Heterodera glycines
  Genomic contig location: Contig_ID=SeqID_41603; Location=1..399; Strand=+
  SCN-specific regions: Sequence locations=1-399
  Gene Ontology: Mol. function=protein binding; Cellular component =cytoplasm; Biological process=synaptic vesicle priming
aaattggaaatcaaacatttcccatttttggcaggacgtcaaattagtcagccctaccggttggcatattaaaagggtggagtatttttatttcttttactaattcagggcacccacgagcgctcgctatggccaatggcacaaggatcagcgttactcgcagatgcgctcgggcccgcgactgatcattttcattgtcggtggcgtcactttttccgaattgcgatcggcttacgaagtgaccagaacgcaaaagacgtgggaagtcgtcattggttggtcatatacctgtttgtatcatatttaatgccaatattttgatttttaggttcagatcagatcatcactcctgaacgttttctggtcaatttgcgtgagttgagcaaaaaatctcacgat

SEQ ID NO: 69687 - DNA, 238 bp, Heterodera glycines
  Genomic contig location: Contig_ID=SeqID_41603; Location=481..718; Strand=-
  SCN-specific regions: Sequence locations=1-178,227-238
atgaatgacaaaaagagaattgactggaatgtgaattaaagcttcgaaatttgaatgtgacttgaattcgatcaaaagaatcaaaatttaatcaggtgcgacaggatcaaaaggagaataaataatgtgcaaatcatttatatataatgtacaatgatttatgttttagaaaagggtatttttccttgcgttttaatttaccttttttaaatttacataaatcaatttggggaataaa

SEQ ID NO: 69688 - DNA, 478 bp, Heterodera glycines
  Genomic contig location: Contig_ID=SeqID_41604; Location=217..694; Strand=-
  SCN-specific regions: Sequence locations=1-248,280-377,402-478
cttcttctcgtcagtgaagcggactgtgccgagccaactgaagtgccatcaaaatttgatggacgacttatggtgtggcacagaatgacttttagctttggcaatgccaaaaattgttccgaagccgtcgcacagttaaaacagcagcaaaatttatggtggcaaatttggaagggtaccaattttttaccacaccgtgacgtaccgtacatggcacaatttggtacggtatttgttttttttctttcaaaaataaattaatttttagattttttaattgccaatcgtaagctgatcaacgaattgaaatcattccaattcaatgtgggcattttggagacaggcatgggtgatttttcgatgagtattctccgcgcatttccaaccatcaaaaaatttgtcggctcacaaagcatttcgccaacaatttcacaatggaaatattttggctatgacaaaattgttggcgcaatgccag

SEQ ID NO: 69689 - DNA, 178 bp, Heterodera glycines
  Genomic contig location: Contig_ID=SeqID_41605; Location=879..1056; Strand=-
  SCN-specific regions: Sequence locations=1-37,60-67,89-131
ccagggaagaattgaaaaattttttcatgaatatctcaaaaagtaaaatttaatttttgatgtgaaattaaatcaaatttttaatatcaactagcgcagatgcgctcgcttcgctcgcgcacctcgcattcctttttctttttctctctctctctcccgtctttttatctcttctctt

SEQ ID NO: 69690 - DNA, 731 bp, Heterodera glycines
  Genomic contig location: Contig_ID=SeqID_41606; Location=40..770; Strand=-
  SCN-specific regions: Sequence locations=1-731
atgacaccaaatcacagaacaaataatgccaaaggtaatcaatcgaaggcaaaaagcaaaggaaaaaaaactttcagaaattcgcgaggcaatctttgcaacgattgacccaaaacgaattgcggaaaatttgcggcaattcacaaaagagccgcacgtggcggggacagaagcgaataaaagggtaaatgaacaaaagaggtaaaagactaatgcacgctaattgactaaatggaggtggctgagaaaattgcaaagatttggaagcaaaacggaattgaaggtaattggggggggggggagaggacgatcagtggtagaatcactgatcggacgggctcttcccggactgaattggccaacccttcattgttctttcccagacgtgcattttgtcccctacgacgtgctcctctcctaccccaacttctcttctcccaatcatctctccgttctgtccgccgacggccaagtcaatttccgcatggacggagtcagtcccgaacttatggcgcccaattcggaggacctgcgctcgtccatccaatggttgacatattctgcccgaggaacgggggaaggcgaagcggggtactgtcactacgggagagaggaggactttgaacggctgagcaaagagtttaatatcaccagcttaaaaggtgattgaatggggaggaaaagccgaaaatgaaatgaaatgccaacagaaagaaaataatggtaataaa

SEQ ID NO: 69691 - DNA, 158 bp, Heterodera glycines
  Genomic contig location: Contig_ID=SeqID_41607; Location=388..545; Strand=+
  SCN-specific regions: Sequence locations=1-54,109-158
atggcaattccgcttaacattagtgcggcatcgaattttttatattttacgaggtaaattaaaattaaaatgattttaattatacaacatatttttattataattttagcacggaatatcgacaagcatttcgagataaatttccaacgaaattttaa

SEQ ID NO: 69692 - DNA, 1006 bp, Heterodera glycines
  Genomic contig location: Contig_ID=SeqID_41611; Location=23..1028; Strand=-
  SCN-specific regions: Sequence locations=1-37,99-256,307-404,426 -452,502-716,773-1006
atgcttgtggcaaatgaagcagcaaaagaagttagtgaatttaatgaatttttaaaatagcaattaaaatatattttaatttagtttgaaaattatttgacgtcgaatgtcttcaaaaatatttatgttcaacaaaatttctatcgaataaaaatggaaggagctttacagcaaattgttaccgtagttgaaaaatgggtatgattaaactgtaaaaatatgaagatgtattttaaatgacaaaaaccccaattagaatttatttaaaaacagtattttaactaaaaaaattgttttaaaattattcctaaaggaaatccgaaaaagagattttttaattatcaaaaggattttggggaccgataacatcatgcaaaaattgaaaaatctattcatattttttctctacaccaaaagggaaaatatacaaaaaaaactcataaattctcgagaaaattattcaaaatttttaaatttaaaaatttattttaattttattttgcattttcagtcaaatggcctcgcccaactgctcatctcgggctcccttctgctccattcgcacacaattggctccgatgttaatttggtgtgcttaacgccgggtgaaaagctgaaagtcagcgattttatgggagatgacagaaaatcgaaatgtgaggaaaataaatgcacggatgaggcaaattcttcacttttttgccaaatttgcgcggtaaattaatcaattatttaattaattgagcaatttgtaattaaaataaaattaaaaccaaaattttagcacaaaagcacaacaaatcttatcaaaattgagtcggactcacttttgattgtccgctttcaatttgatggcatcgaatttgacatttcgctggtcgcaattccaaaaattgaacaattggaaaaaataaatgccgaaatgttgcaaaaattagcggaaaaatttaacgattcaatctttgagcagaaaaatatgggccgaacattagcaagtaaaatttag

SEQ ID NO: 69693 - DNA, 691 bp, Heterodera glycines
  Genomic contig location: Contig_ID=SeqID_8932; Location=296..986; Strand=+
  SCN-specific regions: Sequence locations=1-608,630-691
atgacggagaagtcggatgacagggcggtgagtccaactgaaactcggaagagggatgtggattgatggttgtgtgtgaactgctcaaaccccaaaaaattcagcgtccaagtgcatcagtcgttgtgcttcctggaaggagatgttctgcagttcgaccatctcttgtgcctgttgtgccgattgcatttgctccaattgcggcaggtcactatcatttggcacaattgaacggataatgttgggcggaaaccatcggagttccgacagaggccaacgctgaccaagatcttgcgagctgaactggaggtggtcggcgccgagcagtttgacagcgcgaaagacagccagcagaaagagacggtaatactccggcatggccatcaacggattgggcagcgttttgcccatcaacagttgggaaaagttgagcagatcttgtggccacgtgcattgcacaaagcgttggatggtctgttcaagaagggcacacagttgcaacgtattggaggagggacacggggcagtggagataggactccgtactaacgcctcaagcacctgtgggacatggaacaatgcagtggaaaagtgaccgtatatatgacttggtaaagaaaacgggaacgcatttcgatgctccacttccagccaaagacaatgttttggaggcgaaagttgtgcagctcca

SEQ ID NO: 69694 - DNA, 2937 bp, Heterodera glycines
  misc_feature (1574)..(1574): n is a, c, g, or t
  Genomic contig location: Contig_ID=SeqID_8932; Location=33..2969; Strand=-
  SCN-specific regions: Sequence locations=1-63,86-270,292-698,731 -816,838-1401,1423-2045,2067-2703,2731-2937
atgatcgcttcgtttcggcccctcgccgaaattggttccatgctcggccgttcctggatgtggcccgtgcccgcttcgccctccttctcttggagttctccgacgtgcagtgcgtggaaattagacgaaaagcaatgcaaactttacttcaagacgcacttgccgtacagcaggtgattcgattcactcaactaacaatccattgggtttttgaaacagaacttttcgaataaattgtattttcattccaattaaatcatattttcagtgaaaataccaccccacaaacctacttgcagtatattctcttcaaacagccccatggccaagacaatttgaacgtaatcgccagtttttagtgagttttgttcactctcctctccaattaagcacattctccgttcgtcaacttcacagactccgtgctcccgtatccaatgtgatgaggtcattcaactgctcattttggaggcgatgtgcgccatggaggactcggaacagcccgtgctggcgccggtcaaccagtacaattggctgcacctttcccacttggtcactcatgctctgtacatgcaaaactgcacattgaggtcaaatattttgtgtcaatttattacattttcttaatttattttcaacttcagtgagctgttgaaaatgttgctgccacagttgagaagttgtcaagtatcgtcgcccaattttccaatttgttcatttatttatttctccatttaatagtatttgcgagcgaaggacgagttgatgtggattctgctccaattggttgcctacgcccgttatcgcgagaagaatttggtccaacagcagcagcaacaaaatggccaatgcggggcacaaatactctccgtcgttgggttgggcgcacagaatcgggaattggttttggatatttttaacgtaatttggtcacaaattggcaataatttggttttcactctaattgctcttaaggttttgtacactgacaagaacatgaattgggctaccacctgttccacggaaaaccctctgaatatggtttttctcatattggccattgctttgactgactctttgtcaattttatgtccgattttttgctccggccgccatttggatcaatttggtgcacccagtcgcttttcccattgcgtccacttcggaagaaagtcagcctcagccaccggaaaaactgaagccactcatcgatttcatcggtttaaactcaacgaaaatatcgtcaaattatttattttatccagaaaaacagttggatgcaagcaaaccgctggacaaaacgttggcccttctggcggtcattgccaattcgtacagcaacaatcgcgaggtgttcgaggaacacgtcagctccgcggtgtttcggattcttggccagagcattgttcatcaacagcaagtgctatttatacaaaggctcttttagcttttcctctaactgtttttagcctcatccacccgaaaagtgttgggttttgccccggcggacggcgaactgaacagaatttgcgtgcattggactgacttttctggactcacttactttccatgcncaatttgcaaattaacagtcaacatttcgtctctacagccaattattccataaagatgcgacacctaattttgcattaataaggtggtccaccaatgttactccattttgttgtctttttacggaatttttcagattgccaaccccggcactcgtggaaagtttggcacgacttttgttgagcacggaattggtcagtttttcggttttttccactattaaccatgtcagatcgaccttaatggcgccgtcttttacacgcacattgtctccgctcttcattatgccaccaacgttccaacgaatgaaagtgaacagaaactttaccccgtccgaattgatttcttagcggtccgtgcaattatttcacaccaaattcacttggtttgttctcaaattcaaggttttattggagctgcacaactttcgcctccaaaacattgtctttggctggaagtggagcatcgaaatgcgttcccgttttctttaccaagtcatatatacggtcacttttccactgcattgttccatgtcccacaggtgcttgaggcgttagtacggagtcctatctccactgccccgtgtccctcctccaatacgttgcaactgtgtgcccttcttgaacagaccatccaacgctttgtgcaatgcacgtggccacaagatctgctcaacttttcccaactgttgatgggcaaaacgctgcccaatccgttgatggccatgccggagtattaccgtctctttctgctggctgtctttcgcgctgtcaaactgctcggcgccgaccacctccagttcagctcgcaagatcttggtcagcgttggcctctgtcggaactccgatggtttccgcccaacattatccgttcaattgtgccaaatgatagtgacctgccgcaattggagcaaatgcaatcggcacaacaggcacaagagatggtcgaactgcagaacatctccttccaggaagcacaacgactgatgcacttggacgctgaattttttggggtttgagcagttcacacacaaccatcaatccacatccctcttccgagtttcagttggactcaccgccctgtcatccgacttctccgtcattgctcgtctcaatctttcgctgcctccacgaattcaccaatttccatccccaattgccccccggcaagcagtcccaccaaagtgcgcccaatttcccggccctttgctacaaacttctttctctgcaaagcaaccgcgacgtgcaccggtcaacaaacgctttggtggactatttggtttggaagtgccaaggggacgcgtcacaagcgccgtcggggatgcttaccgacgaatcactttcactgcagcaaattgacttgagg

SEQ ID NO: 69695 - DNA, 49 bp, Heterodera glycines; identical to SEQ ID NO: 51181
  Genomic contig location: Contig_ID=SeqID_41613; Location=510..558; Strand=-
  SCN-specific regions: Sequence locations=1-49

SEQ ID NO: 69696 - DNA, 584 bp, Heterodera glycines
  Genomic contig location: Contig_ID=SeqID_41614; Location=58..641; Strand=+
  SCN-specific regions: Sequence locations=1-584
atgaatcgccaaattgatactaaaaggcaaaagtctaaaatcacgcatgaagggcacctttacactttcgataaagcaagtgcggacgggatgacaaaattttggagatgcgaattcaaggacatttgcaagggaagtatctggacgaatttggctgatcaattcatacgtttggcgactgctcataggtgccctgcgaacgcatcaagcgttgaggtgcagaaagtcaagacggcgataaaacggcgtgcgctcgccacatatgaaccgccagcagtgatccgttccgaggcacttcaaaatgtgccgtctccagcaggactttaggttacacagaatagttcaagacaggtactgttcaattaatgatatacaatacaacgaatgaattgttaagatcgtcaaaagggcacgacatgaagtaatgcaccacctgtggttcctaaaagtgttgaccaactgattgtaccgccggcataccgaacatataagcctattgacggtgatgaatagcagttcctattgggtgactctggtgtgtattacgaggccggaaacgaaaatccgcagaggtagttttttga

SEQ ID NO: 69697 - DNA, 518 bp, Heterodera glycines
  Genomic contig location: Contig_ID=SeqID_41614; Location=720..1237; Strand=+
  SCN-specific regions: Sequence locations=1-377,418-518
atgaaggagtgtttcggagacggcacattctcattggcaccgccaatgttctatcaaatttacacaattttggccaggtaatgttttttctcttgtgatttaacaaggcaaattatttcaaggcgtggtgcgtgggttattgttgtgtgccattgcctcctgacgtccaagtcgcaggcatcctacgaaaggatgtatgaacttctgcggcaagcgtggccgacattctcgccaacttcgtttaccattgactttgagacagcagcgcgaaacgcaactgttaattcgttccctggatgtgcaatcaatttttgcttcttccacttcgtgaggaatttgcaaaagaaaatcaaggagcgaagtctctggcaggtacaataaacattttctattctattttttaatattttcgagtttccagcgctattgcactgatacagtgtttgcagaaacagatggaacttggtcacagccaacaatcccaccaaaacagtggaacgtctacactcgcacattga

SEQ ID NO: 69698 - DNA, 348 bp, Heterodera glycines
  Genomic contig location: Contig_ID=SeqID_41617; Location=422..769; Strand=+
  SCN-specific regions: Sequence locations=1-137,159-348
atgcgtgccgtcaccgtcggtggcattgtgctgatcggcgtattactctgctgcctgatcatctgcttagtgaccatggtcgcctcgctgacattcagttgctggtggacacttggtaagacgaactattcataaagtttatatctgcaaaattcaaaaaatcagaggtgtgcgaattcaaatttttaataccctaggaattttttagccctttttcaaattttgttcaaaaatgacaattttcacgattttttagtcaatttttttacaaattattgagttttggagtctgtatgatgcccatagacgctgttgtgagaactgtaactcgagattttttctttatta

SEQ ID NO: 69699 - DNA, 53 bp, Heterodera glycines
  Genomic contig location: Contig_ID=SeqID_41619; Location=359..411; Strand=+
  SCN-specific regions: Sequence locations=1-53
attgaaagccatccattgcctgccgatgctcggcacagcaaagcactaatagg

SEQ ID NO: 69700 - DNA, 561 bp, Heterodera glycines
  Genomic contig location: Contig_ID=SeqID_41621; Location=15..575; Strand=+
  SCN-specific regions: Sequence locations=1-23,45-47,70-147,171-561
atgaccgagtttattgagtgctgtatttataattggcattatttaaatccaaaacaggcaaaagaaattgactgggtgatcccggcccgattttgtacgggtcgttatgacagcaaaaagatccgtcatagaattgaagtccaactgggcgaggagagcaaagaggagcgtcttgaagctggcgaatcgcagaccaaatggccaaacgcatatgtgatcccgtcaaaaggtgggtcccaaaatggttatgaattctgaaatgggtcggtcgtcattcgcatttcagatggacacaaagtccgaataatcgacgcgccgggaattggtgacacaaaaggcgtcaacgaagacaaaatcaactttgacaagacgctcaacttcatcagcacattgcctgaacttcacgccgtttgcattctgttgcgtcccaacaccactcgcgcaacgcccgcaatcacatattgcattaagggactgctcacgtacttgcacaaaaatgcagccaaagtactgtactcatcttctataatggataacacggattataacacacctttttag

SEQ ID NO: 69701 - DNA, 1161 bp, Heterodera glycines
  Genomic contig location: Contig_ID=SeqID_1196; Location=194..1354; Strand=+
  SCN-specific regions: Sequence locations=1-131,154-252,276-364,495 -793,829-923,963-1161
atgcactggtaagaattgattttttttggtaaaaataatgatttttcattgaaaatctgttaaatatatagccaaaatttcaaaaaaatttcccggcggcgcctatcggcaccgccggatccttaaaatccttaattttcttaaaaaacttgctcaatttgcaaaaattggtcatttttgaacagaatctaacaatgtattgtattaaaattttcaatttttttcccggcggcgcctaccggcaccgccggcctccctcctcctccttggtcaccaaaaagttttttcaagaaatacaccgcaaaaaattttgtaaaattaataaagggagtcaaaaatataaagttaataaatgttttgttcgaattaattataaaaaataatttatttaagcaatttgaaaaaattttctgatttttgactcaaaaataagatttttttatttcaaatttctcctttataaatttttctatatatttttaatttaataaattgattgtcctttaaatttgtgcattacaaatatttttgtgagtttttaattaaattttcgaattactcccgcccgggactcccgttaaaaatggacgggattttaacgggaatcccgttcgtgactcccgtcccggaaaattttgaactcccgatcccgctcccggaaatttttttttaccggactctattttggagcaattaaaatctatacagaaattagtgattcacagtgccgagttgtgtcgtgaggaacgaaaattgtttagaaaattttatggaaaggacaaaaaaaatttccaaattactaatgatatcatttatttataatttcattgactgaacatttttaaatttatgtgcatttgcaggtgcaactcgtttttgagaaggccattgaacagttacaagactccgaacgcaaattcaagttttaaaaatttttacaatttcaataaaaattattaattccaggcatatcaatttcgaagatatcttcaaaatttaccacaccagattccagttgacatacaagtaggaaataagcttttgtcattaatatcaaatcagatattacattgtgattgaatcagttcttttgtaaaatttatgtgggctaattagtcttccgccagattagggatcattttgatcaaaaagggttactca

SEQ ID NO: 69702 - DNA, 5926 bp, Heterodera glycines
  Genomic contig location: Contig_ID=SeqID_1196; Location=1605..7530; Strand=+
  SCN-specific regions: Sequence locations=1-181,204-318,340-340,387 -683,705-769,793-795,817-1233,1267-1330,1352-1374,1396-1622,1645 -1789,1813-2014,2036-2058,2080-2088,2111-2125,2147-2274,2298 -2550,2641-2668,2701-2706,...
  SCN-specific regions: Sequence locations=...2728-2810,2840-2856,2880 -3058,3080-3140,3164-3184,3208-3237,3266-3498,3520-3612,3634 -3661,3688-3967,4093-4235,4279-4377,4445-4530,4620-4941,4963 -4981,5003-5141,5163-5746,5787-5926
atggtagtgactcttatgattggaatgaaaaatggcgttgaaaaactgttcaagcagcgtccactcacaattgaccagttggacgagcagtacattgacaaaggtggcacaaatttaaacaattttttttttcatttttcccaatggccaaattaaattttatggcaaaatttgctcatcttttcaatttgaatttttaattttcagaagttttggtacaaaattggaagcccaatgttgtgtatttggtgcaatttccgcacaccgattcggccccaagtttatccccggcggcgatccaattggagacatggctacggatcaaagaaatcccattttatgtgggttttaattggggaaattgaaaaacattttaaaataaacttaaaagtttaaacactcatatacttttaccactcatttttattcaacattttagaaaataaaaatccaaaaaacaattttctttaaaaatttttagcgattatctttggtagaaccaaacgaaattgcaaaaatgaagtctggttgatgcctaatgtattccctattttcttgttttttaattatttctcaaaagttgaaaaatttaacggtgctatgtcaaccgacaaaaagtgcaaatttgggcgacagacgaaagtgcaaaatttgctaaatttttgactaaatcgactcataacttttctaaaacgcaaccaaattgcacaatcttggtatcatacgatatcccttgaattgcattattagcatgctaaatttcaaaaaattttattaagtttttcaaaaattcaagccaaaaaattggaaaaattgtcataacttcaaaggctatcgtatgataccaagattgtgcaatttggttgcgtctgagaaaagtcatgagttgatttagtcaaaatttagcacttttcctcggtcgaccaaccacgaaatttaactatttattggggattggattttcgtttaatttttattattttttgctttagactgtcagtgatggtgttctgtttcgcgctctttttgccgatgacaaagtgccatttgttgaatacaatgggcagaaaatattcggcacatccgaagagataattgacactttgaagcaggaagctttatccaagggcacacttagcgaattattagggttgggacaaaaaagtgatgaaaatgagcaggaaatgcgcaatttaattgacaatgttctatacaggtgatattgagaaaaactttttatttaaaaatattaaataaaattattttgcttaatacagtatccattttcatacaacatccgttttatcagttgcacttaatatagtctccttgttcatacagtatcctacagcatccgtgttgtcggttcaccttaatacagtttccttataaagtatccctcttcatacaacatccttgttatttgtctttatacaacattcatcttatcagttcccattaatacagtttccttcttaatacagtatcttgctgcatgatcgttttcaaaatttggcaagttccgaggccgaaactcatttggccaaaaacattgattttcaacgcattgtgctgccatcagtgctcaaggaggcgaagcgcaattggttcaaaattcagccgttgccaaaaccattttgggatgaatattttgccaagggaaaaactgtagcatatggtagcaaatcatggaacggttacggtattagtgagaaagaatggaaaaaatttgtggacaaattgagcacggaacacattccgaaagcaatgaccaaatttgtgaagcatttgaaaaaacaggtgggcactggaattgggtgggacattttggcattttgtcactgtcattgtgcctagctgatttaaaaaagggatttcttcgagagaataatctttacatccgcctgatttatttttccatttaagcttcttcgccagctctcggaacgaccttctctcaaattttcggatgtgggttttttatacctacaattaatatgatttagataccgaaatttaaattttccattactgtacggtactgtaatcgataaaaactatgagaaaaagatagataaattcaacgataaattgaagaagctttttgacgaaacaatgcaacaaattgagcaacagttgaccaaaatgagtgcaaaaggaaaaaaaacgaaattttacctttttggcgaaacgccgtcagcggtaagaaaaagttgaaaaaatgttgcctattaatttgggtgataggtcgtttcgtaagattcgccattagccaagctttttctctttttctctattagcctgcaaaattttaaaatatggtcaactttagaaaaagttgaatgaaaataatactgtttctgccacaacttatattaaatttgataattttgtttgaaattttgcaggcttatagagaaaaagcctttgctatcgaatgatgccaagaatgtaaaatttggttgcctttaagcaaagttatgccatgttatgtcgaaaaattcgctaaaatggctgattttacgaaacgacccagcacgattaatttggaaaaatattaattttaatttaaactggaattttttaaaaatcattttcacgaaaaatttttttattcatatttatttgttttaaaattaagctaaagtcaggaacatttatttttgcaaattaagtataaaaaatattttttgaaaaaagtctcgactcaagaaaagcctcatttttgggtctcattctcgactctaaaggtcaagtctcggtctcaagaagttttgactctcgaacaaaactgaaaatcagcctttattaaaaatggagagatggaaattctatgccaataatatttttgttgctaaaaagttttattatttttatgtgcttgtttagttggactccgttctcttcggcattctttcccaatttaccaacaccaacacaatttacaatggacattatgccaattctatttcggcaaaactcaatagaaatccgaatgatccgttgaaaatttattttggccatatgaaagacatttttatgggccaaaataacaccgaacaaaatcagtggcaaattaatgcggattggaaatttgagaagaaagcgaataaatataacggtaaaatgggagagaaattataaaataaaataaaataaaatattcatttacaataaatagatgattttatatatatatttaattaacgttcgaattagaacttctttaaaatttcgaatttaaaattaaattaaattatatttactttaacccaacaattttttactttatttttaattttaggccctttcattttgcgttttgatgtgcttaagctcgattatgaacaaagaaagcggttcaccaatgatgaacgtaaaacattttcgccactgtttaacaatggaaatgccgaaaattctgatgaaatctccggcactttgttttcggaacgaaagtttttggcggtttacccaaaggtggggaaattgaagggcattttgaatttgggattaggttagatcagcagaaattgcatttgacattaatgatcgggttgatcagcagaacataacataggtaatacatattgaaatcgaaaaatgtatccaataaagaccaaattttcaaagtcacaaaaaaattttgccaaaatttacctttaaattaaatttattaaaatatttcttactataaatttgaatccattttgttaaatttaaaggtcgtcactttcattgtgcaccaattgctcagcttgttcaatttggaacgatttgccattgaaatggcggaggtttcttttttaggttttttaaatttggcattttgttttgttttttcagttacccactgttgttgaaattcgatcattggcggattacattgaatttattccatcagattcaaaacagaaattattgcaaaaattagaagaaaaaattggaaaaattgggactttatcagaaaaaaaagtaaaaatctaaaaataaaataaaataaaaaatatttttatttcattaattatttgatcaaaggcattaattattttcttttttaaaactatataaattgttttttacattaattttcatttgagcgtatgaaattgggccgtgctttgattcatttgatggcctcatatttatgcgaaggaaaaattgggcaaaatgattgtgaaactgaacatgatgaaaaagcgaaaaaataccttggaagaatttgcaaaatttcgtaaaattaaattaaaaaaattattaaaatatttatttttatttccagtgaaaaatactttgctgaattgtctgtgatcgtccgaagcttagtttaccaaatgatgtacacaataaatgtggaatatcagaccaaagaatccgtaaaaaaatatttttatttttagtcaaattaaatttgattttacctttaaaaataatacaaataattgattaagctcaaaatgtttggtgccgcattgcttgactttgatggtaagaaaagaaaattcgctattttacatttattcaaaatccaataaaatataattcaaaaaaattaattcaaattgaaaaaaacgaaaaatatttttaaaaacaatttctcttttattaattaattatatggaatttttagaggaacaaaccattaaatacgaggccaaacggttgcgcaacgccataaggcatttggagaaatttgagagtgaaaaaattgaatacttacgaacgaaggtccaacaacttggcattttgatgcagaaaagtcagcaaacagattcgaaagatcctcaaacaatcgcagatggacaaaagtcaaacgaagaaattaaggtaattaagaaattacgatagttatatcggaatttaaaagtgcaaatttgaattttgatcaatttgctttttgaaactcggttcagagctattagactgatggctttaagctttatccattttgtattcttttttgtgaattaaacttcgaatattgaatatttcttatagaaattgcaaaaagaattgagcgtttgggtgttgcgcagtttcattgtgtccgaaatgcgtgccttggtcgatgcgcttgacgacgatgataaatttagccgggaaaaagttacgttcaatgacattgagccgtcacggaaccattggctcaatttgaatgtactggtagaaaagtgcgagaaagaggacagaacgtgcaaaatgaacagggagcagatgaagcaaggctttcaaatgatcactgaacgcaaaaagaagcacatattcaaggtggacaaatggggcgaaagtgatcaaaactaaacaatagaggttgggaaatcggggtagagggattaaaagtgatcattggaggtggggaagtggaaagaaaagagattagtgtgaaatgaaattgaagtttcaactgggtataattaccacgttgggtcaccctggaaggccgaaccgatgccattcgtctaattggtatcatgtcactgatgagtgaaaaattgaccataaccaaatcaataatcaagccccgatcgggaattgactaagtgattctcggaataaaagtaacaattaattttttaggaactttgggccaaaacggtggaccaggcagagagcgtttttactgtacaaaaataccacgaagttctctcctatcggttgggccaactgcgcaagttgtacgagttgcgcaagtcgcagttgccacgtgacgaggcggtgaacatcaaaaaggtggaggcatatttggaaaatattcaataaataaatactatttatttatttttaaacttaaagattgacgagcagtacgtcaaagtgaaggcggagctgttccagcgactgggcgattccgaagtgaccacgacggaggacaacgacgagggggcggaagtggtcgaagtgctggcagaagtcacattcacatcaa

SEQ ID NO: 69703 - DNA, 959 bp, Heterodera glycines
  Genomic contig location: Contig_ID=SeqID_1197; Location=352..1310; Strand=+
  SCN-specific regions: Sequence locations=1-411,449-497,520-535,557 -644,676-959
tggcgaactgttcattttattgcgtgccaaagtggaggaggacggcacaaactttgatgaggaagaaatcgccaaagggttcaaatatgtgaagggccacaattcaatgcaccgtgcccacaaattgcgggcttttctgttcgattgggccggcaaagtggcgaaggagaagaaatttgtcaaagtgagtcagttttggcaatcagtgacataatgccaaattttctttttttcaatttttaaatgttaagaagctcgcctggcgcatgggccaactgtccaagctgtacatgttgcggaaagagaaaattgatgaaaaggacatcaagtcgtgggcaagcaaacaagaagagttgagtggggagatggagaaacgatggacggaattgaagaccataatggaaaaaatggtaaaaaaataaataaaattatttacaaaaatttaatacattttcctaaaatatttcaaataattggtgttttctcagtcggcgcatcgacctcccccctagcattctcataatttatttgtaaaaaagcctaacaaaaaccccaattaattctaataaattcgtctaatattttaatattaagtggtacccttcccatgaattgtttctttcaaatttattatttaaactggcaaatttttttttaaatattcaaaaaaattaaggccgataaaatcatcgaaaatgccactggaaaaacagacaaagccccgctcgcagccgccaatgtttatgccgaggatggaaagcccggaacaatgccattggaggagattcaaatcgaagacaaacgcgaactttgagaatgggggcacttgttaccatttgaaatggtagtttttattctttttgggattttttattttctgagcagatactgtgaaatatgtacaaaaaacaacaaattttggacttttttgcgttcgtttcgaatttagggatttgaaa

SEQ ID NO: 69704 - DNA, 651 bp, Heterodera glycines
  Genomic contig location: Contig_ID=SeqID_8933; Location=1085..1735; Strand=+
  SCN-specific regions: Sequence locations=1-280,302-435,457-651
atggatgtggatgtaattgtcaagaaattcaagttagtattttggcctgcacaagagtttcggaacgtaccggaagattttgatgaaaagactcgaaaatttgtcgaggtttaatctcaagtcatcaaatttatattacctaattcaatactttaggatgctttgtcctgtaaatatctcatcgagactctcaaacttcaaattggtgtcgaaacagcgcaacggatgggcgaggaggaatacgacgcgcgagtggaatactcattgaacttggagattagtgaagggaaaaacgcccatttaatgaccaaggcggacgaggagagcattcggcagaacaaccatttgctttacatgttaaacttcttcattgtgttcataaatgagcgtgttaaactgacggagcacgcattcacttgcgcattaatgctaaacacaaaggaattctttgatgttcaattttggtacagttgtacaaaatgttcgtctgttctcaaccaatttgctttagttcggctaacatggagattcccacgaaatgcttttcattcgtcagtttggttgaccgtgaccaaccacttgttcatcgaactgttcaacttgttgaggatcctaaccgaatcatggatcgtttctacaatcgcacaataa

SEQ ID NO: 69705 - DNA, 479 bp, Heterodera glycines
  misc_feature (410)..(410): n is a, c, g, or t
  Genomic contig location: Contig_ID=SeqID_8933; Location=26..504; Strand=-
  SCN-specific regions: Sequence locations=1-258,290-330,352-479
atgaaaaaaaaaatcaacaaaaaggaagaacaacggcgaaagcggtaccgaccaggggagaagtaatttgtttttcttttttatttaaggtaaattaaataatgtttgggtttcatgtaccttaacttttttgtttcctaaaccacaaatggagagctcttttcatttggattgacaaaaatcacaaatagccaaaataatcgaccctttagacatttttaaaaaataaaaaagaaataacaatcaaaatgacttgacttatttttaaatttaaatctttttaaaaaatgagtgaggacaaacacgacatcaatcaaacttaatcttttagggcacttaaagagattcggaggtaccaaaaatccacagacaatttgatgccccggcagccgttccgacgcttgatccgngaagtgataagcgaaataacatggaactctcacccggtggagacccaagcggccactgctcttcaggag

SEQ ID NO: 69706 - DNA, 1027 bp, Heterodera glycines
  Genomic contig location: Contig_ID=SeqID_8934; Location=50..1076; Strand=+
  SCN-specific regions: Sequence locations=1-114,136-211,238-664,689 -713,735-1027
atgtgcgaagaggtgaacgagtcctcggtttttcgagtccaatttgacctcgaacgaagggtatgttcatttgtttaacacccctctgtacttatccttttgtttagtaactttatgcgctgaacatgaatctgacgttcatttttgcaagttaatagctaaaaacggacgtccgattcgttttaagtgcataaaattaccatagactcagtttaaaattttattttcccttttcttacggtcagtctgaggactattgccaactgatcaatcgtcttgcaatggctaccgaacgttccgtggaatttcgcacttttgcccccgaaaaaatcctacgcttccgcgcttatgttgagtcgcctttgatcaatgagcaatgtcgccaaatgtgtgaaaacaacttcaaattgatgtacatgattgctgcacttctgtcccgggggacggtggtcaaagactatttgctggccaccgaattggaccgtgacagatttgtgggacggtgcgcaaacgatttccaaagggacagagcggtgaatttaaataatttttggatttgtttaaatttttacaacattttacaggtcacattggatgtgttggagcaggtgctggctgagattgacaagcgcttggattgtttgcacccgtccctaatttacgattggatattcaaaagagtcaaccgaagtgccgacgcaatgcgacaaatccacgacgaaaacaccaaggagggttatgttcgcatcagaaaagtccgtctcatcagtttttgacttataatcatactttttgaggtgctcatcacaccgtcacggatgctttttgttgcgcctgaacttttgatgggcaacagagtgttgcgcatggaccctaagaaatatcccctggacaaattcttgcgtgtcgttttccgagacgacgacgggcgaccggtccatgcgacgaatgttggttcgatgctcatcgaccgattcattggctcgaaattgcgcaatagcataaccgttgccggtaactgtttaca

SEQ ID NO: 69707 - DNA, 857 bp, Heterodera glycines
  Genomic contig location: Contig_ID=SeqID_8935; Location=136..992; Strand=+
  SCN-specific regions: Sequence locations=1-391,413-495,517-857
  Gene Ontology: Mol. function=RNA-directed RNA polymerase activity; Biological process=positive regulation of growth rate
atggaggcggtcgatttcccaaagactggtgtccctccgaaaccgctaaccaccaaatgggagactgttaacccagaaaacgaagatgcacccgccaagcctacagcaattcctcccgagcgagctgaacgttctccggactttatggagaagaacaatgaacccatgcatgtttctgtttatttgaccaataatctattggtgaaaattcaggtacatcagttctcgattgaatggtcaactttacaggtttcactcgacaaatatttcttacaatttcacccatttatatcattacttacagacgagccagagaaattgacgacattttgaccattgcatctttcgacgatgagttcaccgcggtggaagtggaccaattgttgcaatggccaggctgtgaagataaggaaatattggaagtggcagtgcagcaatacgaagcttactcggccaatattcaggtcggtttatttggaaacatttcgttgaattttttatttatatattcagaatattttggactgttacgggataaaaactgagggcgaactgttctctggtcatttcaccgctttgcgaaatcgaatcagcgagaaggacagtgacgacatggtgggtatttttggggggtttatcgttgtattccctttgttttttagtctttttacaacacgactaatgcgattgaacagcaactgttcagtgtgtttggcaaattcagacgtcagtttttcgaacttctattggaaggccaacagaaccgttacgaggaagtgacggtgccggtgtatcgttacgtgcgcaccaatggggcaaaggtgttgggtgtttggttattcggttattatgattag

SEQ ID NO: 69708 - DNA, 76 bp, Heterodera glycines; identical to SEQ ID NO: 53797
  Genomic contig location: Contig_ID=SeqID_41622; Location=280..355; Strand=+
  SCN-specific regions: Sequence locations=1-76

SEQ ID NO: 69709 - DNA, 428 bp, Heterodera glycines
  Genomic contig location: Contig_ID=SeqID_41623; Location=66..493; Strand=+
  SCN-specific regions: Sequence locations=1-428
atgacattctatgcttctcttgttggatacacgggaagaaataatagttagtccttttgttgaatttttagaaattctatccgtccaatcggcttttggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcagtaaccgtaaatgacattctatgcttctcttgttggatacacgggaagaaataatagttagtccttttgttgaatttttagaaattctatccgtcaaatcggcttttggaattttaatgagtaaatcagtaaccgtaaatgacattctatgcttctcttgttggatacacgggaagaaataa

SEQ ID NO: 69710 - DNA, 300 bp, Heterodera glycines
  misc_feature (232)..(232): n is a, c, g, or t
  Genomic contig location: Contig_ID=SeqID_41623; Location=578..877; Strand=+
  SCN-specific regions: Sequence locations=1-57,79-300
atgacattctatgcttctcttgttggatacacgggaagaaataatagttagtccttttgttgaatttttagaaattttatccgtcaaatcggcttttggaattttaatgagtaaatcagtaaccgtaaatgacattctatgcttctcttgttggatacacgggaagaaataattgttagtccttttgttgaatttttagaaattctatccgtccaatcggcttttggaattntaatgagtaaatcaggaaccgtaaatgacattctatgcttctcttgttggatacacgggaagagataa

SEQ ID NO: 69711 - DNA, 931 bp, Heterodera glycines
  Genomic contig location: Contig_ID=SeqID_41625; Location=55..985; Strand=+
  SCN-specific regions: Sequence locations=1-46,164-208,230-279,308 -476,498-852,874-931
atggggtgtgccttcaaaacaggaaaataccaagataaggaagagcataatgataaagataatggtaataattaggaagaggataatgataaggataataagagataaaatgataataaaaaattaatgataagggtaaggaaaaggatgaggacaatgataaaggataaggaagagaattaggattagataggatgataagcactcaaaacattaattaaataaaccaaaaatgattaattatttgattcagaaaaaatgataaaaattatacggaataacttttaaaaaagaaatccaaaattaatttataaatcgtagaagaaaatataaaatgagcaaaggaagctaaaattttattcaaaaataccaaaaataaataaacatatccataacgaatgaacccacacgagaagtgaatgagaccgagagagttcattcggcgcaggaaaaatactatacaataaaaataatggaattgcttttaatatataactaaaaaatgtagtcttaatattgtagtgaaaattcgatcaatcatatttcaagcagattgagcagaagcgttctaacatttgcagggatactcatgggtaaaggtctatcctacaaagaaaggagcgtcgagtctagctggcgcaagaaaatgtttgatagtccgagtaattagtgagtattgaatgacagcaaaactaattccaaaatattttgtaagaaagggttctgacacgcaacagaagttagttgcaggttagtttagacagtatgattctgatgatatcaaaaagcgagatgaatataatgataaagaagtgtcaaacaattgaaaacagaacaatatgtattagaattataattaaaatttcagtatttttatacagaagggctgccatcgttagagcgattcagaaaggcagagaaatatcatgta

SEQ ID NO: 69712 - DNA, 818 bp, Heterodera glycines
  Genomic contig location: Contig_ID=SeqID_41626; Location=117..934; Strand=+
  SCN-specific regions: Sequence locations=1-222,285-420,450-818
atgggccgaatggcaccggaaaagggcgtggacattgccattgaatttgcgctttggtccggcattaaattgaaaattgcggcacaattggtggacgagcacaagcattcatattggcacaagcaaattgagccgttgatcaatgctaatcaacatttggttgaatatgttggcgaaattggcggtgacgaaagagagtgcgtttgccattattttcaatacattttaatttatgatttttaattaaaaaagaaataataattacataaacaaatatatttttagcagttttttgggcaatgctttggcatttttgttcacgccaaaatgggacgagccgttcggattgtccatgattgaggccatggccaccggaacgccggcgattgcaaatcggcgcggtgccgtgccggaagtcggtttttatattattcataaaataatttattctttgaaattaccgtaagattaagcaaaacccaagagatatactaatatttaaaaagttccattattaggtaattaataatgcacttgtcactgtaattactggtatttagcgaccgttaaatttatcacaatcacagattgtgcaaattggccgcaacggttatacttttgactacaaagatcggcttggtgttgaacaggtggccaactttgtgcatttgatcaaccaagcggccaaattggaccgtgccacggtccgacaaactgtcgaagaaaaatggtcattggacaaaatggcagaaaattatgagaaagtctatcgccgcatgttgaacaaaaatttcatagcaaactgttatgatcattag

SEQ ID NO: 69713 - DNA, 378 bp, Heterodera glycines
  Genomic contig location: Contig_ID=SeqID_41629; Location=105..482; Strand=-
  SCN-specific regions: Sequence locations=1-128,150-294,317-378
atgccatacaacaaaaagcgcatggacaaaaaacgacggattaaaacggaaccagcagaggcttatgatcagaattatggtgccaatcgtcaacaatcgaatggcaaatgggcaaaattagccgccgttaaggaagaagcaatcacattaattaatgatgatgtgggtcacttggagcagcaaaaaaagttgaatatggcgaaaattgtaccgtgaagggcgaaaagggtcagttttagatacataagaaaatattaaaaaaaaagactaagtaaagtagggaaatttttcgaatagaaaatattttaaatgaatatattaactcatctgaaaatatacagaatttatcggcataaaaattataaaatatgcaataaa

SEQ ID NO: 69714 - DNA, 838 bp, Heterodera glycines
  Genomic contig location: Contig_ID=SeqID_41630; Location=123..960; Strand=-
  SCN-specific regions: Sequence locations=1-727,749-838
tatgttaacccattcaacacagtatgctatccatcatatggtacacctccggcactttttcggcattcattgcaattacggtccaaacttccaccgcgattagcccactttcttcccgaacctgaaccgcatatttgtgcgcacaactcacaaatcatccgggttgtcgagccgtacattccgccgggtgccatccaaaatgtcaatgacgcattaatgagcaaacaaatctcatcggctggcacatggccaaaacagctggcagcaaaactatgcgccatctacgattttcctgtaagtaaaactacaaagaatgaaggttctttggttttatgataattggtttgggccgtcccaattttgagggcccgaattttggcacttttccaaaatttttcaggttgccgttccgtgctgcaacggcttcacctcgttggtgttagcattacgctcagctaacattggagcgggtgccgatgttttgatgccgtccataacatttgttgctgtctcaaatgccgtcctcaatgttggtgccaatcccgtgtttgttgactctgctgatgaatgggactacaatccaagttggtctctgctgttacgagcggcaactcagaaaaccaggcacgaaaaaatcttggaaaagttttgactggggcgtaaaattataatgaaattccattttttttcatggactgtcttaaacggacaaaaatatattttatcttggcttgaagcttctatgtaaattatctatgtccatattaagggggaaaatgttatgaaagtcttttttttttaaaaaaaggaagtttacgaatttatttaattaaataaa

SEQ ID NO: 69715 - DNA, 665 bp, Heterodera glycines
  Genomic contig location: Contig_ID=SeqID_8937; Location=2239..2903; Strand=-
  SCN-specific regions: Sequence locations=1-247,299-474,496-520,542 -549,574-665
atgccgcactgtactgacgatccgatttggccagcgtgggccttccacacctctgttgtgttgaattttgtccttgtccttgtgctttttgttttgtccgtcttgcttgttggtcgctgtaaccgtcctgtgccggttaaaactgttggtcactgtgaccagtgtcaccgccgtctcactgaccgtaagcgcatttctgtgtttgatgaggccactattgttagtggtctttagtaagcatttgccgattatttgttaatttttttattaaattacacatttgttaaataaataatttgttgaattgatttgttaatttttagttaatgaattagtactttgctaattgaaaatttgctggttatagtttgagtattttcgaattaaatatggcgaagagaggaaaaattcgttggaaattggaagaattggtgtattagaaaactgtggaaaatggatttttacggtagtcaataattaaatttggaaatgcagtatatatggtaattagaacaaatgatgtgaaatgtattttatatttattattatttttattttattttattttatttttttatttgcattgtggacaaaaagggattaaaatgagaaaaaaaattaaattaattggaatttgataaatgtgaaaatgagcgaaaaataaa

SEQ ID NO: 69716 - DNA, 383 bp, Heterodera glycines
  misc_feature (300)..(300): n is a, c, g, or t
  misc_feature (315)..(315): n is a, c, g, or t
  misc_feature (350)..(350): n is a, c, g, or t
  misc_feature (369)..(370): n is a, c, g, or t
  Genomic contig location: Contig_ID=SeqID_8937; Location=1..383; Strand=-
  SCN-specific regions: Sequence locations=1-383
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccatcaaaagcaaaacgatataaccaaaatataaggaaaaatttttgaaaaaatttttctccatcttcctttttgatactaaagcatcagagtgctaaaattaacttgtaaataaaatttggtgcgctttagagcactttctanaaaaatatttatganataaaaaaatcgatttttttcagtgtccgtttggngtactcaaacaattatggnngagcaaaatccaa

SEQ ID NO: 69717 - DNA, 1832 bp, Heterodera glycines
  Genomic contig location: Contig_ID=SeqID_8937; Location=3135..4966; Strand=-
  SCN-specific regions: Sequence locations=1-76,176-228,250-278,300 -398,480-1295,1317-1359,1381-1481,1504-1832
atgccgggtccagaaaagccgggtctggtccgtgttctcatttttaaaccggctcaaggtgtccggtaaaaccgggtatttaaaatttaaaaaaaaatacatttttttttttaaattcatgaaaaatgaaagcttatattttaaaaaacatgaaaaaataataatttaaaataaacacttttttatttgtcgaattttttgttgctatcgaaagtgtacagttatttattaaaaatttgttcaactttttatctctaaaaaattgttatttattggtgaaattcatcaaaataaaaattactattaaaccacaaattggctttttaatagaaataaatattcatgaacaaacagtatagcatgttaatactaatacttttttcaaaatttattatagcatttttgtttttaaccttgattttttatttaccttttgtggtattggatttatttggacccttctttttatttttatatttgattggcgttttgtttatttgaaatgacctcaattcttttgatttgatgattcgcttgctggtgtttattcggtaattgtggatattaatttggccgtggattttaattattggattttctttcgtttgtgctttgtcttttatttggaattgtttttcattattcttgttcacataaattatttatttgtcgtgtttattcaaaagcaggtattctccgattctcagacattttccaatttggtcttctcgcattgtgttaaagttaattccaaaagaagaagaattggtttgactttccaacatggcgctcctggacgacaaaggtctggcttagtggcattttcaattgaagggaaacatcggtcgtaaaatttgttgtgaaaaatccaaacaaaaatttttgataaccctcgtgtcgggttgactccattcggatttttgtccgagcttacaactttcttctcgccaaaagcactcgtgttgtgcttcgccaaattgaatttttttttgtaaaaagctcgtgctgctttaaatttggaaattctcaatttatctcgtgttgataaacgttacaatgtttcctaattctccaccactgacgagacaaagacttcggaggcaacaagaagcattgaatcaacaggcgctgattgacgaggaagagcgagaaaattttgaaaaccgaccgattaacaccgctaacaatggggtttttgagaattctttgattgagggagaaatttcagcatcacaccgaaacttggactcggaacaaattccgatgcacttttaaatgtggaaccagcgggtgtacgaaatgagcagcagaggcagaatgaggcagtggtcgatgaaaatttggaaccacaacgcggaggtttgagattgtgttttcaaaatttgggattcaacgttggtagagaggaatggttggtgagaaacgaaaattttgatggccatcgcataactcacactctttcaccacgtattgtaccaagaacctcaacccccattgaaaaccgcatcactcctgaattactcgtccaacatgtacctgcgcaaaatgcccaaaaaactcaaaatgtcatgcaaaataatgcgcgaactggagtaaatggtggtggtgctgccatacagcaacaagcaatgcattcacttgcccgccctcagccacttccagctcaacagccaatcatagtacaacaagcaattccacaacctgctgtaactcagccaacaatccagcagggatttccgggaccaatttggggttttcctggccaaattccttactatcaataccaacctccaggctcaaaaatggggcggctgtcacttcaaatgggatag

SEQ ID NO: 69718 - DNA, 261 bp, Heterodera glycines
  Genomic contig location: Contig_ID=SeqID_41633; Location=333..593; Strand=-
  SCN-specific regions: Sequence locations=1-132,154-183,220-261
agtcaattttactttttgttttttggttgcaattgggttagccatttctgaaaaatgtccaaatcagaatgtacatcaaattggttaactattaaaaaataataggatttggaataagtaaaaaatgagcgaatgtaattaaacctaacttatgccaagtggcgagggatccctcaggcttagtttttagaatcttaatttttaaaaaagcacatttttctatttttgggttggggcccaaacgaccccggggcccaaaaa

SEQ ID NO: 69719 - DNA, 324 bp, Heterodera glycines
  Genomic contig location: Contig_ID=SeqID_41634; Location=61..384; Strand=+
  SCN-specific regions: Sequence locations=1-257,302-324
atgacaaatgaatataagcaaaagagaaaatattcaaaaaaagaatgggagaaaaattatgccgaaatttgtaagaaaattggagtcagccgagacataattaacaaatggaagaaacaatttggaattcgctgtaaaataacggagaacgaaaaaatggaaaaaatgaaaatttattggcaaataaaaagtgaaaatccaaaaatgactgacaaagaaattgcaaaaattgtgaacacttctcaacagaatattttcaattggaagaaacaatttggagaagaaatttaaagtattaaaaacagaaaatgagaaaagggatca

SEQ ID NO: 69720 - DNA, 90 bp, Heterodera glycines
  Genomic contig location: Contig_ID=SeqID_41634; Location=1117..1206; Strand=-
  SCN-specific regions: Sequence locations=1-90
taattttatgaatgaatgggcatttatttattcgtgaaatgattttcatattaataaattggatttttttaaattaaaacaaactacaaa

SEQ ID NO: 69721 - DNA, 815 bp, Heterodera glycines
  Genomic contig location: Contig_ID=SeqID_41637; Location=67..881; Strand=+
  SCN-specific regions: Sequence locations=1-108,166-400,451-510,532-815
tcctcgctaaatatccgattttgctgaacaaaaattcgtctgacattttttatttcgaaattttggtcacaaaaatcaaaaacgaacgcaagtaagaggagaattttgaattttaactatttaattaaaagtgaaaaatttttaaagattttatgttatttaattcttcgctttcagtttggtcagcttcggattcgccgtcaaacagcaggcaagattggatgatggaattctgcttgaaaagggcacttatgcatatggaagtgctggttggatttggattaacggaggagtaaaagaagccgaatattcctacggtgttggcgatactgtaggaattggcgttaattcggccactcgacagatcattttcacgaagaatggacttcgtttggataggaaaataaataaaatgtaaataattttttaatataattttttatattttaacttaacaattgtgtgttccttttacagattccttcgattttttcgttgctccaacttatgaaaatgtttatttttatccgttcgtttctttgtggaattctgatgacaaaattgaggcgaactttgggcccgacaatttcaaattctatttggcaactctctgaggaataagaatattcgttaaactgatcaatgatcatttgtttcgattttatcttttctattaggcttttcttctacaattataaatttctttttcattttattcaattaatgggaaaattgattgtttttcaggtgtaaaattatgtcaacatgatcaatttttctctataacattttgtgtttttcttaaatcaaaagaa

SEQ ID NO: 69722 - DNA, 1019 bp, Heterodera glycines
  misc_feature (141)..(141): n is a, c, g, or t
  Genomic contig location: Contig_ID=SeqID_41638; Location=96..1114; Strand=-
  SCN-specific regions: Sequence locations=1-45,67-292,322-464,487 -563,585-630,656-739,761-816,847-1019
gcatggatccaatgcgagtcggaggagaccgctgccgatgtgaagaacaaattggcggacatcatcaggcgcgagacggagaagaagcagtgcgcactgctgtaagccgtgccaaaactttaaaaaaattaacaaatattntggaaaggttgaaattttttcgcaacatggcgttcggaaaagcaaatacttttcaaggacattcataggaattcgtacatttgatttatttttcatggattatagtgccagtggggacattcgttttccaaagaaacttttttaaattgcattcttatagtttttaaattttcaaattttcttacgaaattctcagaatttttaaatccaaagcttttaaaaatcattagggttttcctcgtgggatggaaattttagaagttcttacgaaattccctgatttttttttcaacaaatggttttaaaaacccattacccgaaaattttgtggaatttttccaaattttagtgccctcggcaacattgccaaggggggcggttcctccccttcattctccaatggcaccgcttcccaacaacggcaccaccaacaccatcaccatgctttgcccggcacttccacaacctatgcggcgccattgaccacaactgctgccgctgttgctggcgctggtgttcccgccagcggcacggcatgttctggcggccaaatggcggcggcttcggttgctaatgggcaacccgcgcaacattccgtggcggctaatggtggcggcttctcacaccaaaatcgtccaccgcccgagttggagacgatcagtgaggacgaaaagcagcaacttgaacagcaacagcaacaacaatttgcgggcgcggaacagcggtcgcccgccacgtccgtgtcctcctcgtcaaatggtgccggcggtgccggaagcggtccgcaacaacaaaaacggcacaaccaccatggtcatcatcatttgagccaaagcgcgcgcgagaagcggttggagttgcgcgagtgcaaggccaag

SEQ ID NO: 69723 - DNA, 749 bp, Heterodera glycines
  Genomic contig location: Contig_ID=SeqID_41641; Location=18..766; Strand=-
  SCN-specific regions: Sequence locations=1-133,173-283,305-333,374 -425,457-492,514-749
atgtcaattattcgattgtacatttcgttcaactggatggatttatcgcaatttattgtgtgtattaacaagaggagttacttattacgaagtggatttaaatatcgttatgaggttggtttatacatatatgtaaatttttattaaaaatgtttatattaatgttttttttgtttctcagttaagtaattaaaaaaagtaaaaattaataatgctgatttattactatgtgaaaagtatttgtattgaaatgaatttttctacattaattgtgtttaataatatgtaaaagaagttttacaatgaaaaggtcggttgaattttcatttcatcaattaatttcatttaataaatttttatctttattttttttctcatttgttcaatttgcaaatttacctatatgttttaatattgtgttgttaattaactttgttttttaatacagattttaaaaacgccatattatccgagcaatgaatttggaccatgtttttcagaaaaatcttagtattagagatggaaatgaacagtttttggagaatggaaatgttttagttattgaagatgaaaccgagatttttgaacatgatatagatgatgttttgtctgaacataattatgctaaacgagcaagatgtttgactgatgtgaatgttgctagccaggcatcactgaattcagatattggcgttgcaggaccgtcacgtatgagtgatagtcaatttggaagaaaggagaagaaatga

SEQ ID NO: 69724 - DNA, 234 bp, Heterodera glycines
  Genomic contig location: Contig_ID=SeqID_8938; Location=1..234; Strand=+
  SCN-specific regions: Sequence locations=1-234
ctgagtttttccggaacaacgatgaacaattggaagactattttgttggggactttgggcgaagtcggtttttggcatgaaaaggattaattgtttttttttgtagtcaacacgaacaattatcagcagccatttcgacggcgcagaagagaggcgacttcggcaattcgcaacaaatacaaataaagaacagaagattaattggataattatttaaatcaactttttgtgttt

SEQ ID NO: 69725 - DNA, 2714 bp, Heterodera glycines
  Genomic contig location: Contig_ID=SeqID_8938; Location=402..3115; Strand=+
  SCN-specific regions: Sequence locations=1-137,160-354,376-589,612 -1061,1083-1173,1195-1528,1550-1659,1683-1832,1858-2714
  Gene Ontology: Mol. function=protein binding; Biological process=Tl signaling pathway
gataatacggagtctgaattggtgtccattttgccatcacttggaccgttcgactcgtcttttggcattttgtctgattgttgttatggtcaactgatcttgcttgggttcgtttaaatggtctatgtaacgaatgcatttaaaaatttatttaattatctttacgcgtattttatttgtcctttttgggtcaatagtagttcgtataatggcagttcgtacaataggatggatgtccgtacaatgtattgttattttgatgaaaagtatgtgtcactatcggaacccgtcagtttgaccttcacggttcggccccagcacttcttcccactatagctttttattttttttattgagaaaaattgaaaatttcgactttttttcttgtgtaacttttttggtaattgtctaatctcggagcaatagcttagaaaaagcttctaaacatgttaagctttcaaataataccaacaatgttggatttgcttgataacgaaaaaagttatagccaaaaacttgggctcgtacgaaaccgaccccgacctggggccgaaccgtgggggctaaactgacgtagactggtcactatatcacatatcttttaaaatttgattattgtacgaaacgccaaattgaaacattgtacgaactggcttttgtacgaaactccattgtacgaactgcctttgtacgaactgccatgaccccgtcctttttggttaaaggtacggcggtgtctccgaaacatacagtaaccatcggagcactatgaacggtaatttatcaccaaaaaagcgaaaaatattattggcagccacagactcttcaggtcgaaaacattttgtcaaaatgtttttcaaacgacggaaggaaccaaatggaattcgaaaggggtcggcgatgacattgagcagaggagcgaacgaagcgccggcagtaaaggacgccacacggcacaccgtttcatattcatacggaaaatcgggcacagtactggtggaatatttgcctgactcgagtcgcgacatgtttcaagtgggcccatggggggagaacggagagagtaaaccaaagaatggacaatcatttcgccaatgtcctctttgaggagggatatttactaaataaaacgctttcgcattttatttttcggatttgccattcattctctgggtacgtctccgtgtgctttttcctctctcaaaaccaccaaattcgcttttcaggtcggacgctcttctgaggaccaaattgactttacgattgtggacacttggctggccatcggttcctcaaatgtttcctccccggccgggaacagtgcgcgtcatcttcgcgacgatgtcaacggacaaaagtccatctcttccacaatttcgcgctacgcctgcagaattttggcagatcgtgaccgtccaaataaggccttcatttttgcggctggtttcaattcatccaaaaatgtcctagtgaaataagccactcaaattttgcgaatttttcagatatttttgggagaaaaagcgacaaaatggcaaaaagcgaacggtgaattcgatggtttgacaacaaatggcgtattaattttgcatccaaatctgtgcaataaaagtgccgaccatgatcagatagtaataaacaggctaatttccaccagtcttgcttttgaattcagaaagttttcaacgaacgtttattgtggcgcgaaggtatcttaattcgattgtttattggaacgggaatcatgctaattagtctcccctatcgaatcggtcccctttctcgcccatctatgtggggggggattgggatactgaaagcacttgatgctatttgttaagtttctgttgatggtgacatttataatcttcgcgagactcggtcatccatgcaaaagggcactttggccatgaatgaaactaacgagcttcaggttcggatgtctcattgtcaacatatcaattcgaaatgggcattttttcaggatgggactctcatcgatttgtgcggcgccacccttttgtggaggtcggccgaagggctgaggcgctgtccgtcccgggaagcgttggagcgtcgtctggacgaactgaatgccgggaagccgcaatgtccggtcaatctgaacacgctggtggtccccagaagaaagcatccgaagaacagctcttcaagcaaacagccatacgtactctgctggggttgcggttgttcgtttgaattgttgtgcctttttaggtgtatttcgggtgtggacacgttcaaggcaaacacacttggggaggtgagtcggcattatgccagtttgtctaattgtttttaacaatatctaataatagtcaacaaatgcgggtcaataacgacattccgttgtcccatttgtatggtcgactcaaaaggggtcgccaaactcgtcatgggaatggagtcggtcttccatttggactccgactgcctcaaatacgccttcaacccatgcgggcatgttgcctctttccgcaccgtcaggtgacattctctccctctccttggtacactgtaacactcgtttttcagtttctggtcaagaattccgcttccccacgggacgagtagcttcttccccgtctgtcctttctgcacttctctgctttctgccgaaaaaccattcgttcgtttaatctttcaggacaattgtggtgagtgattgtatggtcccctccccctcctttccc

SEQ ID NO: 69726 - DNA, 846 bp, Heterodera glycines
  Genomic contig location: Contig_ID=SeqID_8938; Location=3923..4768; Strand=-
  SCN-specific regions: Sequence locations=1-143,166-387,409-662,689-846
  Gene Ontology: Mol. function=structural constituent of cytoskeleton; Cellular component=Arp2/3 protein complex; Biological process=actin filament organization
ttgcttctgctccgtggctatgccttcaatcactcggctgactttgaaacagtgcggcagctgaaggagaagcattgttacgtggcgtcagtgaacggcggatgactttcccttcgcgtatttcccggtattttcagctacgacgtggagcaggagcagcggttggccctggaaacgaccgtcctcaccgaatcttacaccgttcgcacacttttcttcatttttctcttcctaaatttatctcccctaaatccagctcccagatggacgcatgataaaactcggcagtgaacgttttgaggcgcccgaagtgcttttccagccacaccttgtcaatgtggagaaactcggactgtccgaacttcttttcaatgtcatacaatcagcggacatcggtcaaaacaaacggctttgaatgacactggcaaatatttcagacactcggctggagttctacaaacacattgtcctttccggcgggaccacaatgtatcccggatttccatcgcgacttgaacgagaacttaagcagctttaccttgaacgtgtgctgaaagggaacactgattcatttcaggtaagttgataggaagaggactgagggggagaaaactgccaattcttagaaattcaaatcaaaaatcgaggcgattccacggaggaaacacatggtgtttttgggtggcgctgttttggcccatttgatgcgcgaccgggacgaggccagtgcttataagtaccgaagttttttttaacaaactaaattttcaggaattttgggtaaccaggcgcgaatgggaagaaaatgggctgtcgtactgtatgaaaaaactcagcttcaagtga

SEQ ID NO: 69727 - DNA, 199 bp, Heterodera glycines
  Genomic contig location: Contig_ID=SeqID_41642; Location=812..1010; Strand=-
  SCN-specific regions: Sequence locations=1-199
aacaaaaacgacattaatcgccgaacttgggcaattgaaactgaacactttggacgagccgtccacaaaagcatacgaacatgtcagggaattgtttggggcatcattcaatttaagaaaatgataatatttgcagataaccgatcagagattgcgttcattggtggccaaggcatacgacaatttccaactttgcctc

SEQ ID NO: 69728 - DNA, 876 bp, Heterodera glycines
  misc_feature (39)..(39): n is a, c, g, or t
  misc_feature (49)..(49): n is a, c, g, or t
  Genomic contig location: Contig_ID=SeqID_41643; Location=271..1146; Strand=-
  SCN-specific regions: Sequence locations=1-94,157-259,283-490,514 -722,744-815,838-876
atggcattttttgaaaacgggaatttttggacaaattgnaacaaaaatntaaagaaaatgataatggcaaaccttttgaaagaagataatgaagaaaaaattattttatcaattgaaaaattggaaaaatatttaattttattcaaaaaattaaatgaacaaatacaaataggtaattttttggttatttgaagcaattaaaataaccatttagatgagcatttgtttaataaatacagaaatgaactaaacaaatatgtggatgaaaaagtgaggaaaagtttcgtggattctgaaaaatggacattgccggacgaagttgcaaaaaattggcaagaaataaattttgaggaaaatttgaaagaaaaatcggaacaaataatcgaggtgaataattacaattatatgtattgtattatcaatgatagtaaataatcgcataattcttagggaaattattctcacaaaaaccgaaatgtgaaaaattgagaatttataaaccatttttattagcagatttagccattttttaaaacttttgccgaattttaataatttttgcagattaaaaattgtttgactacgaatggatatttatctgaagaagaaatgcgcaaaaaaggacaaataattggcgaattgacaaaaattattaaagaatgggtaagaggaaaattgggaatagagatagaaaattcaaatttacgaatcccgcgcgggattgtaaatcaaaactttttgcagtacgagatcccactggataatcccgcaagtcccgaagttaaatttgcgggaatcagcgcgggattgtgagcttatttaaatttgaaaaaatatcgatttcaactaaaaattcttcaaaataataataataaa

SEQ ID NO: 69729 - DNA, 556 bp, Heterodera glycines
  Genomic contig location: Contig_ID=SeqID_41644; Location=90..645; Strand=-
  SCN-specific regions: Sequence locations=1-46,68-114,229-289,311 -356,432-497,519-556
atgtgtaattttgaactggtttttactcaaatacaaaattttatagaaaaattattttattgcttttcgtggtttcaagtatgacagagtctttggcttgcattttattatgagaattttataatctttttttgtatatatctttttttgataatattttaaagttttttcattaaaatatttagttcattattaatatattttaaattaattaaaaaatattttattcgagaaatgtataaaatttcccacaatttgttctatgttttttatacagaacaattgcttcaaacatgcatttaaaatgtttagcttatcaaattacgtttcataataaaatcttataaatttcacacttttatttatttattaattttcttttttactttatataatttttattaaaaactgttttatttgaatttttatttggaatatttgaaatatcaattaagtttttatccttttcattaaagatattaatgtaatctttagaattttattctgttattttgttttatttctataaaagatgttgcgatgtaagattaataaa

SEQ ID NO: 69730 - DNA, 150 bp, Heterodera glycines
  Genomic contig location: Contig_ID=SeqID_41645; Location=1097..1246; Strand=+
  SCN-specific regions: Sequence locations=1-48,73-150
atgcgaaaaaatattccgacggaattactttttgaaattatcggtgcaattccattcgacagaaaatgggctcaaatccatgtgtcccaagtgtttaaccattttctgttcaatcgtatgggctcgtggcttagtcaaatcaaaaatttg

SEQ ID NO: 69731 - DNA, 711 bp, Heterodera glycines
  Genomic contig location: Contig_ID=SeqID_41646; Location=11..721; Strand=+
  SCN-specific regions: Sequence locations=1-362,384-711
tagtacaaattattggaacaagtttattacgatcttaggtcaccggcaagttacgctggtattcaaaaagtgctggcggaagcccagaggcgaaatccgagcattactcttcgtgatgttgacaaatttttgcataaacagcgcacctacacgctatttaaacctcgcaaaaaccgcttccgcaggctaaaaactgtgcccagtggactacacacggactggcaatgcgatttgtgcattatggacgcactgaaagagcataatgatggatttcgttacatccttgtgtgcatagatgtgctaagccggaagattttcactgcagaggctgagtccaaaaaaagtgagcacatgattgcggcatttgagaagattttcaaaaaggcaggtgtgttgcccaataagctgtacagcgacgctgggcttgagtttcaggcaaagaaaatgatggactactggaaacaaaaagagatcatcaagcacgtgatgtacagcccacatttgcatgctggagttgtggaacgcgcaaaccgtacgctgaaggagcgactttacaaatattttagtgaaaaaaacacaaagcgatgggttgatgtgctggacagcattgtgcgtaacctgaacagctccgcgaaccgaacaaccggactaaggccaacggacgttaacattaaaaatgcctctgctctacggaatcgcctatataagcaa

SEQ ID NO: 69732 - DNA, 523 bp, Heterodera glycines
  Genomic contig location: Contig_ID=SeqID_41648; Location=452..974; Strand=-
  SCN-specific regions: Sequence locations=1-413,436-523
  Gene Ontology: Mol. function=calcium ion transporter activity; Cellular component=integral to plasma membrane; Biological process =calcium ion transport
atggaacgaactgtggtgatcaaacggctcggattgcctgatcaaaaggtcaaagttcgaatttggaacgatacggtaagggcagcagagaaagggtgttacggtatctgtttgtcaattgccaattgttaaggtgtccaacctcacactgatggcacttggtaagcgaccgattggccaaaaaatgatttgccaaattttaaggctcttccgcccccgaaattcttttgtccataatcgaagtggtcggaaaggtaattttgaattagtgatcgtcacttttgttgatccgtgctcacttttagggcttcgaagccggcgacttgggggtattttctttctttttgcccccccccccctcaaaatgccattgcccccccccccaactcagccgaatacaatcgtcggctccgccgccttcaatctgttcatgatcatcgccatttgcgtttctgctgtgccgcccaccgaaattcgccgtcaaaagcatttggacgtgtttttcgtgactgccacatggtaa

SEQ ID NO: 69733 - DNA, 358 bp, Heterodera glycines
  Genomic contig location: Contig_ID=SeqID_41649; Location=172..529; Strand=+
  SCN-specific regions: Sequence locations=1-222,245-358
atgacatcacagaaagacacaagtttgtaataaatttaaacattcagaattttttggaataaaatggctttaaataggcaaataatttttatttcacgggtatttttcggaattaaataatgacatcacagaaagacacaagtttgtaataaatttaaacatacagaattttttggaataaaatggctttaaataggcaaataatttttatttcacgggtatttttcagaattaaataatgacatcacagaaagacacaagtttgtaataaatttaaacattcagaattttttggaataaaatggctttaaataggcaaataatttttatttcacgggtatttttcagaaaataccaa

SEQ ID NO: 69734 - DNA, 49 bp, Heterodera glycines; identical to SEQ ID NO: 51181
  Genomic contig location: Contig_ID=SeqID_41650; Location=434..482; Strand=-
  SCN-specific regions: Sequence locations=1-49

SEQ ID NO: 69735 - DNA, 184 bp, Heterodera glycines
  Genomic contig location: Contig_ID=SeqID_41651; Location=334..517; Strand=+
  SCN-specific regions: Sequence locations=1-45,77-184
atggccaatttggacaacttcgacaatgatacggtaattaattggtaaaatattatttaattttacaatatattttcagttttatttggccttcaaagatgccaatcccagctggtctctgattggatgcgcactgatttatggaatcattacaacatttggaatcatcttcatttttctgtga

SEQ ID NO: 69736 - DNA, 2849 bp, Heterodera glycines
  Genomic contig location: Contig_ID=SeqID_8939; Location=2162..5010; Strand=-
  SCN-specific regions: Sequence locations=1-171,197-389,411-651,673 -747,792-815,838-888,910-1049,1071-1364,1390-1580,1602-1680,1702 -2502,2542-2587,2618-2849
atgaccaaaaagtcaaacattgcaaaacttgtttctgaaaagccaaaacatcaaagaaatttccaaaaagtcaaacattgcaattcaagtttcttaaaagctaaaacatcaaagaatgtttccaataaaaacaccaaataatacaatatcgtttccgaaaagaacattaaatgatgtttccaaaaaacaaaacattatgtttctgaaaaagcaaacatcaatgaccaaaaagtcaaacattgcaaaacttgtttctgaaaagctaaaacatcaaaggtgtttccatacaaatcagaacaagaattacacttttataaaagccaaacatcacaaataaatgtttttgaaaatcacaaaatgcatcttcccaaaactaaaatacagtatttatcagaagaaaaatacaaatcacaacactaaatacaaacaaaattattgccaacccatggaaaacacttaaaacaaataatttttatggattaatggataaatcatttttacacctgcacaggttgtgctcacactgcttcaaaaggcgcatgttcggttgaacccaaaatatttgtaccaagcggatgggcatgcaattcgcgagctgctgcccgtgttgagaatgctttatgaaagtgtgaaggaacagaaacggagcaacggaaccgaggggagcggaggaaaggcagcggaggacgggggaggcacattacaggtggctaattgagctgggttcaatagcattcctctttcaccaaattttttctttaattttcaaaaaatcttaacaattcaaaaaattattgtaaaactttcagcgattttttagaaaaaatcttgatcacaatgctcaagctgacaagggaccatcccgaactgccagtgtccaaatcactctaaaacaattttattttgtagcggcgcataatcaatttgctattggaaaattttagtacaaacaaaaaatgattgaaaaatctacaagcaaaaagacttatctttattcccttcccggtacagatcaatgtgcttcgctcgcaagtgaatgccaaggtcgcgtttttataattttaaatttcgcttggtttttaaacaatgaaatgaatgatggatgcttaagcgtcaagagctccatcaaatcatcaaattggccacagaattgccaaagacggcagcttctctgtatgaactgcttcgggaggaaatatttgcaaaagtgagaaaccaaggcattctcagtgtataaatgtaccaaatgttcaggaagtgcgcactaaagcactgggcagaccgctgaacgcagcgcaggtgcaattgaacactttcaccatctttttcccatttagagcctatttaaacacgtatttcccgttaatttagggggaaaaaagaaagaaattggggaatgtttaaaattggaatttttataatatcagacaatggccccggccggacccaaaaaatatcagacaaatgtccagccggacccaaaaccaagttcgctcaattcggataactgtgaaatgaattataaccaaaaaaaccgtaccgtggcccgttgaccctcaccgagaaatactgtgcccgcctcctcccctccccagtaaaccgacctcgtagaacagtgggtacattctgttgcataggtggaaacggaacttcgggaacgcattcaaacaaccgaacaacgcattgaagaagtgaaggaacggctccaaaacatcgagtcggacgaacaggagttgggccgaaagattgaacggcgtcggcgcgaaatggatcaactgcagaagcggttggccaaactgcaggcattccgtcctccctatttggacgagtacgaacgttacgaggcacagctgcgcgttcgctacgctgtggtacagttggccaattaccgtactttggccaaatgccaaattttgaactgatttttagtatgtgatactgttccgcaatttgcatgcgttgcaaagtcgtctagtacaatctgagcacgcggagcgcgagcaggcactggaggctgaacgttcaatgcgcgaaatggtgggaaaaatgcgcatggaaagcgaacaggcggctccattgtaggcgcttaatgaaatttctggccccaataatttggccaatcattcaattggtttgtctagccactttttaagaattgctggcattccgctgcacattgatgagctgaaccaagctgcagacgacggattggaggagtatggacaaaatgggcgacaacgacgaccaggaggtgggtggaaaaattggacacaaattttttattccagtacaatatttaaaatgtgttgaaataaagtaattagagcctggatgggaaggccgggactttcccgggatcccgatcccggctttgctaggacacggtttcccgttaatgcgtaaagacaatgtccctatggcggttgttcttttttctgtaaaatctcaatttccgcaaacagaagtgcgcgttttcggcaacatgactgggttgggactgtccgacgacgatgaggaggatgaggaagaggacgaggatgggctaggaggtggacgaatcattgaaatggaggatgatgaagaattggatgacgatgatgatgatgacaatgacgattatatgaacaattttatccgtggcggcggtaacggttcaacagcagctgcagcagaagagcccaccacaaaacgacgatgggcgttaattgagagcaaaaaagtaattaagttaatgacaaaaaaggcattaattaaatcaatccaatgatcggcagatgcgacaagaaaacgtcgatgaagaggaaacggacgaggaagctgctgatgaagacaattcgggagacaatttt

SEQ ID NO: 69737 - DNA, 599 bp, Heterodera glycines
  Genomic contig location: Contig_ID=SeqID_41652; Location=202..800; Strand=+
  SCN-specific regions: Sequence locations=1-30,78-124,146-158,181 -204,226-232,276-458,480-599
gttcggaccagcagagttgttgcgaattgaaaaataaaatgcaaaaaatgaaatacgaaaaaaattaaaataaaatacgaaacacaaacgaaaaacgaaacgcgaaaggcaaaacacaaaatttgtttttgaaaaattctaaaattttagaataattctaaaatataatcaataaagaaatattcgagatcaattattttcatattttttaatcaaattccataaaatttagaagttgatattattgttattattgttttttacttttaaagttctcctaacatttccttaatcaaggtgtgatctgctaacaaattttatatttttttgccgcataatttttcctaaatttttgtggagtaggaccgaaaggtcatacttttttgaaactagccaaattttttgcaattaaaaaacgaaatgcgaaactcaatatctctcctgaccccactcaagcccagcagaaggacaatattttcagtattgtcggccgccaagcacttaacaggccggcgttccccgacacacctttttggcgatttgttctgcccaaaaatatcggcccattttatggtcttccaattaactttttttcactg

SEQ ID NO: 69738 - DNA, 98 bp, Heterodera glycines
  Genomic contig location: Contig_ID=SeqID_41655; Location=1108..1205; Strand=+
  SCN-specific regions: Sequence locations=1-33,60-98
ttaaccctaaactttttggcctgtttaaaaaggaattaaaaatttttaaaaattttattcatctccctttttgatagaaaaggcatcagagtgcctaa

SEQ ID NO: 69739 - DNA, 674 bp, Heterodera glycines
  Genomic contig location: Contig_ID=SeqID_8940; Location=1127..1800; Strand=-
  SCN-specific regions: Sequence locations=1-74,96-154,177-614,636-674
atgaattatcatatttgtactgattttatcaattccttagcatacggtaaaaattttagatcggtcggttcacgggaattgtgacaaaagtcacacgaaaatgggtccaccacatatccgatcactactgtgcaatattcaaaattcattcaccagcaaaacagtaggcaaccaaacaatatcgccgatcaaatttgcattgttcggttgtggcatttatgtatggcgaatagcccgtcacgtccatagcagcgccggatttgcacttcaatcctttcaatttaaatacttttatacttgcttatgaaataataaaaaaatttggtcaattacctgagcaatgtccgaacagggtaataaccccgtaggcaaaaagaatcatgtccagtgctccaataagtgtcattataatgtctttgaaaaaaattttcagcaaatcctgaaatttctttcgctattggtacgttgaggataagcatggaagaagcctatccatttggcttctacgatgactaagtttatattttcgaaaaattgaaattttgtttgtctttgcaaagtggagacctactggttatattcgttgtttgatttcgttaaaattttttttaatggaaaatgaatgtaataataacgaacatttgtcaaccaactcatatgatttttaaaataaa

SEQ ID NO: 69740 - DNA, 737 bp, Heterodera glycines
  Genomic contig location: Contig_ID=SeqID_8941; Location=82..818; Strand=-
  SCN-specific regions: Sequence locations=1-152,194-603,625-737
atgtccaacttggagagcccattaagaactattgtataatataaatatgtgggttatgacgccagcagtgaaaaaaaagttcatagcgttctttttcagcctttttaatccagaaaaactcctatggactgaaccaatatctaccacctaacaaattaaaaatatttttaatataaaaattaaaaattaaattctggtcgcgccgaaacattctgcgtagaaagagcctgcgcgaacctccttgcgaaacccgtgccgaaaaagaaaaccactttcttaagaacgcatgggtgctcgattccgtggtgcgacttttggggagtgaaagggacaaattcaaaaagaagacaaaaggaagtaatcaaacggaccagaagaaggaggacaaagataggaagaaaacatccaatataaaaatgaacattgacaagaagaaaaaggaatgatttgaaaaggtcgacaaaaagactagaactggatttttatgaaagtcgactcaaaatgcaaaaaaaagccagagaaaacaattaatctgctttagaaaatcaaaaaggatactaattgacaataagtaggggggcttcgccttagctttgcctatttcgggggagtgagagaggggcgttaattaaggacaatccaccagaagaggatagtccgttaattaaggacaatctgagagtgaatgaaaatccttcagtgaactgacactatgtctatatgaaattattattaaa

SEQ ID NO: 69741 - DNA, 887 bp, Heterodera glycines
  Genomic contig location: Contig_ID=SeqID_41663; Location=422..1308; Strand=-
  SCN-specific regions: Sequence locations=1-297,319-549,571-788,810 -844,866-887
  Gene Ontology: Cellular component=cytoplasm; Biological process =neurogenesis
atgcggagaaaaagacggatttggccatggaaacgccgtcgaagtgttgcaagaaacgggaaggtaaaaacggacggaaaggcgcacagggggaagacgacgaggagaagaggaggacgagcgggacgaagatactggtgatgaccaacaaaaggcccttctggaacgaacagtctcaagtctaccaggtaaatgcagaaaccatgttaatggtgggcgtgtagtgtgattcattctctacgatatttaattgtttaagttggactttaatggaagagtcactcaagaatctgccaagaacttccaaattgaacaccagtctcggcaagtgcttcaatttggacgcatcgagaatggtgcgtacacattggactttcgcgagcccttttctgccattcaggttggttctcttagtaattgtctatttcgacatttgatgttttcaggcttttgccgttgctttggcatcaataactcaaagattgaagtgatttgattggctgctctaaggtttattctggtctacgaattcactcgagtaaatgcacgacgcatgtgaaaaatgtgatcatcatcaacctatatctctttctgttattttgtacaatttttcatgtttttggttgcgcgtctattcacaattatttgacattgtctaactccatcctccgactttgggcatccaattgactttttactatgtctatttgtgtattattttatcagtactataaaacaatttatatgcataccggcaaatttaaagttcatttacagaattccctaattttccgccagttcctttccctacattcaatttttgtatggataaaaaataacatcaaaaatcctatttatagtaataatatggtatttgagacaataaa

SEQ ID NO: 69742 - DNA, 565 bp, Heterodera glycines
  Genomic contig location: Contig_ID=SeqID_41665; Location=426..990; Strand=-
  SCN-specific regions: Sequence locations=1-13,35-157,179-249,405 -407,429-565
atgaatttatggctattaatagttattattatattttgcttattttatggaattaaatctggcaaaatccaaccaaattttgacgaaatatttggcgacaaatgggataaaaatgaaagtgaagaaaaaattattaaaatggaacaaaatgaaaactctgaatttaatattaatcaaaacagtggaaaaaatggaaaccgccctaatgatcaacaaaaaatagaaacaatcgaaaaatttgatgcaattaaagaaaagttgagagaaaaaggaaaatatgaaaatgaaaaaagaaataaaattgagtggaaaattgcaaaattattaggcgcaaatcgtaaaaaaatatacaaatggaaaaatgaattaaatttaaataaaattaaattcaataaaatgaaaaagagtttttatgaagagaaaaagagcgaattcattgaacgaattgatgaatttaaaagtttatatggccaaggaaaacataaagaatttgtgaaggaattaggcatttcaaaaaagacatttcggaaatggaaaaaagaattactgccaaattgctataaaa

SEQ ID NO: 69743 - DNA, 390 bp, Heterodera glycines
  Genomic contig location: Contig_ID=SeqID_41667; Location=119..508; Strand=+
  SCN-specific regions: Sequence locations=1-63,90-292,325-332,354-367
atgaacccactcgtaagtattttagacttttcagttaaaatcattttggcttgaaccctgttcaaataattatataattaaattttaaacaaaacaaaatttaccagatttccggtggatcgaaacttgccataaaccgtatgtcgtggactgtttattttctggctactgtagaaaatgagttccaaaccatgggatacggctgcacagcttcgctgatttcaccgcaattcgttctgttggcagcacattgttttgacaatctgaaggaaaatggacaattttcacttggtaattttttttattaaattaatacataaatttgtaaaatgtcatgatgaaaaaatgaataatagatgtatatacgttataataattaataatatttaa

SEQ ID NO: 69744 - DNA, 115 bp, Heterodera glycines
  Genomic contig location: Contig_ID=SeqID_41667; Location=745..859; Strand=+
  SCN-specific regions: Sequence locations=1-115
atggacaaaaaagttaaactttctccaaaaatgtatccagtctgcgttcattgtgggcccaccgaaaaattcaaaaatggaaaagcattcattgccggatggggaaatttaaaga

SEQ ID NO: 69745 - DNA, 565 bp, Heterodera glycines
  Genomic contig location: Contig_ID=SeqID_41671; Location=742..1306; Strand=-
  SCN-specific regions: Sequence locations=1-362,385-565
atggcattggcacgccgagaaaacaatggcaccaccaccaccgctactgctcgacgatatggcgtggagacgaaacaggcggcggcaaaaacaacggccaaacattccgcggaggatgatgatgatgatgatcaacagcagcagttgttgatgaacagcacctacattccggaagtagcaaaggtgtgaaatccacaggccccaaatttttttgaaattcaaaccggaattccgatgagcaaaaaaatttcgaacttggaaaatttcaaggaatcaattgaccaaaatggcagttggaatcaaaataatccaagattgaatttttcattcacactgaaaccttttgactatttcaagaatggcaatttggtgccaatgtttcccgagtatggcattttagtgattggaatggcatttctctgccgatgatatttgagaacgcatttcagcgccatgtagttcaaaaatgactttttctggaattcgattcgaatcgaatgatatattacaagaatggcactttgtgcccatgatttttcagaatggcatttcagtgccaaataaa

SEQ ID NO: 69746 - DNA, 375 bp, Heterodera glycines
  Genomic contig location: Contig_ID=SeqID_8942; Location=904..1278; Strand=+
  SCN-specific regions: Sequence locations=1-314,336-375
atggctcgccagctcacagatggcactggtggtgccaccaccaagcgtggttccgcctcctcactgctcaacctggtcagcgctcatcaccgtggtggcgaaaagcgctcattccggcacccctctgtcgtgcagagcaccagcgccaattccaccgccgccgcgctgttggacgcgcagccggcggtgaccgccgccggctcgtcagccaagaagcggagcggtggtagcggcactggcgctggcggcagtgttaataatgcgttggagcggctggcacgtgccggcggtggcggcagtgttaacaatgcgttgattgagcggatggcacgtgccggcggtggcggaacggctggcaacagcaaaaaggcatga

SEQ ID NO: 69747 - DNA, 258 bp, Heterodera glycines
  Genomic contig location: Contig_ID=SeqID_41672; Location=515..772; Strand=-
  SCN-specific regions: Sequence locations=1-258
aatgaaagtttaccacctgatttgggctgcgaatccccaaaacaacccgactccaagacacgtaaagaatggaataggcaccgccagttggacaggtcttgccaccttctctggagccccggtcgaagggaaaacttgaacaagcgggccaacccaagctcacggtctatacgctacacctcgcaacccagaggagctgcgattcgagcgctggactcttcccagttcactcgccgttactacgggaatcctcgttag

SEQ ID NO: 69748 - DNA, 141 bp, Heterodera glycines
  Genomic contig location: Contig_ID=SeqID_41673; Location=35..175; Strand=-
  SCN-specific regions: Sequence locations=1-7,30-49,92-109
atggcccccaaatgccttccgctcgaactgttgttcgaaattgtgcctttcatccctgccgaaaatgccacaccgaatgcgctctcgtcctctcggctgctgtacaactttttgctgccacgtgtcatcaaatggaaagag

SEQ ID NO: 69749 - DNA, 358 bp, Heterodera glycines
  Genomic contig location: Contig_ID=SeqID_41677; Location=5..362; Strand=+
  SCN-specific regions: Sequence locations=1-200,275-358
atgggcccagcgctcgacggacaaagaaaacttttctcattgttttgtggtaggcgcttttcctctgccgatggaacaattgaaggcaaaaagtgtggcattggcacactctgtgccaacaaatttgtcttaatattttttttttgaacataaacaatgaagttgaagcttaatataagggatacatatgttcttgacagatattttattaattagttttttttaaataaagtgaaaattgctgaaattgttattttatatatatatattttttggttttttacacttaatttctaattttttagcttttttggtcaaaaatattaacgtagaataattaagtattttttggaaaata

SEQ ID NO: 69750 - DNA, 636 bp, Heterodera glycines
  Genomic contig location: Contig_ID=SeqID_41678; Location=1..636; Strand=-
  SCN-specific regions: Sequence locations=1-245,269-411,433-636
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagtactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaataatcgattttttcaagtgtccgtttggggtactcaaacaattatggggagcaaaaatccaacgcagaattaaagtacaggctatagggaagctat

SEQ ID NO: 69751 - DNA, 1267 bp, Heterodera glycines; identical to SEQ ID NO: 41680
  misc_feature (1189)..(1189): n is a, c, g, or t
  misc_feature (1238)..(1238): n is a, c, g, or t
  Genomic contig location: Contig_ID=SeqID_41680; Location=1..1267; Strand=+
  SCN-specific regions: Sequence locations=1-375,397-498,520-1022,1044 -1238,1262-1267
  Gene Ontology: Mol. function=transaminase activity

SEQ ID NO: 69752 - DNA, 60 bp, Heterodera glycines; identical to SEQ ID NO: 52045
  Genomic contig location: Contig_ID=SeqID_41681; Location=154..213; Strand=+
  SCN-specific regions: Sequence locations=1-60

SEQ ID NO: 69753 - DNA, 1401 bp, Heterodera glycines
  Genomic contig location: Contig_ID=SeqID_8944; Location=72..1472; Strand=-
  SCN-specific regions: Sequence locations=1-348,370-503,550-829,851 -976,1005-1401
atgccaaattttttaataaaaaagtgccgaaaatcggtgccattggccaaccttatgtttgatgagcagaaatgggatcagcatcagcaggcccccgtcgtggaccacctaaattatgaaaatgcgttggttttttcttcctaaaatggctttttttttcttttcaccacccaataaatgtcgatggtccccgtgagtcggtccccgtggctgggaaaggcactggcatattttggcaccaaaacggcacagcccgcggccgcgatggtccgcaccaattcggcaaatcggttggcctccaacattgggtttttgccctgaaaagtgtacagaaaacgtattttaaaattgagaatttaatatttcacgcaataaaagaattaaaaaataaaacggacggaaccaatttaaaattttaaaatgagaaattttaggcaccccaatcaagcaaaatttcctataaaatctggtttttttggcacctaaaattggaaaattggcacaaattttaatttattttgtaaaaggaattaataattttaaaaaatagcagtcaaaaaatgttaccggaccagaggccgaccaattttgaggccatgcacaaacgacgctgaaaaaccaattagtgttttttttttaattttcaaaattatttggccaatttctggccattggccacctgttgtgccgaagtccgcccagccccgaggtttggatcagatgggagacgccctggatgtactggtcggccaccaacacgtcgcagaagccgcggatgcgactcgccttcacttcgtcgtgcaaattctgtggcaaaaataataatgggtaattaattaataattaatttgctcattagattagtgctcccaaaaactcgatgaaaatttggaacaaaaaatatttttcggcaaattaattctttttttgtctaaagataccaaaaatggcacacaccagggatggcattccgaggccccaaaattttttgaaaatcagaaaacgtaattccgaggtccaaaaattttttggaaatcggaattccttgcaaaaaatgccagaaatcagaattccgtgccatccctggcatacactgtgcattcgagaccgagctctgcaatgccaaaaattgcattgacagtgttgtttgtcgacctgtcggattgtgtccaattcgccgcccgccatttgggcgaatttcccctccacacattcggccacaagcgtcagccctttgcccgccttcagttggcccacaaatgcgagcagtccacgccgggtggattccaagtcggtgaacaagcccgacatggaggcggacgggtggaggacaagctgagaaaaggaacagcgaaatgggatggagagaagacatggatcatcatggatcatggacactga

SEQ ID NO: 69754 - DNA, 4457 bp, Heterodera glycines
  Genomic contig location: Contig_ID=SeqID_8944; Location=1..4457; Strand=+
  SCN-specific regions: Sequence locations=1-468,497-622,644-923,970 -1103,1125-1520,1542-1549,1571-1618,1694-1939,1962-2102,2125 -2280,2302-2305,2327-2570,2656-2697,2785-3059,3081-3565,3591 -3894,3918-4457
  Gene Ontology: Mol. function=potassium:chloride symporter activity; Cellular component=integral to membrane; Biological process=transport
tacgacggcactagagggtcaattcatcgttttttggctgctttgatttggtcagccgattcttttcccgatcagtgtccatgatccatgatgatccatgtcttctctccatcccatttcgctgttccttttctcagcttgtcctccacccgtccgcctccatgtcgggcttgttcaccgacttggaatccacccggcgtggactgctcgcatttgtgggccaactgaaggcgggcaaagggctgacgcttgtggccgaatgtgtggaggggaaattcgcccaaatggcgggcggcgaattggacacaatccgacaggtcgacaaacaacactgtcaatgcaatttttggcattgcagagctcggtctcgaatgcacagtgtatgccagggatggcacggaattctgatttctggcattttttgcaaggaattccgatttccaaaaaatttttggacctcggaattacgttttctgattttcaaaaaattttggggcctcggaatgccatccctggtgtgtgccatttttggtatctttagacaaaaaaagaattaatttgccgaaaaatattttttgttccaaattttcatcgagtttttgggagcactaatctaatgagcaaattaattattaattaattacccattattatttttgccacagaatttgcacgacgaagtgaaggcgagtcgcatccgcggcttctgcgacgtgttggtggccgaccagtacatccagggcgtctcccatctgatccaaacctcggggctgggcggacttcggcacaacaggtggccaatggccagaaattggccaaataattttgaaaattaaaaaaaaaacactaattggtttttcagcgtcgtttgtgcatggcctcaaaattggtcggcctctggtccggtaacattttttgactgctattttttaaaattattaattccttttacaaaataaattaaaatttgtgccaattttccaattttaggtgccaaaaaaaccagattttataggaaattttgcttgattggggtgcctaaaatttctcattttaaaattttaaattggttccgtccgttttattttttaattcttttattgcgtgaaatattaaattctcaattttaaaatacgttttctgtacacttttcagggcaaaaacccaatgttggaggccaaccgatttgccgaattggtgcggaccatcgcggccgcgggctgtgccgttttggtgccaaaatatgccagtgcctttcccagccacggggaccgactcacggggaccatcgacatttattgggtggtgaaaagaaaaaaaaagccattttaggaagaaaaaaccaacgcattttcataatttaggtggtccacgacgggggcctgctgatgctgatcccatttctgctcatcaaacataaggttggccaatggcaccgattttcggcacttttttattaaaaaatttggcattttgggaatgtttttcgagttaaaacgaattttacggagacaaatcttatttgtaatcagtcattttaataatttctatttgaaatattttaattgctttttaatggctttccgaacggatttttaaaaaaacacaaaaaaattcggatgaccacggtgggactcgaacccacaatctcctgattagaagtcaggcgccttgtccattaggccacgcggccccacgctgacgggcgttcccattaagcaaaagacagtggaataaatgtgagaaagtgtgtgcattaaaaattggaaaatgtgcgcagcggcggaaaaggaaaagcggcggcgcaaaatgtgaacaaacaaattcagacatggaaaaacacgacggtgcgactgttcacttttgcacagccggaggacaacactttgcaaatgaaaagagtgggcaaatttaagaaaagcattgaaatttaattaattttttgggccgggggaatttgcgccaaaaatttaacgaaatgccatccttttaaattgaaacttttgaagcgggaacgaataaaagccatggcatatttttggaatgtttttgtgccccgttttcatttggaaaattcgcaaatttcggttcaaaatcgatggcaccaattttatcgtttaattcgctaattgatcaccaggctcgtaatcagaatttgaaggcctttttttgccgatgtccaaattatttttacatttggaatttctttggtcaaactttcaaaaaattgagcaatattcgttctggaaaatcccaccccttggcatatatttttggcactgtttccatgtcaattccctccccttttggcatttctttttgacttttggcactgttccctccccccgtgccaattcctaaaacttcacaaatttgggcaggacttggaacgctttctgtaccatttgcgcattgaggcgcaagtgttcgttttggaaattgactccaccgaaattgagccgtacgtttaccaacggacgctgaaaattgaggagagagtgaaactgttgagagaaatgggcaccaaaagcaatgagagagtggcggacattcaggtgaaaacagagagtgggagagaaaaagaggagaaattggaatttaaaatttaataattaaacttaaatggaaataatctaaaataatcaaaatttaattctattttctaagcaaaatgtttaaggaaaaaaactatgatagaaaaaatatttaattgaatttgaatttttaaatatattttatagactaaaattaaaatttattaaaaatatatttaaaatattataagcaatagattcaatgaagtccctcatttgtcaggtgacgatggacgaggcggtgttggagcggaagtactcgcggcccgactcggcccggcgacgctcctcaaccgttgatccggacgcgccatcgcaagactcggccaaggtgggcgagaattggccaaatctcggcctctaagacttgggaatgaccactcggaaatcttggtcccgagtctcggcacaacgctcccgtgccaatcccggcatcccttgtctcggtgaagttctctattatcgacttcaatttggatgccggtgcgattctcgaccaaaaccttgcgcactaatcccgacgcaatctcggtgccgggtctcgaccaaagactgcactcttattccgacataattacccggtgccgagtctagaccaaaaatttacccctaatcccggcacaattatccggtgccgagtctcaacctttgcgcccttaatcccgacacataggccggtacggagtctcgaccaaaacttttcgccccctaatcccgacacaattggccggtgccaaagtctcgaatttggtgcaaatttaaggcgaacactctgtgggcggtgcacgaagaatctgaggaggagggaaagcaacagcaaaggcagcagccgaggagcatagagcaaagccaagcggcgagaacggcaccagcgaatgacgacgacgacaatggcacaaatgggagcaaagtgcgcttcatcgacaattcagtggaggtgaaaaagcgcataaggatactgcagaacacagaccaaaaaagagggtggggggatactgtaaaaacttaggcttttggcttgtgcctttagttttaagacttttttttttaattggtgcatctcaaatgagcaatatatttcaattagggcacggcgggaatggcatttccgtcgggaattgcagcaattttgttgtgccaacaattattcctgatcaactcaaaatcacacacagatccatcggccctcgttggactctgccgacagtttgttgccgtcgcctgttaaagtgccacctcgggcgacgacaacaaataacacactgacagtgaacaatgatgctaatggggtgcaaaaagcatttaaatttatttatttaaattgacgcgccgccatttcagtcccaacccgtcccttcgacggtggcacgaatgcacacggctatgaagctgaaccagcacatgcgggagctgagcgcggacgcgcagctgctcattgtcaatttgccgggcccgccggaagttggccaacacgacgcttactgtaagaagacagtgcctattgtaaaactgtgtttgccaaatctcatctccccccccccatctcgcgtagtctcgagagtgccattctcgtgttaatctcgagagaaccattctcgcattagcctcgcgaattccattctcgcattagcctcgcgaatgccattctcgcgttagtctcgcgaatgccattttcgcgttaatctcgcgaattacattctggcgttaatctcgagtgccattctagcgttctcggcctgtgctgtgcctcaatcatcatccatccgtttttcagacatggaattcatcgaagccttgacggaaggcattcgtcgtgtgctgttggtgcgcgggacgggctccgaagtggtcaccatttactca

SEQ ID NO: 69755 - DNA, 640 bp, Heterodera glycines
  Genomic contig location: Contig_ID=SeqID_41682; Location=209..848; Strand=+
  SCN-specific regions: Sequence locations=1-455,477-566,596-640
atgacaccacgatttgcacttgacgctattgataaaaaattacgtgaattaactaaatgtaacctattatttggtggaaaaactattattcttgctggtgattttagacagaccttaccaataaaaaaatttgcagtaagaagtgaaattgttgatctaacaatcaaaaaatctgttttatggaacaattttgagcaattgaaattaactataaatatccgagccaaggacataatatttgcaaaacaaattcttgatataggcgatggagttagtccaaacagcttcattcaattacctccggagtgtattttatcaaatgaatctgatttaatcgatgaagtttacggtgacatttttttaaagcataattttaatgaattaaaaaatcatataattctaaccccatacaacgatttgaccgataattataatgaaatagctttggataagttcccaggaaaatgcgttacttatcttagtattgatgaagttgaaacaagcaataattttccaattacaccagaaataatgaactctttcaattctcccggttttccattgcatgaattaaaattaaaacaaaattgtaaagtaatgcttatgcgaaacataagtattgaaaatggtctttgtaatg

SEQ ID NO: 69756 - DNA, 610 bp, Heterodera glycines
  Genomic contig location: Contig_ID=SeqID_41684; Location=107..716; Strand=+
  SCN-specific regions: Sequence locations=1-290,313-610
atggaggagcaacaatatgctgttgttgttgatgagccggaccattaccgtattgagcaacattttgacgagcccatgccagaggaatacggtgatggtggtactattgtacatcatgagcatgtcgttgaatgggaacagcaccgatccgacgaatcaccaccttctgatgcagtatctgcaccggctgcagaagaggccatgcaaaagagtggcaccacaacagtgactactgtaaccaccgtaaccgactcgtggagcagcagcaacggtagaggcgctgaagcagagacggagggggaggaggagaagcggctggcacatgcacagctggcagaacaacaacatgaggaagaagaagccgaacacaaagggggagcgggaggtactgcttcaacaaatggtggccatggtcgtgccgacgaagttggcacaccggtgccaacggaggaggaccaccatggtcatgatgatggacattggcacgagcaagccgaagaccgccgggactagtctcgaaacggctggcactttgtgtgccgtcgtcggacatccatgccaccaaaaaaaaaaacgccgtgccgacgtcgtcgctttagcttatgtttaa

SEQ ID NO: 69757 - DNA, 590 bp, Heterodera glycines
  Genomic contig location: Contig_ID=SeqID_41686; Location=265..854; Strand=-
  SCN-specific regions: Sequence locations=1-95,118-138,160-246,289 -394,440-564
atggcaccgccgcaaaaacaacggcactttgccctgagggcaccgaatgccaaaatttggacggcgcttttgtgtgtgcgtccactgccaggtccaaaaaattaaatctttatatgtatattaattctttttgaatgtcttaattttgttctgaatattcacggcgctcaattggcactgtggcgctgaaatttctctctgcatacatttcagcgccgatttacgattttttgaccccctcccaccttaaataaattaaaaaatatgacaattttttaaattatatatcacatggagctcagatggcttaatggtgctgaaatgggcctaagaaaaatttcagcgccgacttccccccccccccatcaaaaaattaataattttaagcgattcgttaataaattttagatttttaaattttatttaaatcatttttattgtagtttgtttgcaagcagttcgcttcgatacacaatccatcaattcaagcagaatgtcaaaattgccaatttcactgttgaaattcgaaccaggactttaaatggacacttgattaaattggtgattttttaaatatatttattaataaa

SEQ ID NO: 69758 - DNA, 604 bp, Heterodera glycines
  Genomic contig location: Contig_ID=SeqID_41687; Location=22..625; Strand=+
  SCN-specific regions: Sequence locations=1-183,207-319,344-604
atgtccgaaaatcctgagaacattcgaattggtaaggacgaataaattttgagacattagtaatttaatcaatgtttggctccactacagtttacttgtcaaattagcttttacacttccatttacttcagattttgacaacgatcgtacgaagtcaatcggcacgccgtttaaggtcaaaccaaagctttcctacactccttacagaggctccttcaaatacgtggacacaacgaaggcactgactttgtttgattcatttatttgttcatttcattttgcaatttcagatgtcaaaccgcgaatttgcgatttatcagcaaaagaaggaggaggaaaagaagcaagtgctgaacgaacagagcgaacgatgtgcgagtgtcaacagaagcttcttctaaatttgtagcaaacgtttggactgtccgattgatgcgtttcgtttggttcggatgtttatttgtatttgactgtagcatcttctgacctatttatgtatcctggtaatttttttttccattgctatcaccgatcatcaaaatcttctatcgacctgattgaattgaattgtcattggcagttcgttcaatacaaattttacaaa

SEQ ID NO: 69759 - DNA, 569 bp, Heterodera glycines
  Genomic contig location: Contig_ID=SeqID_41688; Location=1..569; Strand=-
  SCN-specific regions: Sequence locations=1-482,505-512,536-569
  Gene Ontology: Mol. function=structural constituent of muscle; Cellular component=cytoskeleton; Biological process=regulation of striated muscle contraction
gaaaactgggagcgactcagctcattcgtgcgcaacacgaacactttggtgcgcgattttcaaattgtttcaatttgggccctcagttcaaaaacgatttgtgaatgtatggcaaagtggtttttgtaagatagcaagggacaaacggcggatgttcgagtccgcttcacgacaaactttggagttttttttttgttgaataatttgtgaaaaagtgtatcaacgtaaaatgcctgtatttcacaatgtagaaaaatttttgtctatcgttttttttaataattttgtataaaacaggtatccggcttggtggagaatgaacgctataaattccgagtcttggccgagaatcagtacgggctgtccgacccgctggaactgcccgagccgattgtggccaagtaccaattctcggtaccaagccagcctgacaagcccgtggtgcgcgactttgaccgaacatgggccgaattggagtgggagccgccggcatccaacggcgggtccaaaattcttggctacaacctccagtacagggaccaacattcgcacaaatgggtgagtatatg

SEQ ID NO: 69760 - DNA, 526 bp, Heterodera glycines
  Genomic contig location: Contig_ID=SeqID_41689; Location=326..851; Strand=+
  SCN-specific regions: Sequence locations=1-125,147-501,523-526
atgatcaagctggagatacagtatatgcagttgaaacggatgtgtgaccgtcacatgaacaattgtccttgtcccgaaacgacaaccaccacgacaacaccaatgacgacaaccacaatgtccaccaccacaactgagcaatgtgaaccagcacagccgtgccaagatgacagcccgatgatttgtgcacattatgccaaactgaatcagtgcaacaaacctggcgtatgtgtgctcataaaaagggtgttcctccccgatccgattcggggaaaaattgcgaatttcgtaacggttgacactccaaatcggatgttttgattttaaattaatgaccgagccgggcccggtaccgggtttttaccaggctccgaaaaacaggcccgccgatttttggaaaaacacggtttgaccggtgttggaggcacgacccaagaaacccgagttgtttttgaagatgtcagcccagcctgggcatttttaatttatcggttaaaccccatttagtatacaatgaaattttgta

SEQ ID NO: 69761 - DNA, 657 bp, Heterodera glycines
  Genomic contig location: Contig_ID=SeqID_41691; Location=1..657; Strand=+
  SCN-specific regions: Sequence locations=1-657
aaaaaatcgattttttcaagtgtccgtttggggtactcaaacaattatgggagccaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaac

SEQ ID NO: 69762 - DNA, 967 bp, Heterodera glycines
  misc_feature (19)..(19): n is a, c, g, or t
  Genomic contig location: Contig_ID=SeqID_8945; Location=37..1003; Strand=+
  SCN-specific regions: Sequence locations=1-340,374-656,679-755,818-967
atgtcaactttcgtgagtntaattatcataaatatattatagcaaaaccataatgccgaagttgtccaacaacaacagcaacagtcacaaatggcacatctgcttgcaacaacaccgcagcagctgcagctgaacaccttccagttggtgttcaagtcgttgaagcagcgcgacgaatggagggatgtgttgtggaaggccatgtacgtccgtgttatatatagactgtgtcctctaagcctatttctaattaaatttcaaactcagactatgacaatttttgaaacattttcacatttttttgaaaaaaaaatggaaaattcataaaattattgcttgcaataaaataaaaatttaatttacaaaattatttccgatcgctcttggctcatttttcgagttcaatcatttttcagcgaaacttgtaatccacgagcggcacatacaaaagggcattcactgttcttcaagacgtacaacggcgtgacaatttgtgccatttgcaaaatgttattgcgcggccaattcttccagggctatcattgctcgggtaaaaataaaacaaatttggaatgctaaaaaatgattaaaaaaattaaaaacacttagacaaatatggattggaaaactggaaaattaaaaaaaaatagccttggaaaatttaaatttaatattaaactcaatcccctgaaaacactaaaaaatcaaatttgacaatcatcatttcatattcaattacaagctttcgaaattacattatttatttgaatttaatttttgcattttttaatatatttatcaattttaaaatatttttcttttagcagtttgaagaaattagcctaatttttataatttttatgcgccgtaatttgtagtaatcaaatccagggctcccccatttgtccctaatttcaaaataccctacattttcggctttcatccattgatcaactactaattcgca

SEQ ID NO: 69763 - DNA, 187 bp, Heterodera glycines
  Genomic contig location: Contig_ID=SeqID_8945; Location=1074..1260; Strand=-
  SCN-specific regions: Sequence locations=1-187
atgtgcactccttcaagcaggcgcactcgcgatgcatgtcacgattacagcctgtaagcgtaatgaggcaatttatcattttttcgagaggagagcggcgtgccgaaaagtgccgcctgggaaaatttgcacaaaaaatagaattttaaagaaatgccaacaaattttcaggatgtttttggattaa

SEQ ID NO: 69764 - DNA, 395 bp, Heterodera glycines
  Genomic contig location: Contig_ID=SeqID_8946; Location=489..883; Strand=-
  SCN-specific regions: Sequence locations=1-326,365-395
atgtgctttaccgaaccatcgacactgattgaaagagcatatttttgcacttcggcactccaccggacaagaaatgtgccgtccgccgtgccgtacagtaaccgtcgcgactcggcacggtccatgacgccaaaataccatggttgttccacaacattcggattgtttttgtggaaatcgacgattgcgctgggaaaaatgcccgaaaattaaagatttatttatcaaacccgaaaatatataatggaatttgagacatataaatgcaaaattttttaaaaatttcccctaaaactaaaaaattctcaaaaaaattcattggattcaaaaaaaaatttttttttatcacaattatttaaattttctgaatgtcttaaaatgatttttctaataaa

SEQ ID NO: 69765 - DNA, 931 bp, Heterodera glycines
  Genomic contig location: Contig_ID=SeqID_8946; Location=695..1625; Strand=+
  SCN-specific regions: Sequence locations=1-220,249-595,618-931
cgcaatcgtcgatttccacaaaaacaatccgaatgttgtggaacaaccatggtattttggcgtcatggaccgtgccgagtcgcgacggttactgtacggcacggcggacggcacatttcttgtccggtggagtgccgaagtgcaaaaatatgctctttcaatcagtgtcgatggttcggtaaagcacatgcggctggagtataatgcggaaatgaaaaagttattaattatattaaatttaaaaaattgtaaaatgccaatcatatttggcttgccaaaaattgaacggcaaaattttaaacggcacatttttttttttgttaacttagccaaagtatgaaaatacggttttttggacatttgggcctagacttttcgtattttagggtcaattttgggtttcgcgtctagaaaaaaaaaataataattctggacagcccatattctacgtactttttcccgccataagggccagaaaaacccaaagttttaggctttttcataattttttttatcctcaattcagataccatttgaacgatatgcgctttttcaacacaatgcttgtaagtttggttggaaaaggtttttcgtgaatttaaaattaaaatttttttgtttttgtcaggacctgatcaactattttcgtgtaaataatctcagcgaggccattcatggcttggatgttgttctccggggcaccccgctcaagggcaccctttaccgcgcggtggcgccatttgaacggtttttggcaaaaaaatgaaaatcaaaaataccccctaaattatcctcccgatttttcagtaccaatggcagggcaggttacatcacactgaggcctggtgatctggtcacactgttggacaccgccgatgatgacaagggctggtggaggggttctgtcagcaatgcaaacggtggcacacgg

SEQ ID NO: 69766 - DNA, 545 bp, Heterodera glycines
  Genomic contig location: Contig_ID=SeqID_8947; Location=948..1492; Strand=-
  SCN-specific regions: Sequence locations=1-113,145-312,338-448,471 -477,507-545
atgatcatacgattcaaattaactgttctttctttgttggttcggcagaatgcacattcacattcacagaaaacaagaaataaatgtggatcaatatttttaatttgttcaacaaattataaaaataaaaaataaatttttattgctttcatttaattgattaaaaatttggtataaaaaatcatttaaggcaaatgcgtaatgggacaaaatgcgtaattacaactttttaattgttcatgaaattttcacaaattttcgagcaattattattatatctttaatgtataaaagtttatttggagatcggacttaatttttttttttttttaattttggacaattaaaaatgtgtgaaaaaatcaaaaaaataactttttttgagataaaaaattaattaatatcagattaagtccgatctcaagacataaatttgtagtcgttttgtgaaggcatggaaataatttgttaaatcacaaaaattattattatagaaaaattataatgctccggcagaaggtcaaattcgaatcacacaaaataaa

SEQ ID NO: 69767 - DNA, 882 bp, Heterodera glycines
  Genomic contig location: Contig_ID=SeqID_8947; Location=1722..2603; Strand=+
  SCN-specific regions: Sequence locations=29-344,366-505,527-673,695 -882
  Gene Ontology: Mol. function=3-oxoacid CoA-transferase activity; Biological process=succinyl-CoA metabolism
ttttattttttattttttttaatttttagaaggccccaaattgttggcaccaattcacattgtcggcacagatttcgaccagcgcttatagaaataatgccaaaatttttgagagtgctgcggatgccgttcgggacatacccagcggcgccacacttttggttgggggttagtcagtatttgaattggaattcaagaaatagcgaccggaccaggcatgcacactaactatgcttgtgggtttaagttggcctggtccggcctgggcctgaaaatttcggcacgatgaaaattttaaaaaatcgaaattttcaattaaacgaaaattctgacgcatttccattaaaagtattctttccttttttggctttgggctctgtggcattcccgagcatctgattgatgcggttgctggcagtggcgtgcgcgaattgacttgtgtcagtaacaacgccggcattgatggtgttgggcttggcattttgttgcgcaacggccaggtctctcggaattaaattttcaaaaataaaattcgagtatttcaaattggattaagaaaattttgtgaattttctctccgataacatttcccaatttgttcgatccctaagccatatttaatcaggggtcgaaaatcgggaccccgttcggtgaatggccaaaactttattcgaacaaaaaatcaaattttttacaaatacatttacttaatagccctcaaagttaattaaaaattttacttaaaaattcaaatttgctttcttcctgacaaggtgcgcaagatgatctcctcttatgtgggcgaaaatgccgaatttgcgcgccaatatttgggcggtgaattggaattggaattcacaccgcaaggtgctctcaatttgt

SEQ ID NO: 69768 - DNA, 473 bp, Heterodera glycines
  Genomic contig location: Contig_ID=SeqID_8947; Location=1730..2202; Strand=-
  SCN-specific regions: Sequence locations=1-116,138-473
atgccaagcccaacaccatcaatgccggcgttgttactgacacaagtcaattcgcgcacgccactgccagcaaccgcatcaatcagatgctcgggaatgccacagagcccaaagccaaaaaaggaaagaatacttttaatggaaatgcgtcagaattttcgtttaattgaaaatttcgattttttaaaattttcatcgtgccgaaattttcaggcccaggccggaccaggccaacttaaacccacaagcatagttagtgtgcatgcctggtccggtcgctatttcttgaattccaattcaaatactgactaacccccaaccaaaagtgtggcgccgctgggtatgtcccgaacggcatccgcagcactctcaaaaattttggcattatttctataagcgctggtcgaaatctgtgccgacaatgtgaattggtgccaacaatttggggccttctaaaaattaaaaaaaataaa

SEQ ID NO: 69769 - DNA, 422 bp, Heterodera glycines
  Genomic contig location: Contig_ID=SeqID_41692; Location=412..833; Strand=-
  SCN-specific regions: Sequence locations=1-27,49-182,204-255,277-422
atgaagtgagttatggctgatcaaatgtgaccaaaactaaataacgaaaataaggcactgaaactttcgtaaatgttgtaaatttaatctactatttctattatcctaaaaaacatctaattaatttatttgaagtgaattggaagctttgagctctgattatgaatttgatcagattaaatatactttgtatttcatttgagtgtattggcgttttgttttttacgccaatttaataactagggccggatttatatggatttccatattttatacttatttcggccgaaaaatcacgtaaatagtattttagcttgatttgttgcttctagggtgtctttttattccctatttttcatattttttgtttttgtctatacatagttccattattttacattcatatttttggcattaataaa

SEQ ID NO: 69770 - DNA, 454 bp, Heterodera glycines; identical to SEQ ID NO: 62857
  Genomic contig location: Contig_ID=SeqID_41694; Location=108..561; Strand=-
  SCN-specific regions: Sequence locations=69-140,208-343,379-454

SEQ ID NO: 69771 - DNA, 658 bp, Heterodera glycines
  Genomic contig location: Contig_ID=SeqID_41695; Location=85..742; Strand=+
  SCN-specific regions: Sequence locations=1-313,344-533,576-658
atgcgcacccgtccgatctggcaagttaagcaacgattgctgactagccaaaaggttcgggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtga

SEQ ID NO: 69772 - DNA, 677 bp, Heterodera glycines
  Genomic contig location: Contig_ID=SeqID_41695; Location=1096..1772; Strand=-
  SCN-specific regions: Sequence locations=1-56,78-677
aaaaaatatttatgaaacaaaaaaatcgattttttcaagtgtccgtttgggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgagtgtccgtttggggtactcaaacaattatggggagcaaaaatccaacgcagaattaaagtacaggctatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 69773 - DNA, 568 bp, Heterodera glycines
  Genomic contig location: Contig_ID=SeqID_41700; Location=423..990; Strand=+
  SCN-specific regions: Sequence locations=1-101,129-136,159-162,185 -187,237-292,314-568
atggaaaaaatgaaaatttattggcaaacgaaaaaagaaaatccaaaagtgagtgacaaaaaaattgcgaaaattatgaaaattagtcgaaatagcattttcaattggaagaaacaatttggagaagaagtgcttcagagaacagcagaagaagaagaatgaattgtttaaaatgttatttttggtgttttttttctttattaattatgctaaattataaatttcattatttttttcaatttcttcaaatgccgaaattgtaagaaaattggagttagtcgcttagttaatgaaaaatggatgaactaatttggcattcacatacacggatttttcaaaatttatagtcattcagtgaattggttatctattttttgaaacttttgaatttaattgctttatttgactcggctaattgatttatacaattgaaaaatggggtacaaatgtttagaaaaatattaaaaaatagctgacatttttaaattagtataacgaccattttcataggaaaaaacatttgaaaaagaaataataacggaggggtgaaatcggaacagcttctaaa

SEQ ID NO: 69774 - DNA, 133 bp, Heterodera glycines
  Genomic contig location: Contig_ID=SeqID_41701; Location=893..1025; Strand=+
  SCN-specific regions: Sequence locations=1-133
atggtccactacaaattgtattattttgatctcactgctcgtggtgagccaatccgatatttgctgcactacgctggccaaccctttgaggacattcgcattaaagccgaagattggcaaacagaaaagccaa

SEQ ID NO: 69775 - DNA, 1104 bp, Heterodera glycines
  Genomic contig location: Contig_ID=SeqID_8948; Location=48..1151; Strand=+
  SCN-specific regions: Sequence locations=1-21,44-379,406-1104
  Gene Ontology: Mol. function=RNA helicase activity; Cellular component=nucleus; Biological process=cell growth
acgatgacagagaagaaattgagaagcaaatggaagaggaggacaaaatcctgcaaagtgtgactcagacgagtgcactcgcaacggtaaaccatcactttaaagccgaaagtttcactgcttttcccctgtcaggtggcggaaatagcgaagggtgtcaaatacacagagtccattaaaacgtcgtggaaaccgccgcgtcacattcggcaccaaactctccaggaccacgagaagttcagacgcttgaaaggcattcaaattgagggagaagactgccctcaggcaattggcagttttttggtccgtgctcaaaaatatatatttgtaagtactaaatttttctaggaaatgaaacttccccgtcccatcattgccataatgaaagaaaagaaaattgtgtgtccgactgtgattcaaatgcagggcattccggtggctctttcgggtcgcgatatgatcggaatcgctagcaccggcagtggcaaaacactgacttttgtgctgcctgtgattatgttcgtaatggagcaggaaattgcgctgcgtttcaaacgcggagaagggccatacggacttatcatcgtgccgtctcgtgaattggcgaagcaaatttacgacgtgatcatgtggatcagtggggctcttccaagtcccgattatcccgagcttcgagtgggcctttgcattggcggctttccgataaaggaccaagcgcgggagtttgaacggtgccgttgtcccaatgagaaaaaaaatatttctcatgagaaattcaaaattaaggggtgttcacattgcggtggcgacgccaggccgtctttcggacatgctcaacaagaaaatattcaatttgcaagtttgtcgttatttggtcctcgacgaagccgaccgaatgttggacatggggtttgaagaggaattgcgctcaattttctcctattttaaggtttgacttctttccttttggttcaattttacaattttttaagggacaacgacaaactttgcttttttcggcgacgatgcccaaaaaaatacaaaactttgcaaagtcgacgcttgtcaaggcggtcgttgtcaatgtcggaagggcgggggcgg

SEQ ID NO: 69776 - DNA, 77 bp, Heterodera glycines
  Genomic contig location: Contig_ID=SeqID_8949; Location=3072..3148; Strand=+
  SCN-specific regions: Sequence locations=1-77
acaagggaacattccgagctgtgagtgggaaaatgcatataagctatataccattggatagagcggggtcgacttgt

SEQ ID NO: 69777 - DNA, 3510 bp, Heterodera glycines
  Genomic contig location: Contig_ID=SeqID_8949; Location=199..3708; Strand=-
  SCN-specific regions: Sequence locations=1-627,649-687,724-782,804 -867,889-2568,2590-3452,3491-3510
  Gene Ontology: Mol. function=cAMP-dependent protein kinase, intrinsic regulator activity; Cellular component=cAMP-dependent protein kinase complex; Biological process=signal transduction
gtttataatgctcaaaagcatcataaaatacccatttacaacagtaagtgttgtcatactcgtaaaaattggagggggggggttgagaagagaatatttaacaactaaattatgcgcaaagattgcatttaaattaccaaaaccaaatcgtttacgaaaagctcaatttcctcaaatttggccaatgatagacaattcgttggcatttcaggtgcaaattggctcaagagtgtacgatgcgcaggagttgcagaagcttatcccccaggtattttccaaaactgtttttattctatttttgcatttctccattcttaaagatggaagaccaactggagaaaaaggaccgacagttgcggcagaaccaaaaagagatggacgcgcagcagaaacggattggcgaacttgaagtggaggtgaaaggtctgtcatcagagtgcgacaaactgcgatcggtgcttaatcagaaggtgggagagaatgatccatttactcgttcaagagttgttttttacggggaggggtgaaacataatgcaccaaccagggaaaattcacaatacaagtcgaccccgctctatccaatggtatatagcttatatgcattttcccactcacagctcggaatgttcccttgttaaccctcttcccttgtcactacccctgggcagaatttttacaattttagctacatggcaaataaattaaataacaaaatgtaattttcaaggcagaaagtgccgccacttcagccagtcaaaagcggtcaggcgaactgcacacagagatgaagcaggttgtgagtgttaagcatttggtagaatttgtatttcgtatctacagaaagccgcgttgctgccggagtttggccaaggtggcactgaagtgcgtgccaaaaaaatcgccgtatccgctgaaccgacaaatttggaccagcacaaagcgacgttacagcaccacaccaaatcagcagggtggggaagggcacactcatcacaaactgatggcaaacgtcacgacatccctttccagatccaagcaactcattcgtgacgctgtccaaaagaatgattttctgcgccaattagccaaggaacaaatcattgaggtacgggcaaggcaatgccaaacgatcggcttaaatttactgatttgtgccagcttgtcgaatgtatgttcgaaatgcgtgcacgggctggtcaatgggtgatccaagagggtgaaccgggcgatcggctgttcgtgatcgccgagggtcaactgcaagtgtcacgagagggccaatcattaggggtacaagagataatcggacggtgagacggagcagtgccccgcaatttttaggtgctaaatccaggggttgcgatgggagagcttgctattctgtacaactgtgctaggtaatcaaacgcattttgtggcaatgccgacggcggcatttctcacattcccactcattgtcaggacggcatcaatccaagcgatcaccgactgtgtgctattctgtctcgaccgttcagtttttcaaatggtctctcatagcaactgatttcgtcattatcctattttttttctcagatcactatgcgattgggaatggagcggcacgcccaattgatgaatttcttgcacaaagtggagatctttgccgcactgccggaggaccgactgtccaaaatggccgatgtgatggaccaggactactacgccgctgaacattacatcatccgagagggcgagaagggcgacactttctttgtgataaatagcggccaagtgcgtatcactcagtccattgaaggcgagttggagccacgtgaggtgcgcattttgaaacaaggcgaattcttcggcgaaaaggctttgcttggtgagttgaatcaattaaaatggctttatctaccagattaaatgttatgacgattgcttttctcaggtgaggaagtacgcactgcaaatgtaattgccatggcccccggcgtcgaggttctgacgctggacagggaaagctttctgaagttgatcggcgaccttgaaccgctgctgaaacaacagcgcacgtaccgcgaggaggacataaaacggcgcagcgcacgcactgagaaggactcttcccgcgtttccccgacaaaaacagagattcccgcgttggaagacgaattctcacagattctactgcggcatctgaagcgcatcgccactttgggcgtcggaggatttgggagggtcgaattggtgagaaggaacaaaattaaatggttgaggaccatttctcaaaaaggtatgtatcatcggcgacaagggtcggactttcgccattgaaagcattgaagaagaagcacattatcgacacaaggcaacaggtggttccattcatttgcaaagttattgtaacgttcatttaaactacgcttttttttacagcgtcgaagttttttaggcattttaatgacagttctctcgtttaaggagcacattttcgcagagcgtaacatcatgatggagacccggacagattggattgtgcgtctctacaaaacttttagggactctaaatatggtaatttgagtgaattcaatttaaaaattgaatcatcttttacagtttacatgctactggaagcgtgtctgggcggtgagctgtggacaacgctgcgcgatcggggtcactttgacgactacacggcccgtttctacgtcgcttgcgttttggagggattagagcatttgcacaggcggaacattgtttaccgggacttgaagccggaaaactgtttgctaaccacaagcggctacttgaagctggtcgactttggctttgctaaaaagctagcctcgggtcgcaagacatggactttctgcgggacgccggagtacgtgtcgccagagatcatcctcaacaagggccacgaccaagcagcggactactgggcactcggcatttacatctgcgagttgatgctgggcagaccgccgttccaagcatcggacccaatgaaaacatacactttgattctgaaggtaagtcacattcgaaattttttgactaaattggctattctgagcagggcattgatgctttggagatacccaatcgacgcattggtaaaacagcaacggcattggtgaagaagctgtgccgtgacaaccccggagaacgactcggctcgggttcgggaggtgttaatgacattaggaaacacaggtgaacggtgtagtcacgttgttctgaacaacaatgataaatgatcgttcagatggttcatgggtttcgattgggatggacttcggtcgagaacattaaaacctcccattatcccagtgagtctatcacatttatcacttattaatagagagccgttctttctttcagaaagtaagcaatcctgctgacgtgtccaactttgacaattacccacccgatcaagacattccgcctgacgaatttaggtgaaatttttttttaagtaattttctaaattaaaattttagcggctgggatgacggtttt

SEQ ID NO: 69778 - DNA, 348 bp, Heterodera glycines
  Genomic contig location: Contig_ID=SeqID_41703; Location=548..895; Strand=-
  SCN-specific regions: Sequence locations=1-89,111-138,160-160,182-348
attatgagccacccaatttggcaaatcggtctttttaaacgcattaaagaagattcagtcgattgcttggagtgtaagcaaaaaaacgttattaatttttcatcttcatcattttttggtttcaaaatatatttgaatacttttttatactttgaaagacttttttattaatacagaattttttgaaatttcctaaaatccgcaatcctgcgcaggatcctgcagattttacatgcaggattgcaggatttgcaggattaatcctgccggatcctgtcctgtaaaaaattttgaattccaatcctgcaacaggatccgcaaatttgaaatttccggtctctaattcta

SEQ ID NO: 69779 - DNA, 238 bp, Heterodera glycines
  Genomic contig location: Contig_ID=SeqID_41706; Location=704..941; Strand=-
  SCN-specific regions: Sequence locations=1-123,147-155,178-238
cgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttggacatttcgtgggtttttactcttttggacatttcgtggcttggacactttgtgggggtgcca

SEQ ID NO: 69780 - DNA, 429 bp, Heterodera glycines
  Genomic contig location: Contig_ID=SeqID_41709; Location=492..920; Strand=+
  SCN-specific regions: Sequence locations=1-59,81-429
atgagttgtgccaatgtgatcaatcccgtgccgaccgttgtccgcccggaaagcccgggaaaagggggaaacggggcaaagacggaaagccgggtgagtgggcgaactgtgatgagattgtctatgctttttcccaggctctcccggacttagcggtgcccccggactccccggcaatcacccgcccgtccctttggacttcgaactccaatgccgcatttgtccgctgggcgaacccggtgaataatgtttctgaggtccaaccaatttggtgaacactttcaggcgagcggggaagagccggcgaaccgggcgaagatggaaggccgggtaaaagcaaaactacggaaaacagcggaaaaaaacacttttttaggggaaaatggcacaacgggcaaaacaggaaaagtaatggaggaaaaaggataa

SEQ ID NO: 69781 - DNA, 810 bp, Heterodera glycines
  Genomic contig location: Contig_ID=SeqID_41711; Location=113..922; Strand=-
  SCN-specific regions: Sequence locations=1-497,519-650,677-759,802-810
aaaaaatcgatttttcaagtgtcgttggggtactcaacattatggggagcaaaatccaccgcagaataaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 69782 - DNA, 2145 bp, Heterodera glycines
  Genomic contig location: Contig_ID=SeqID_8951; Location=988..3132; Strand=+
  SCN-specific regions: Sequence locations=1-72,94-146,168-543,565 -584,606-1018,1047-1049,1098-1107,1129-1515,1537-2005,2027-2145
attcacaagcaacagaaatggctgatcagcccatcagcggcaacagcagatggtgtccgaccattgggcactgctgaaccaagtgccaatcttcaacaatgcctgcaacagtgttgtgccaggccgggtagcactttttaaaatttcaaaaatcaaaattaaaccccattaaagatgacaggaaacggattttctaggaaattttctccgcctaattttcaattttagaacgagttataatcacctaaaaaaacctattttatgaagaactgtaaacacaaatttagggtcaaattcgaattgaaaattgataaatcatttcaaaaaacaatgcaaaatttttcgcaaattaatactaattaacgctaattatacttattcgtgtatatatttttttgattacccaatttacacaaaatccccgatattttttttcaaatttctccaaccatccccgacaaattttggtgggaatttcctccccgatccccgacttttttctccccgagaatcggagcttaaccttcaaattaaaacaatcagaaaattaattttcacaaggggtggtggtggtcgactgtccatccacaaattttcccaaaaatgcccatttattaaggtcattagggggtgctcatcctctctctaatcccatttcgcgaccaccgatggcgcaaaactaacaaatccaattttgagagtgccccgcggggggtaaattttcaactttttgcctccccccccccacgaaatttggcgttttgacgcaccggaaaacgattcgccacgccttttaaaaagtttttccgccaaatttgtccctcgtcggcgcgcactcttttcgcgcacatcaatggatgggatgggatgacctttgtttcttcattttccattgtgttgttgtttgggcaaccacaaattgcggcggggcgcttaatgtaacaaaaatgggttgggaaaaggacaaaaatggacaaaatggagaaaaggaaattgggggggggggggaaagattgcgtaaattaaattaaattaaatttaaattatgcaaataaattaattaatttaaattataaaaaataaattttaatttaaaacttatgatgcaaattgaaaagattatggaaaaattcgcaattgcaaaggttctttcaaaatccgtaagtcgcctttaatccgcgcaattttgggcataaaatgccgtatttccgtccctttttagaatttacgtaaaagtactgatcactgatcattctcagatgtttacaatttgtctttaactgatctgatcctatcattatttttgaactggaatctgatcatttctttgccattagattgttctgcaattagcttttccggctttttaccattgtcctctgactctggcaacagcagcaccaatggcgatgatgacacttcatcctcggcaagcagttcagcagcaaattgtgccctttttgagtgccctgccggtgccaacagtgaatgtgctctgacggatgccactgatgcggctgatcaggagggattgctcagtgtacggcttagacggaaggacacgcaaccaccggtaagaacagcaaatgatcaaagagctgaattggattgaccaaaaaactgatcagatcgatctaggaatttgtcgtactgatcagggtacactactgtactctgatcagtctgtgatcagttgagatcagccatgctaagctctttcagtcagtgaccaattatgttaagtcaaataagccaagataaacactgatcagttgggatttgcttgtgatactcctgatcagctgctttgagcattttaactcagcactaattaggtatgataagctcggattagctatgatcaagctttgattacttgagatgggctctaatcaacattaacatttctgatcagttgatataggctctgatcaccctgaactgttacctttttagccaacatcatcaccaacaagcaacaacaacacttcatctgctgaacagcaggatgacgaagaagatgatggacaaagtgccgaaaatggtggtgatcaacggcacatcctttcgttaggcaatgatggcacgtcgacggaagacggcaccggcggcgggacaaccgcggaacagcaacatcagcagcag

SEQ ID NO: 69783 - DNA, 377 bp, Heterodera glycines
  Genomic contig location: Contig_ID=SeqID_41712; Location=291..667; Strand=+
  SCN-specific regions: Sequence locations=1-377
atggaaatggaggggcaatggcaaagggaggagaaacgaaaaaggggcagagaatgggacggagagcgacagacagacgacggattgggaagagacggagagacggcgagtgcgcattcagttggacggcacgacgcacagcacagtcggcatttaggaccataaaagctaattgaggcaattctacccaaaacttccattttcagattcttgacgaagaattgggactgaaactgtccatgttgggactgaacggggcaaagtcggccggcgctcagttggacccgggggtttattttgtggagaatcattcggacggatcgctgggcgaaattacgggacaaattgcagtcaaccgaatcacagaacacgagtaa

SEQ ID NO: 69784 - DNA, 49 bp, Heterodera glycines; identical to SEQ ID NO: 51181
  Genomic contig location: Contig_ID=SeqID_41715; Location=598..646; Strand=-
  SCN-specific regions: Sequence locations=1-49

SEQ ID NO: 69785 - DNA, 525 bp, Heterodera glycines
  Genomic contig location: Contig_ID=SeqID_41718; Location=822..1346; Strand=-
  SCN-specific regions: Sequence locations=1-66,175-233,260-267,290 -346,368-525
  Gene Ontology: Mol. function=structural constituent of epidermis; Cellular component=intermediate filament; Biological process =epidermal differentiation
atgctgctatcaacagacgtgctgtgttagcacggtgacaacgtgtagaacatgtgcagtttcgtacggcggtggaggctacggtggcggaggatacggtggcggaggctacggaggtggaggatacggtggcggcggatacggcggtggaggatacggtggcgggtgtggtggatacggaaaaaagtgacttcatttatcagctgatggattgtcttctcatcacattcaaattgcttttaaaaaagatttatttaagaagagatatttttactgaattcttcggaattggaagcaaaaaaaagaaaaatggtaaacgttttaagggtacaccccaaaaaagagtggaaattttggaattttgggcaaaagaaatcaaaggggaaagacgaaataggaaaatttaaaacaatttcaaaaatttagcttctttggctcatctctttgccttttttggcatttggctgagatgaaaatgaataattttattctacgggtccggcggtgcgaaaatatagaaataaa

SEQ ID NO: 69786 - DNA, 374 bp, Heterodera glycines
  Genomic contig location: Contig_ID=SeqID_1199; Location=735..1108; Strand=+
  SCN-specific regions: Sequence locations=1-44,66-374
atggatccgcaattgctcatccgagaggccaccttcaacaaaatcgcacagaaacaagcggcggccaaatatttggcgaccaaaaagcgtcgggagaaggacgagcagagaatgcgcgagttcgtccgccgggcggtgacgccgcccgactttggccaaatggacgccgacgcaatggtcaaactgtcggattttatgcctgtactgaatttggaattctttttgagtgccatttccgaatgcttttttcatttgtttaggccgtgccggcccaatttgaccgctcttttcgctacgaaacgctcactgttccggtcaaaattgcctcggacggagtgtattcatcggacgacattctcatcatcggtgctcag

SEQ ID NO: 69787 - DNA, 1798 bp, Heterodera glycines
  Genomic contig location: Contig_ID=SeqID_1200; Location=1344..3141; Strand=+
  SCN-specific regions: Sequence locations=1-27,49-207,246-877,900 -1231,1253-1382,1408-1575,1602-1621,1643-1798
atggcccacaaaaactgtgtccaatccgccttctcccaccgctgctggcctccgccgctcggcgagaaaatggtgccggcaccggcggctgcggtcagcgtgacggcatcggccgagtcgacgatgaccagcagaaaggcaccacgcccaccgttgacggacagtcggtagatggacagttggatgtcgctgaaacaattggaggcgttgctgcaaatgaaaaaatcttagaatatttcaaaatttcttcttgcgtttttctcatggattttgttgtttgtttttttttgcaaatgattcaacgcttaaaaactgtggtgttctgctttgatagcgtttattcaaatttatttcagccaattttttcatttttgccttgttatttttcttactatcatttgcaacaaaattcagacagaacattttttgtttctaattctatttaattttgatgccaatctacatatttcattattttagacgctttttattgctattatttgttccaattttaatatgaatttcccatcaagaactcgaactcagttggtaagctcttataacgcactctgttattcttaatccaacgttgtcgttaatttgttttaaataaaaatgggaagtaaaataggttaaaatttttatgcagttagcgatggcattcccatcttaactcggcgaaccgccccatctctccagtgaatttgccgttgtccaccctttctcatgggcgttggaattggcatttgtttctgttcccctttttccaacatttccattttccaatgaatccaaaaagaattcccattgaattggtagctgaaactgttgggtttttgaggttgaatcggagatggggtcagtgccgagtttcagcttcatttgatcatttccttctcaaaaaaattggcaaatggttgaagaaatcaaaatctttggttaaaaaattacaatttcttatttaaatgatctgatttcaaggtcacggactgcatcgattactcgaacgaaatcgaaggaattattcgtgctgttcccctaatatggcaacgatttgaagaagcatccaaattctttagaggtctgttttacaaagctcttgcctcatttcgatttgttcacatttcccaattttttcattttagtgatcaacaaatttgtcggctatttcccaccacttcgcgattcatttcctacgccaggcaacgaaacagtaaacattagaaaacactaaattaattaattaaaaattgcttttctttttagttggacgaaattctgcgctgtgctggtgtcggagtcagattgttagttgaggcagagagtgtttcggactattccctctcaaacttacgtggcggtgagtttgacgagattgattctactttatttaaaatacatttaactcgggttgtttggccggattgcagatggtcacgggatttcagcatttactaacgccaatttttgagtttttttgggaacagggaacaaaacgggaaggggtcgacagatccaccgggaaaacaaatttgaaattttttactatttttaacagatttcgccagaaattgtaaatttagaaaaattttggaaaatttcagtaagtgagatattggagggggtggggtaccaatggggaaaaaccatattgctaaattttcggtacaccttaaacttttagcttaatgttaacactttttgttattccagccctgttcgccatttattattcggccgtgtactacatgccaacgactgatgactgattttgctgatggacttattcgtgacgaaa

SEQ ID NO: 69788 - DNA, 112 bp, Heterodera glycines
  Genomic contig location: Contig_ID=SeqID_1200; Location=434..545; Strand=-
  SCN-specific regions: Sequence locations=1-112
ataaaagtcaacgtagaagcctcaaaccaagtggaaaatgcgttatttatgcttaatatatcgaaagtagtgcgcagaaaaaaaaggcatttgcctcaaaatgcggtctcta

SEQ ID NO: 69789 - DNA, 1472 bp, Heterodera glycines
  Genomic contig location: Contig_ID=SeqID_1200; Location=4561..6032; Strand=+
  SCN-specific regions: Sequence locations=1-141,163-336,364-547,570 -574,596-1237,1259-1390,1413-1472
atgctgaagcagcatgttgaggacgtcgtgaaggcggagcagtacgcggcttggcacgtcaacaagtaaatgaagcgttgagaaattggcacaatatgaaacactttcagggtaaagttcgagctgaagcgcaaaatggcactgaaggaggaaatccataagatggttggcatgcttcatcaggtgaagcacagcgtaagaatggggagaattggcaccgtttgcttcagaattcactcgaccgcgacattgagaaggccgaaaagtcattcggcaacttttactccgacttggccaatgcgccgtggctgccggagaagcgagagattcagagggagttcaagaagtacgacgacgagttggcgaagttccgtgaacagatcgccgagtacatcaacgccatttctaagatcaaatcggaaggtacgcaatggcattttattgtttaacggacaccaaaattcagcggaattgcatgccaagttgccgttcaaaacattcgtttatacgctcgccaattattcaaagcaatcgggaaaagtttgtcagctgttgaaaaaggaacagaagaaggcaaaacaggtgaaagtcatggattcaaagatgtaatttggaatttttacaatatttagcttcgggaaaagctgtcgtagatgagcgacgaggaaattcgcaattcggggttaacttttgatttgggatcggttcaaattattacgtctttaggaacaggacacggccatagtggaggccgcaattgaatctcatggacaacgcatggagcaagaaagtcggaacgaaaccatcggagagcagcgccgcgaggatgacaagcgaaacgaagcgaacgcaattcagcagccgcaacagttcgacatggacactcaaaatgacattgtcgtggtgggacagcaaaagctgcagcgtattgtggaggtggaggagaacagcccaagtgacgccgaacagatgccgcagcaactgctcatggacagagagagtcagcaacacgtttttgccacgccgctccctcccgtttctgcgccgcgcggctgcgacgacggcgaccagcaggcgctgttcgacttcttcgggggcgaaggcggcgccgatcagagcgccacggaaggctctttcaacttcggctcgttcatgaccactctggcagggcccggcgcgaagaaggggcctcagaagccgcaggcggacggcccgggggacagtcagagcgatttcaatttcaatgctttcttgggcaagccggacgagttcagcaaggaagtgactgaaggaggcgctcttttcgatttcaacttttgagtttttcctttcatttggttttggttgtgctgtagctgttatttttattttaatctgcttatcattatattttggccatttttgctttgtttagcattgttttgttctggtcagttcatttgtgtaagtaactgtgtttctgtttatttcca

SEQ ID NO: 69790 - DNA, 504 bp, Heterodera glycines
  Genomic contig location: Contig_ID=SeqID_8952; Location=1334..1837; Strand=-
  SCN-specific regions: Sequence locations=1-100,230-402,437-504
ggcatttgcggacaacacggatgagattgtgttcgagaattactgcttcaacgctttcctccgaacgtccggtgaggaaaatttgtgctttttcattgcctataaaaaaatacaaaaataatttttcagcaaaaaatcttaaaattttacataagatctttttaaaaaaatattatttttaaaaagaaaaaaaaatcttttgaaaaaattgatataatttcaaaaaaatgtgtgagaatttcttcatttttgaaattttttttgtagttttttggtccatttaactctaaaaaatgcaatttttagcgtccgcctgcaccgcccaggcgcactgctcggcccacaatccgtgctgtgttgtcgtcgactcggggtcggtttctcattggtctcatccgttggaaatttacaaaattttatttatttttaccctttttacaggcactcgttcactcacattgtgccatttgttgggggacaaattgtgcgcgagggcattgtccg

SEQ ID NO: 69791 - DNA, 556 bp, Heterodera glycines
  Genomic contig location: Contig_ID=SeqID_8952; Location=1324..1879; Strand=+
  SCN-specific regions: Sequence locations=1-78,113-285,415-556
atggatttaccggacaatgccctcgcgcacaatttgtcccccaacaaatggcacaatgtgagtgaacgagtgcctgtaaaaagggtaaaaataaataaaattttgtaaatttccaacggatgagaccaatgagaaaccgaccccgagtcgacgacaacacagcacggattgtgggccgagcagtgcgcctgggcggtgcaggcggacgctaaaaattgcattttttagagttaaatggaccaaaaaactacaaaaaaaatttcaaaaatgaagaaattctcacacatttttttgaaattatatcaattttttcaaaagatttttttttctttttaaaaataatatttttttaaaaagatcttatgtaaaattttaagattttttgctgaaaaattatttttgtatttttttataggcaatgaaaaagcacaaattttcctcaccggacgttcggaggaaagcgttgaagcagtaattctcgaacacaatctcatccgtgttgtccgcaaatgccctaaaaattggacatcaatttttaattattattcccatcaca

SEQ ID NO: 69792 - DNA, 93 bp, Heterodera glycines
  Genomic contig location: Contig_ID=SeqID_41723; Location=13..105; Strand=-
  SCN-specific regions: Sequence locations=1-93
atgtttgcagttgtactcggggtcaatcaagccacgcgggtacatttccgaacacgtccggcacagggaaaacagcgtgcggttgttgagccg

SEQ ID NO: 69793 - DNA, 471 bp, Heterodera glycines
  Genomic contig location: Contig_ID=SeqID_41724; Location=516..986; Strand=+
  SCN-specific regions: Sequence locations=1-305,336-440,462-471
atggtgaacatcggcggaattggcatggacaaattggacaaaaatgccaaattggaggtattctgacaaatgagcagcccaccgaaagagtgcttttgtgataaagcaacattttgagttgttttccagcggtgtttttcggcacattctgggatgtcttcgctaggatttttcaacattaattctaaaaccctaaaaagtgacgatttttgcataaattatccaattttctgtggcaccgctcctccattctttcttaagaatgtacagttttacaaatgagctctaattaatttttaggagccatttaaaagtgaaatgagcaaaggaaaggaaggcgttgttttcgtttcaatgggcaccatcattcgctcatcggaccttccggccaaatttcggcagaaccttctcgaaacttttgcaaaattctccgattatcacttcataatgaggatagaaaagggggacaat

SEQ ID NO: 69794 - DNA, 1072 bp, Heterodera glycines
  Genomic contig location: Contig_ID=SeqID_41729; Location=295..1366; Strand=-
  SCN-specific regions: Sequence locations=1-223,252-318,342-597,619 -796,818-820,842-878,900-1072
atggtccaaaccattcaggcgatgaattcgttcgcgttcagtgtcgacccgttggacgacgacgagcaggcggccatggcacaagcgttccaaacggacattcaggacgtaagttttcagcagcattaatgattggcaacaaaatgtgccaaaacagactcagggcattgaaaacccgttgaaaatggcattttccgacctctcattgtccattattgccaattatttccagaaaagtttaaggaatgccaatttttaaggtcaagagcaggctcttgacagtgatcagaccaaactgatcatggaccaatcggcaaaaatgcccctttctttctgtttgaagttccgattgaattcctaaacaatcctatacttatattccgagaaactaaagtattttgcggcacctattggtcagttatgctcaagattgagaatgccgagagaccaagagtttccatagaaatttaattttcttaacaaactccaaaaatccgagaccgttcccaatttgaattctcgactatcatttgatgatcctgttaacaattttcttattggcacaccttctctgatgccttccaacatgttcaggcggtcgaacggatgaactcggatgccggcatggcagccatggcggtggccatgttcgaagcccagcaacggggtcaacatgacgagctatttttgggcgccagtgccagtggcggaggccaaccgcaacaacagcaagcagttcatggcactgctgctggtggtgctgatcgacacgacataaccaccaccagcacaactgcacagcgccaacagcaacaaaattcagagcaagaggaggaggaaatacgccgtcggcgtcagcaaatggtgtccatcggaaaaccgggcgccgccgcgaggcgcaaaaaggacatggtgatacagacagacagacaatagggcaatgccggacaattgggcaacagacaatttgacacaaaattttcttccgtccgaactatgatcaattcagggaccagcaaaacttttgtgccaaaaaactatgagtcatccggccaaaatccaatctaataaa

SEQ ID NO: 69795 - DNA, 285 bp, Heterodera glycines
  Genomic contig location: Contig_ID=SeqID_8955; Location=22..306; Strand=+
  SCN-specific regions: Sequence locations=1-285
  Gene Ontology: Mol. function=pre-mRNA splicing factor activity; Cellular component=snRNP U5; Biological process=mRNA splicing
atgcttctttccgaccgctttttgggctactttatggttccgtcggcgggtgtttggaattacaatttcatgggtatgtgtcacttttattccaatgatttggtcaaatggttaattgtttttccaggtgttcgacatgatgcaaatatgcagtatgatgtttgtttatcggctccaaaggagttttaccatgaggatcatcgcccacttcatttccacaatttcaatgtgttcgaagatccactcggtgtatccacagccgacagagaggatatatttgagtga

SEQ ID NO: 69796 - DNA, 315 bp, Heterodera glycines
  Genomic contig location: Contig_ID=SeqID_8955; Location=578..892; Strand=+
  SCN-specific regions: Sequence locations=1-226,249-315
atgcagccgcagtcaaagcgaaagattcaggtgttttctcctctattttgctttagtatgtgcattttttgcgtttcgtttgtttttaggtttcttttctgatcagaaatgggtcggtcgagtcgaagcatcgcggcttcgtcaacgccctccaatttgacccgacgacgcgcagtctcttttcggccggttcagattcggtcattcgccagtgggacacttcggcgccgtcgggcagcgccgcctttctccgctcattggagcaccactgtgactgggtgaacgacatcgttttgtgcagtgatggcactcgac

SEQ ID NO: 69797 - DNA, 106 bp, Heterodera glycines
  Genomic contig location: Contig_ID=SeqID_8955; Location=1027..1132; Strand=+
  SCN-specific regions: Sequence locations=1-106
gtgatctccgcctcttccgacaccatcgtcaaagtgtggcacacgcgcagaaatggcgcgtgtttgtccaccctcaaaacacacaaagtatgccttgccaaccaat

SEQ ID NO: 69798 - DNA, 1929 bp, Heterodera glycines
  misc_feature (38)..(38): n is a, c, g, or t
  Genomic contig location: Contig_ID=SeqID_8956; Location=1..1929; Strand=+
  SCN-specific regions: Sequence locations=1-795,817-887,924-1049,1073 -1929
aaacattagggcaatttcggtgaacagagacggcactntggtaagtgccgtcgaatggctgtttccatcccttttgtttgtggtcagtgtctgtccggcagcagcgatggcactgtcaaattgtggagcatcggccagcagcggtgcattggcaccattcgttgccattcggacagcgtttgggcactgcaaacggactctgtttttgccaccgttttttcgggcggacgcgaccatcgcgtgtttcgaactccgctgcgcaacctcaacgactcggaattgctgttcaccgaagggaaacccgtgcagaaattactgatggtcgacactgaccaacccaaacatttgtggacagcgacttgggactcgtccatcagacggtggccaatcgacggcaaagagacggaacggacggaggaggggccgcgggtcagagaggcggacatgacactgcaaggcgagaaaggggcggccgggaactgtcccatgggggggggggacaataaaaggaagaattttgaaaaaaaggactttttgctaccgtaatgcgcttcattggacgaacaaagtttagtaattaaagcaaatgattagtgatttgcaaagcacaaaagattcaattatttcaaatcttgcatttggtcaagttttattctttaggtgctccaagcatccgaaaatacgctgtactgaacgacaaacggcaaattgtgacgcgggacagtgatgggaacgtcgaactgtgggatgtaatgcaatgcggcagggtgaacaccttcccgatgggcaccaacatggaggaagtgatcaaggacaatgtgcggaaggtgtggatcccgagttggttcggcgtggatgccaagtgcggggtatttgtttttacggcgtattatgcctccatgcccattattcctcttctgcttgtgtgatgttcccttctgtgttcaaggtgttggaaatcactttggacgagagcgacgcgttctccgcttgggtctccgcccgtgacgcgggtttcaccgacaaagccaacgatgccaaaggtcctctttctgtggtccctttgcctttgaaccctttgcattcttcggcagttaattacggcggtctccttttgcgcagtcttttcgagcattggccccacgcgtacgttggcgacgacgaggactcgcccctgcagggcttttactcgttgccgctgcacacgcccattctcatccggtgagagtgtaacgattggcacagttatttgcataattacaccaacacaacgtttcatcagtcaatgcaacgacgacattgcgaggccgctgttccgcaccaccgtccatgacacggcctcccaagcggactcagccatgctgcgcgatgtgctgccttcgtgggtgttgcaggtccaaaataccaacaaaaagtgaaccgaaaagacagttgattaaggtcgtggagctcaaccattttccaaagttcaacaaaattcctttttacctgcagccgcactgttctttcattccaaagttccccgttaaaaagtccgtttatttcgtttccatcttttttggcgttaacataacatgacaattccacgtttccacagagaccgactgagtgccaccgaaatgttgcagttgcgaaaagtgatggagcacgtgtgggagaaaatcctttacccggcggagacggcgaccgacgactgcggtggaggcgcaagcgcagcgcattcgctggcaacacaattgcaggaaaacattgaagaacgtattgagttgttctgcaacgaacaggtggacttcccatgtacaaattgatgggattgtaaatgctttcgtcgcttttcagaagttggactcggagatggacctcaggacggtcaaacatttgatttagaagcagggcggcgatttgcttattttttaccgtcccgagaag

SEQ ID NO: 69799 - DNA, 621 bp, Heterodera glycines
  Genomic contig location: Contig_ID=SeqID_41732; Location=1..621; Strand=-
  SCN-specific regions: Sequence locations=1-264,286-541,563-621
  Gene Ontology: Mol. function=single-stranded RNA binding; Cellular component=transcription factor TFIID complex; Biological process =regulation of protein activity, epigenetic
ggggaatggcaggagaacaggaggaggggttaaatggagtccaagggaaatggcacgggagcggaggagggttaaatggaggacaaccaatggggaatggcacgggagcagaggagggttaaatggtggacaaccaatggggaatggcacgggaacagaggagggttaaatgggggacaaccaatggggaatggcacgggagcagaggagggttaaatgggggacaaccaatggggaatggcacgggaacagaggagggttaaatgggggacaaggggaatggcacgggagcagaggagggttaaatgggggacaaccaatggggaatggcacgggagcagaggagggttaaatgggggacaaccaatggggaatggcacgggagcagaggagggttaaatgggggacaaccaatggggaatggcacgggaacagaggagggttaaatgggggacaaccaatggggaatggcacgggagcagaggagggttaaatgggggacaaccaatggggaatggcacgggaacagaggagggttaaaaaggggacaaggggaatggcacgggagcagaggagggttaaatgggggacaaccaatggggaatggcacgggaacagagg

SEQ ID NO: 69800 - DNA, 602 bp, Heterodera glycines
  Genomic contig location: Contig_ID=SeqID_41734; Location=73..674; Strand=+
  SCN-specific regions: Sequence locations=1-432,456-602
atgggactcaacccaacagcatttcaatcactgggactcaacccaccaacatttcaatcactggtactcaacccaccaacatttcaatcactgggactcaactcaccaacatttcaatcactgggactcaacccaacagcatttcaatcactgggactcaacccaacagcatttcaatcactggtactcaacccaccaacatttcaatcactgggactcaacccaccagcatttcaatcactgggactcaacccaccaacatttcaatcactgggactcaacccaccagcatttcaatcactgggactcaacccaccaacatttcaatcactgggactcaacccaccagcatttcaatcactggaactcaacccaccaacatttcaatcactgggactcaacccaccaacatttcaatcactggtactcaacccaccagcattccaatcactggcactcaattctccagcatttcaatcactgggactcaacccaccagcatttcaatcactgggactcaacccaacagcatttccaatcactgggactcaacccaccagcattccaaatcactgggactcaacccaacatcatttcaatca

SEQ ID NO: 69801 - DNA, 1285 bp, Heterodera glycines
  Genomic contig location: Contig_ID=SeqID_41735; Location=101..1385; Strand=+
  SCN-specific regions: Sequence locations=1-108,130-142,164-193,218 -393,426-439,558-659,682-682,773-827,886-956,979-979,1070-1124,1157 -1170
ggcggtaatgactacgaaattttcgagcactccgatacggtgggccatactgtaacaagcccggacaattgtcgtacggtagtggagaaaacgttggccgagttgggcctgtgagaatcagtgatgttttatggaatcgtgatattattttgtgtttattattttgaaatttattctcctattttttttcttcggttttattaatttatttttgtaattcaatttcctttatcaaagtgttaattacatattaaaatttcaaaaccaaattcatttgaaagtatcagcattgacagaatgcaaaaaaagagataatattgggcagtagtaaataaaaaacattgcagaggcagtgcccgccgaaaaaatagacaaaattttttgaaaaaagccaaaaaaaattgaaaatttaaataaatttataagtgaaaaaagtaaaaaagcttccaacaccttcgattcccaggacgtctccgttccaagtacaaagaaggcccaacgttgcttaacttgccagatcggacgggatggcgtactttcaacgtggtatggtcgtaagcgaaaggacagcaattaaagtcatttaaataggcatttttaaaagagcctattttttgccttttctcaagagaatttattaaaaacggcaaaattcgccttaaattaataaggtgaaagtttgaaaatatttattaaaaaatttcaggatgaaatacaattaaaataatcaaaaagaaaaaaaataaatttatttttctaaataaataaaaaacattgtcagaggcagtgcctgccgaaaaattagacaaaattttttgaaaaaagccaaaaaaattgaaaatttaaataaatttaaaagtgaaaaaaattaaagtaatttaaataggcatattttaaaaaagcctatttttttgccttttcacaagagaatttattaaaaacggcaaaattcgccttaaattaataaggtgaaagtttgaaaatatttattaaaaaatttcaggatgaaatacaattaaaataatcaaaaagaaaaaaaataaatttttttttctaaataaataaaaaacattgtcagaggcagtgcctgccgaaaaaatagacaaaattttttgaaaaaagccaaaaaaaattgaaaatttaaataaatttataagtgaaaaaagtaaaaaagcttacaacaccttcgattcccaggacgtctccgttccaagtactaagaaggcccaacgttgcttaacttgccagatcggacgggatggcgtgctttcaacgtggtatggtc

SEQ ID NO: 69802 - DNA, 107 bp, Heterodera glycines
  Genomic contig location: Contig_ID=SeqID_41736; Location=1..107; Strand=+
  SCN-specific regions: Sequence locations=1-107
tataaaatttctcaaaaaaagagatagccatttttctgggataaagtctaaatataaaaattccctcaaaaataaaaggtctattgcgcaccgccctccctatcatg

SEQ ID NO: 69803 - DNA, 304 bp, Heterodera glycines
  Genomic contig location: Contig_ID=SeqID_41736; Location=184..487; Strand=+
  SCN-specific regions: Sequence locations=1-304
aaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 69804 - DNA, 255 bp, Heterodera glycines
  Genomic contig location: Contig_ID=SeqID_41736; Location=691..945; Strand=+
  SCN-specific regions: Sequence locations=1-120,142-255
aaaattccctcaaaaataaaaggtctattgcgcaccgccctccctatcatgctcgagagcatttgtatgtgtataaaatttatcaaaaaaagagatagccatttttctgggataacctcttaatataaaaatcctctgtgaaataaaatgccgattgtgcacagcccctccgtctcatacgcaagcgcttttgtgagggataaaatttctcaaaaaaaaaatagccatttttctgggataaaagataaatttaaa

SEQ ID NO: 69805 - DNA, 434 bp, Heterodera glycines
  Genomic contig location: Contig_ID=SeqID_41738; Location=496..929; Strand=-
  SCN-specific regions: Sequence locations=1-279,302-389,411-434
atgtccaatgaggcggaaaaggagttcacatcagcgggtaatccgaaggcacctgctcttcatgtaacacttgattggattcaccgatcgtggcaggaaatctccaaagaagtgatcatcaaagcatttaagggtcagttaaaaaattaatacaggaaaaatgcctaaacttttaagtctgtgggctgactacgccattggacggaactgaagacgaaaaaattgcttgcttcaaaccggaaggagcaattggaccgatagagattttgcgcgagtttagaggaaatgaaacaatgaaagatggacggaatgatcaggaggaaggccggcctatctgatgatgatgtagagctggatggagtgggagatgaggatgaattgctcatttgttagcatttttactgttttttgaaaaaaaaattcgaaaaattaaa

SEQ ID NO: 69806 - DNA, 225 bp, Heterodera glycines
  Genomic contig location: Contig_ID=SeqID_8957; Location=969..1193; Strand=-
  SCN-specific regions: Sequence locations=1-127,168-225
atgcgaaatgcgaaacgccaaaaaatgcaaataatgcgaaaggcgaaatgcgaaaagcgaaacctcggcccatccctggtgagcataaatcaggtcaagaagactgctcattaccatcaagaaaaagaaaatatattaataaatatttttgttcataaattttttatctattatcataacaatagtaatatccaaataaaaattatagtaatcaatctgaataaa

SEQ ID NO: 69807 - DNA, 574 bp, Heterodera glycines
  Genomic contig location: Contig_ID=SeqID_8957; Location=1279..1852; Strand=-
  SCN-specific regions: Sequence locations=1-18,42-395,417-424,449-574
atgacaaattctacccattttgtggttaaaatttcaaaaattaaggtaaaatgaaggtccggcggtgccgataagcgccgccggaaatttttttggaaattgtaataaaatatggtaggaaaagttgcaaaattttcaaaaattttctgttttttcaaaaaaataaatcgcaaaaaaggcaaaaaaatgcaccaaaaagttcaagataaaagcttcaaaccaagttaaaaactcgttttcgtgcatattaggctatagcaagttagcaaaaaaggtaattattagagttgcacgggaccgggaattttgacaaaaaccgggaccgggacttaccggtccagaaaagtcaggaccgggacctcgattttcgtccgggactgggaccaaccgggaattttcacaagtgaaattttttgaaaaaaaatttgaaaatttgagtgcactttgttacgaaaaattgcctatattcaaaaatgtacccataaatttttttaattctcgtttgtggggagaaattcgaagaatttttccattatgcaattttgagtgtaatatgttaacagaaaataataaa

SEQ ID NO: 69808 - DNA, 662 bp, Heterodera glycines
  Genomic contig location: Contig_ID=SeqID_8957; Location=3369..4030; Strand=-
  SCN-specific regions: Sequence locations=1-45,88-198,235-324,346-662
atgggggtctgggtgagaaaagagtagggaatggtgaagaaggagaaatttttgaaaaaaaaattaaattatttattttcatttaaagcatttgttcatatgcataagtggtcaagttgctaaaccttctgattttattatttctcgcttgggttcaattccccacttggatagaatattcttcatattttctttaccattattttaattgaaattttaattaaaaaaaatattccaactttttttctttcattttaagcatcctaaaaacccaaaaattaatcaattgttctttttttacaaattctcttaacaaatcgcattaaaaaatacaaaatttttcccggcggcgcctatcggcaccgccggcccctccttgttccccaaaagtcttgagaaaaacgtgccgcgaaaaaagcggtgttgaaagcaaaaaaggtcattgatttacattaatttacatggccggagaccccttcgcaaaattggaaaattggctgctgaccccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaa

SEQ ID NO: 69809 - DNA, 355 bp, Heterodera glycines
  Genomic contig location: Contig_ID=SeqID_41742; Location=175..529; Strand=+
  SCN-specific regions: Sequence locations=1-119,150-355
atgcagcagcagaaacaggacgcacagatggcacggcgggagttggaggtgtacaagcaaatggcacgtcgagagttggaagattcggaacgggtaaaaggagggggaagtaattagtaagtaattaataattaattaatgagcctttgtgaaggaccgcgacgcactgggcaaacagttgcgaactttgaataccgaaatggagtcgttgaaaaatgagctgaaaaaggagcaggaacaaagtcagaggatggaattcgaaatgagaaaagttcgcggagagaacagcacattgagacaacgggtggaggacgaaagagaggaaaaagaagcagagatagcgatggaaaagtaa

SEQ ID NO: 69810 - DNA, 574 bp, Heterodera glycines
  Genomic contig location: Contig_ID=SeqID_41745; Location=421..994; Strand=+
  SCN-specific regions: Sequence locations=1-46,70-70,212-229,251-574
atgaggaggagcattaaaatctgtaaaagtgataacacatacagagaaagaaagagatggacaccactaaagagagagacggagagaaagagagagagagagacagatagacatactgacagagatagaaaaagagcgaacaagagaaagaaaaagagacagacagacaaagagggagaaagaaaaagagagacatacagaaagacagagatggcgaaaattggtagaagggatgagagacgaacagagaggcaccagtgaaaaaagataccatagattttttatttttgtagttattttttctcaaaaatttttggagagagagagagagggtggcggtgctgatagccgacgcaatataaaaagttgacccagaaattggcaattccttataattccttaaaattggctcaaatcgcaaattctggtaatttctttgaataaaacctattaataattcaatttcagcttcaccgagctttcttccacaaaattcttcttgaaaaagagttccgcaaaaaagagatgtgaaaataaaaaagtgaattcttatgtgataccgagtttttattaa

SEQ ID NO: 69811 - DNA, 80 bp, Heterodera glycines; identical to SEQ ID NO: 51817
  Genomic contig location: Contig_ID=SeqID_41747; Location=131..210; Strand=+
  SCN-specific regions: Sequence locations=69-80

SEQ ID NO: 69812 - DNA, 812 bp, Heterodera glycines
  Genomic contig location: Contig_ID=SeqID_8959; Location=1041..1852; Strand=-
  SCN-specific regions: Sequence locations=1-21,43-812
atgcgagcagtgcacacggaatgggtacaggtgagaaaagaacattggggagggggcggggaattggccggcattttaatctagggggcaaaaaaaacacgaaaagccaatccaataattaggggtattgaactgggggttgcggcgtatctcgtactcaccggcggggcggggggtcataggccgtcgtttcgtttcgtttcttttttttgaacggggaatgtaacacctttttattcaaaaaagtcatttaacatctgctagcctcagttaattgctttgtttcggttcattaagttgctaatttagcgtttgtctgctgccgtccctttgaatttgccttccgtcgccgtttctctccctttttgtcgcgttgcgaatgcgcccattcggggcccaatgttcgaattgtcaacgaaaaagtgcccagcaaagcattggacaaaacttcgtccctttttgagtgttgtttccccacatcaaaaaggcgccctttgaaaagtgcgctgaggccaaattaggacgaaggcatttacaaattatgcttctcctccggtgaccaactaattacagaacattgataaaccattgttgatttattcattacaacaattagcaaattgttaaaacccaaggttaaatacaatctcactttataaaaacgaatatttaaaaaaaccatagttaattactttttcatctgatttttttaatccatttgtgtatgtatgttgctctggtcctcattctttgttcaatcttaaaaattatgatcaatcacattttttcaaatttaaaacaactttaataaa

SEQ ID NO: 69813 - DNA, 898 bp, Heterodera glycines
  Genomic contig location: Contig_ID=SeqID_8959; Location=3327..4224; Strand=+
  SCN-specific regions: Sequence locations=1-80,153-184,206-271,348 -441,619-670,692-847
atgttctcctcattaacaaagcttactacttcggatgaggcaattattaacgaatttcttgcgttcgacaatataagtactaattaattttagaaattatttcttatacaaataatatttaaaaaattttttttaattttatcaatttttttgtcaaaaaaatgcaattttactttcttaaccaattttttatcgttgcttttcccgccatttttcatgcttattaggtgtatatttgaaacattttgtttcaaaaaatcctaagcctttgataaaaaattaatttgtttcttaaaaatataaaaattatacaagtgaaaaaattatttaaaaagttattttttattctgaagataatttttaaatgtgcaaatttagggtccacaggtgacaattcttcaggctatgtcaatgacccgcagctgagcacctcaacagttgaaaatatttttgaagtatttttatcaaaattaatataaattaaaatcaatctttttattaaaataattaaaaattaaaaattcactatgcccaaattggtctgataaattttaaaaattttatttaaataacttcttaattaattttttgttatttatattttaaaacaaaaaaaatcagattttttcccatttttagaatgctaatacctcggctgcttctccgatcgtttttgctgaactgcaaaacatatcttttcaatcaaatttaaatttatttcaatcagaacaaattcaggttcatccacaacatttcgagaattgtacccagacggaaacgaatgaagcttcagacatttttgaagtggagatgattctgaagatgagaacaaacaatggattaaaggaatttttagtaaaaaaaattaaaaataatatatatttataaatgtaattaa

SEQ ID NO: 69814 - DNA, 861 bp, Heterodera glycines
  Genomic contig location: Contig_ID=SeqID_41752; Location=99..959; Strand=+
  SCN-specific regions: Sequence locations=1-351,374-410,443-793,815-861
atggacgaggaggcgcgtgagcagaagataaaggaactgatagcgatgacggaggaaacgcatcggaaaagggcggaacggaagcgacaaaggaatgaggaggaagcggaagaacgacggaggctgaacagagtgagggcgaggtgagtgggggaggggcgatggacccggggggggggggggaattggacagccatgccattttttatttttaaacacattaattaaaatccattcgtattcttaataggcgtatccatggcaaactggcatctttcattaccacctaacattgtccaaatgacttgtcagttatttgattacatttttccatcggggagagacggacgaactgaaaaaacaaacaaacgaatcgttaatttcagaatgggactcgaacccattccaagcagtgaggacgaagaagaagaacaaaaaggtgcagcagaagcaacggaggtgtgcctttttttgcacttaatttttcgtggtggggttaatattactataattagtccgctccataaattttaaaatgaacattttttgcccgtcattttcatttttttgttttaattttccttttagttggatgtttccgccattccgttgcctccctcttcgcccgaagcaaaaacgactaaagagcctgagcagaaaaagcaaaggtttggagtgcgggagtgggaccgtggcaaaatcggatgcatgcgatgggcggaggaacagcgggacgaacgcgaggacgaatttgcacctccttcattttattacggcgaagaaaacgacgcaaggggggaagaagaaacgcaaaaactgaagctaaagagaatgaatggaccattcggaaaaataatataa

SEQ ID NO: 69815 - DNA, 915 bp, Heterodera glycines
  Genomic contig location: Contig_ID=SeqID_41753; Location=320..1234; Strand=+
  SCN-specific regions: Sequence locations=1-62,85-846,869-915
atgccatttacgtctttttatattttttgttgtcggtcgtttacttattgtttaggaaagaatttttcaaaagaattatttattctgattgtgtcaccaattaattgtcaaaacggcaaagtgtgttaattgcagcaaaaaatggatcgacggtaaggaagtttttattaagtccagccgatttgggatgttgttatcagtgaaatttggcccatttttgcgacaagcatttgccagttgcgctttgccggaggcgattatttggacaaattgcgtcgccacatttcaccgacactgctcactgatcttgatcaattgaattcaatcgattcatgtggtctgtgccctgatgaaattgctgacgatggaccaaatgcaacttctggccaagcgttgtccaaatggcttcacattccgacaaaaaatggccaaccgaagcgatttcgttgccttgattattattctcaacctggaatgaactggatcaacaatttcatgataataatgtattttatgaagaaaaatcgcaattatatgtgggtatatttaaataaatttggtgtaaccctccaagaattttgatggacactcttccatcttttgatcaaaatgtttattctataaattattaaaaattggattttttaactttcgcctaatttttcaggactttttttgcatttttacgtgctttttgggtttttgcgacttttttcaatttttcgtgacttttttgccttttttatgactttttttgtgactttttggcgattttttatgatttttttagtcgactttttgaagatttttagtgactttaattcccagccctacttattgaatacactaaacttgtttgattaaaaaatttaaatgagtaaagaaaattgtcaaatattctcacgaaaaaatata

SEQ ID NO: 69816 - DNA, 71 bp, Heterodera glycines
  Genomic contig location: Contig_ID=SeqID_41753; Location=816..886; Strand=-
  SCN-specific regions: Sequence locations=1-71
ggttacaccaaatttatttaaatatacccacatataattgcgatttttcttcataaaatacattattatca

SEQ ID NO: 69817 - DNA, 952 bp, Heterodera glycines
  Genomic contig location: Contig_ID=SeqID_41756; Location=141..1092; Strand=-
  SCN-specific regions: Sequence locations=1-193,215-242,264-280,306 -463,485-653,675-917
atgactgatttctaccgtatttcaagggaaaatggtaggaagctgatcattttttatggtagtcaattttgacaccctaaggtacagtaaaggcaaatttttggcaacctgcatttttcctgtacttttgtacagaaaatataggtgcaggccatttgggaaatactggtacaggcttttttcaaaatgtcaatctataaaaaatataaaattagagacattttggtcgaataaattgtaaaaaattacagattttaaaaaatgtcgcaaaattgttaacagatttttcttaaaaaaccaatttttgcgattttgggacaatttttaggaaaaaattaagagttttgagggttggcagtgccgataggtgccgccggaaagttttttcgaattttttattcaattttattaagaaaactgttcaaatctcaaaaatttcaatatttctcttcttcgtggattaattagcttttaaactttttaaattctcggagtcctcaatcccccgaattagtgtcgtggggtcgggtgcaaaaaatcgggggccggggacctcggggggcgacatgtcgggggtcgggtcggggaataggtcccaaaaacgcctcgggtcggggggctcggggtcggggcttaaccctaatttggatggattaaaaagaaatgatttatttattgccaaatttgcgtaaaacgtagaaatatttcatcattaattaattaaacccatgtaattaaaattgcacatgcagaattgaatttcattcagcaaatagaactgcttcactcatatgagttctattccaaaagaaaagagagcgtcgccaacggccaagcgtacgttttcagcctggccgaccaacaacccaaacagaaaaggacgagcgaaataacggtaattgagttgtgctaattagaattaattattaactaattaattaatgaaaataaa

SEQ ID NO: 69818 - DNA, 387 bp, Heterodera glycines
  Genomic contig location: Contig_ID=SeqID_41757; Location=591..977; Strand=-
  SCN-specific regions: Sequence locations=30-34,56-79,107-387
atgggcacccgaggggccgtcagtgcagagttcgttattttttaaatgatttctacaaaatgccaatttccagatattttctgcgtcaaggatacaacgtcattttgtgagcagcaatttatgatttttgaatggattttcttcttttttttggacggtttgggaggggccaactccgtctcgcccagggctgagttcgcgccattgtgatttatcttttttacgcatcaaattgctcgattttgggtctgggctttttggggtctcgactctcgtgggtcaattctcgactctaggaaaatttcggtttattcaatgctatgcatgatgaagccgtaaggagtctacgttttcgataaaagggcaaaaaaaggaaaatttattaaa

SEQ ID NO: 69819 - DNA, 215 bp, Heterodera glycines
  Genomic contig location: Contig_ID=SeqID_41761; Location=491..705; Strand=-
  SCN-specific regions: Sequence locations=1-22,44-60,82-104,163 -176,203-215
atgtcagcgagacgaggtaaatgaaaaatcaatttaaaaatttcatatacggagcttgattagaataattaaatatttcagggacaatgattcattttccgaagataaataataaaaatacaaaaacttaaaattttcatggtaaaatttttttttaatttacccttaatcgaaatttgtcggaaatttagaaatttgaaagccaagggaataaa

SEQ ID NO: 69820 - DNA, 442 bp, Heterodera glycines
  Genomic contig location: Contig_ID=SeqID_8960; Location=2217..2658; Strand=-
  SCN-specific regions: Sequence locations=1-442
atggcaacggcaaaacagatggctgcggcggctaatgcgcgacgcgttaagaacgcaaagttggcggcaaagaaaagcagagccgccgtcggacgtgctggcaacgtaaacaaaaatggaagcgcatcccaatagcctaatttgttgttctattttaaggttgttaaggcacaggcccgtccgaagtgcgcaaagtgtgagaagggcggacgaaaaagactgagaaaaaaatctcgtgcggacatgtgctccaccgccggtgcttcttccgtcacattgccacaacagttcgctgcccaacatgcaacaaaaggattgtggaggaatagctcaaaagggaagaatgagtcagatgatcaaaaaatgtaattaaaatgatctgtatttcatgtatattgttttaaagtgaccgtaaataattttggttgaatagattaataaa

SEQ ID NO: 69821 - DNA, 300 bp, Heterodera glycines
  Genomic contig location: Contig_ID=SeqID_41762; Location=847..1146; Strand=+
  SCN-specific regions: Sequence locations=1-300
atgcgcgacttagaagaccaggaggagcaggcgaaggtccgtcttggtgatcgcgtcgtacgccgctccgttcacttccaaatcgacttccatccaatcaagtgagccaatgcaattgcaccatctatccaattttacagttttgctatggttcagtttgcagcatcatcatagcaggtgacgcgtgctacgcatctgtcgacctacactatatcaatatgattacaaaaatatttggacagaatgaatcgtccttgtgtggtgtggcagtacatgtcatatcgattgccgctggaaaga

SEQ ID NO: 69822 - DNA, 165 bp, Heterodera glycines
  Genomic contig location: Contig_ID=SeqID_41765; Location=1052..1216; Strand=-
  SCN-specific regions: Sequence locations=1-67,101-165
gttctccacgactatgaagtgacaaagaatcggcttagttccctttcgtggagcacaaatcgatttgtaatataaaaaaattattttaacttttttaaatcgatttttttttgccaatttgtcccatctttttaggaccctcctcatattgttgtcgcgtccgat

SEQ ID NO: 69823 - DNA, 463 bp, Heterodera glycines
  Genomic contig location: Contig_ID=SeqID_41771; Location=96..558; Strand=+
  SCN-specific regions: Sequence locations=1-303,327-463
gccatttttataacctttggtctctccgggtttcctattggctgtacccctggaaaatatttgttggggcttcgtgtgatttcatgtcttgatgttcaaccaatagttggctcttcggatcgtgtgatggtcacctgcatgccgagtgttggtttcagaaggtgggcttttgtttggtctgttcctacaaaaatccctccactttttctttggctctccgattctcattttgtttaacctgccgttcgtgtccaaagactcaccaaaattttaaacaattggatcgcaaaacgtttttttctgttttttaatttttttttattttagctcactaactcgcgctgtgatcaaaaacatgctgaccacctttttgttccctctcagtaccgccttttatctgttcaatcataatcgtgctatttatgatttggctgcaaaaacaatggttatttctctggtctaa

SEQ ID NO: 69824 - DNA, 755 bp, Heterodera glycines
  Genomic contig location: Contig_ID=SeqID_8961; Location=1642..2396; Strand=+
  SCN-specific regions: Sequence locations=1-19,48-70,92-147,169 -517,539-574,598-652
atggctttgttagagatgggttgtggccagcagctgcagccgccgcttggccccgccgacggggagggcgccgccgaagaagaagccgccgccggcacaggcggcgtggccacgacaagcgcaacaatggcactgttcggcttctaccatcccccagcgacagcaccgcaacaattaacgactaccgtaccaccaccaacagcactacaacacaatgccaaccagcaccagcatcactacggtaggggaggggagagggggtacggtaaggggaactcttgtaatatgaaaaagcttggcatggctcaactcttttgtccgaatattccaacggggttaacgccagggctgttgctaatcggaaaataaaacgcgaaaaaaaactaaaataaatacgaaatgctataattaaacgcccaaaaaaaacacgaaaatattaaacgcgaaacaagcaattttttactgaaaaattctaaaatttataaatcatctcgaaaaaaatttgaaaattttgatgcaatttgttaacagattttgtccataaaatgagcaaattttgcaattttaagccaatttttaaataatttaggaatttttgggtccgatagtgccgcgatttttggcttaattgttaaacgattttcacctatgcaaattttattgtttttaaatggtaataaaattacaaataaataatttttacatttaaaaaatatttacaaaattaaaagagattaaattaattattttttaaa

SEQ ID NO: 69825 - DNA, 363 bp, Heterodera glycines
  Genomic contig location: Contig_ID=SeqID_41772; Location=446..808; Strand=-
  SCN-specific regions: Sequence locations=1-363
atggactcaaatctccggcattctaaacactgggactcactcaacccaccaactttcaatgacattccaatctctgggactcaacccaccacatttcaatctctgagactcaattatctgactttccaatcgctgggactcaacccaccagcatttcactggactcaatccaccaacattccaatcactgggactcaatccaccaacatttcaatcactgggactcaatccaccaacattccattcaacgggactcaacccaccaacattccaatcaccgggactcaacccaccagcatttcaatctctgggactcaaatctccggcattccaaacaatggactcaaatctccggcattctaa

SEQ ID NO: 69826 - DNA, 531 bp, Heterodera glycines
  Genomic contig location: Contig_ID=SeqID_41774; Location=246..776; Strand=+
  SCN-specific regions: Sequence locations=1-183,205-328,357-531
gaccgcgttgtgcctcttcacacattgaagtacgttgctcagctgtaccatttgctgcgcacggaggcaagcgaatggcaacggaggccggtgctggcgcgcattgagacaaaggcggggcacggagccggcaagccaaccaccaaaacggtaacgcaaaattctcttggggaaacaggcaactgatactctctgtgctgctttttgttcagatcgccgaacttgtcgatttgtactgttttttgcagcgggtgctcgaacttgaatggaaagaggagtgatttgattttgcgatgttgtgcaaaacgtaattctatttatatgaaaatgtgtgtctttttctttgtttcatgtctataaatatgaaaaaacacgatttcgtttcactccctccctccccctcgcccatgtcagattctatcaacgaccacgaaaactcataaatgttttcaggctacaatgggtactattaccaaggcattgatcgaattgtacaataatacgaagaaaaacacaagggattcagattga

SEQ ID NO: 69827 - DNA, 308 bp, Heterodera glycines
  Genomic contig location: Contig_ID=SeqID_41774; Location=310..617; Strand=-
  SCN-specific regions: Sequence locations=1-16,45-168,190-308
gttttttcatatttatagacatgaaacaaagaaaaagacacacattttcatataaatagaattacgttttgcacaacatcgcaaaatcaaatcactcctctttccattcaagttcgagcacccgctgcaaaaaacagtacaaatcgacaagttcggcgatctgaacaaaaagcagcacagagagtatcagttgcctgtttccccaagagaattttgcgttaccgttttggtggttggcttgccggctccgtgccccgcctttgtctcaatgcgcgccagcaccggcctccgttgccattcgcttgcct

SEQ ID NO: 69828 - DNA, 1001 bp, Heterodera glycines
  Genomic contig location: Contig_ID=SeqID_41777; Location=48..1048; Strand=+
  SCN-specific regions: Sequence locations=1-32,54-72,94-1001
  Gene Ontology: Mol. function=high affinity sodium:dicarboxylate symporter activity; Cellular component=integral to membrane; Biological process=dicarboxylic acid transport
atggcccagcgggcacagctgcacccgttggcactaatgctgcccaccacgttggcatgctcatttgcctttgtgctgcccgtcggcacgccgccaaatgcgttggccatcggcagcggactgttgcgcgtctccgatttggtcagtcgatcaaccaatttgtgctgctgttcgagagttaaaatccgtaccgagaatagagactgaaaagtccaaaattccaagagaattttctcgaatcgcgtgactaaacactcttgaaaacaaattaacaaagtgccaacatactgtttaaatttggattttgttggacaaagaccgacaattttttttttttggttaattgtacggcttacgacaattttcaggataaaacacaaagtcgtaaaccatgacaagttgtactgctccgtttcgtactgtcttcaacaaaaaaaatgtcattatttttgtcaaagtccaccaaattaaacatttttacaattagtatcattcaacagcttcttcatctcgctatttaacatgcaaaattcaagaaaatttaccatgattcaaaaaaaaaagttatgacgattttttgtcaaaacaaacagtacgagtcggggcagtataagttgggtttcgtccaattttcagccaagcagtgccagtcgtagatggctatttgtttgggatctttctgaaatatggatttcgcctaattgtcgtaaatttcaaaattcccagattctatcgcttttccgtcggtacgctttgaaattcttaattttttgcagatgctctccggacttgccgtgtcggccgcttccgcgctgctcaccatcgcttatctgtccacttttgcgcctctcattttacccattgactgcttcccggaatgggccgcggttacgacggcgacggcatttgacgccaacggcacaacgctaattgccgagggggcggcggaggaaatgggcggaattgccgcgcttggccggctaataatggcggaggaagcg

SEQ ID NO: 69829 - DNA, 138 bp, Heterodera glycines; identical to SEQ ID NO: 50950
  Genomic contig location: Contig_ID=SeqID_41779; Location=296..433; Strand=+
  SCN-specific regions: Sequence locations=1-138

SEQ ID NO: 69830 - DNA, 230 bp, Heterodera glycines
  Genomic contig location: Contig_ID=SeqID_8963; Location=23..252; Strand=-
  SCN-specific regions: Sequence locations=1-230
atggccgcgccaaaatggccgcgccaaaatggccgcgccaaaatggacgcgccaaaatggacgcgccaaaatggacgcgccaaaatggccgcgccaaaaaagctcgcgccaaaaaagctcgcgccaaagtgggcggattgcgaaataagtaccaaaaagtcacgtgacgattgcgaaatcaatagggatattacgaaaaagagaaccaatagaacggttttgattgacag

SEQ ID NO: 69831 - DNA, 1934 bp, Heterodera glycines
  Genomic contig location: Contig_ID=SeqID_8964; Location=522..2455; Strand=+
  SCN-specific regions: Sequence locations=1-87,127-149,171-183,214 -319,341-388,444-537,566-591,618-1075,1097-1147,1197-1237,1293 -1417,1464-1483,1517-1678,1700-1934
atggacaacaacagtaacaatggtggtggtggcaacaacggcgggcgaaaaccgcccccctcccggggtcggaagaggctgcacgagagcagcagcaacaatagcggcagcagcagcagcaacagcgccaacaattttgtggacggcgacagctcttcaaccgtgcgcgcatcaaaccgtcctcagcaaccgcagcagcagcagcaacacaactataacgacttggagctgctgctgatccccggcattgacgacgtgaacagttcggcactgcaaccgcagcagactcagatggttcaacgaccaattgcgacgggcaatggacgtcaaatggtggtgagttcaaattggggggactcgttaaaataaaagccattttggcacgctgttaaatatattttttgtattttctaaaatttttggcaaaaaatttaaataattttcggaaaacaaattaatttgtttttttaaaacatttggtttaaggcggtcaattcggcgtcccatggcacgcctgtggaaggaactttgcaaaatgtggacggcggcggtggcggtggtggtgtcttgtctcagcgtaatgtaagccgggagtgggggcgggtgtgtgtgagggataagtaatgggatctctctagccaaaaaaaaattgataaacgggtgaccacaaatattttttttatagagaattgaagcaccaaatgtcccctccctatttgagtgcaaaaaaatggtgtgcccatgtggagtttgaacaatgtacgtttttttggggggatgtcaaagggtagcagggcttttactagcatttcgggtgggccttcatttttgtcattgtaaaccgggcccaaattcgaacaatatatgttatttgatggattttatttatttttttgtagtctgctgtcaattttgccgctctgatgacggccggcgggggtgacggttcatgtgcagcccgtcccggtggtggaacgctttcggtggtgcgcggtactgttggaggcggacttgaggtggtgtttttaaatttttttgtgtcaatgtggagggggggggcaataccaaattttaaaattaaacatttttcttttaaagtcgctcccgcccagtgtgcgtgaggcggttgcaaataataatttttcccattttttttttgaaaaaaacatttttgatttaaaaaaataataatttttccccatttttaagtgttcaatccgccgtcagcaaaaacagcacagcctggtcatgcaaatcgacgacgatgatgagggcgaggagcagcaggacgaacaaagccgcgggagtggcggtagcgacgatggaccggcagcgaattttgcattgtcatctgcgggcactgatgcgccgcgaaccgagaccggcgcttcgtcaacggtgagccgcaagtgaacaaaaagaaagaaaagaaagacaaaaagaaaaagcaaagaaagaaaaaacgcgctcgcataccatcattatacgcacacacacactcacacaaacacatacaatttgttctttgtttttaaaaatacaattgttgtttattcttctgttgtgttgttgtttttgggttgtttaatagtgggggacgggggaattgagtatctgcgggcgtgttttttgcggaaagtcatgcattttcggtacaaaaatttaaaaaaatgattccaaattttttagccatggctttccgcaacgcgcccgcccactccacctccgccacgaatggatcatcggcggcggccaacgggtggtgcgcccgtcatgtggacatttcctccacgcctgctgttttgagcgtgaggcgaaattggggcgagtgtgccccatttgttcagcccattttataagtgggaagaatgactcgctagggtcaaattttcggtggaggacgccattgaccgctcaaaataattaattaaaaa

SEQ ID NO: 69832 - DNA, 686 bp, Heterodera glycines
  Genomic contig location: Contig_ID=SeqID_41783; Location=305..990; Strand=+
  SCN-specific regions: Sequence locations=1-10,32-33,64-146,189-686
atgatcaggtaaaagttaaaaatatttttaataattattattattattattattattattatttattttaaaggcaggccgcccatcaaattcaaaaacagaacagacgaaatacggttatatctagggaaccaatttttaagctgaataaatgtttattaatttacctaattaataaataaattaaacaaaaaagtcagaatattaattaatttacctaattactaattagaatattgaacccaagatttcataataagcaaaattaaaatcgaataatgcaaaaaaaaaaatagcaaaataaacattaaaaatcaaatataaaaaacaagtactcactttacaaatgttgaaaaaaatttttttttacaaatttaactggaaaaatttataaatttaagatcggcaaattgctcttagcctatcgcattatgataattcaacggcaaatgacgcacaaattgcggaagcaatggataaagcgtggcaggagcaagcggatgccgaattagctagacgattggctgatcaactatagtgtaataataatttgggcagacaatttttaatgactaacaataacaagttatccaaattaataattaattaagaattaagaaaaaaaagccaaaataataattaaatgctcggtcaataagcagtcaaaaagatagatcagaacgaaa

SEQ ID NO: 69833 - DNA, 306 bp, Heterodera glycines
  Genomic contig location: Contig_ID=SeqID_41785; Location=613..918; Strand=+
  SCN-specific regions: Sequence locations=1-34,66-99,127-139,161-306
atgggcatggaattggagcaggagcagcaacaacaggaggagcaggaagaggaggaggaaggggatcaaatgatggcactgacaattgaccacagtgatgacgagggggaggaggaggagaagccggaaaaggagcgggatagtaatgtggaagaggcagacaccaatagtgccaaatttgacgacaacaacggcacaattgccgccgacaacggcaccaatggcaacaacaatccgttgcggttgctaatttcggcggttgaagagcagcaacgccaacaacagagggacaacaacgacttgtga

SEQ ID NO: 69834 - DNA, 612 bp, Heterodera glycines
  Genomic contig location: Contig_ID=SeqID_41786; Location=538..1149; Strand=-
  SCN-specific regions: Sequence locations=1-273,295-612
attttatggaaaattttatgaactttttatcatccaacaaaattaaatcagtatttgtagtccaacattgggatggccttgttcaaaaatatcaacatttctgcggttttcggctttaatctcgaacgtcgataatcataaacatccctcgccactttgaaagtctgttcgctcggcacgcttgttgcaggggctgacaaatacttcatcgccaattttgataacattggaagttttggtccatgcttcttccaccattcaaacgggtcagaaaatggcaaaattttgttaaaattttcgtcaacttcagtgaatgccttaatttctgattgggttggaattaactttttcttacctttcgcatgtttgctgcagaatcggttacaaaagcaaacactcgtccgtcgtttattttccaactgtccaataatttacggacattgcacgcaatcgcattgccagaatgttggccggaaaaatggtgaacagcgagtacaaaattcttttgcacccaattttttgtgacgccgtgaccagtcaagcttaattattttttgaaataccgcttcttgaagcctaaaattaccttaaaaaattgtttgatggacctgc

SEQ ID NO: 69835 - DNA, 749 bp, Heterodera glycines
  Genomic contig location: Contig_ID=SeqID_41787; Location=85..833; Strand=+
  SCN-specific regions: Sequence locations=1-58,135-140,163-296,328 -418,440-529,551-551,575-749
atggcaccaattagtgataaggtggggctgtgccgctttcggaaacggaggatttctgtttttttttctaatttctaaatatttaaatatacatatatgtatttatgaaaaaattgaaaaattttacaaaaatactaatctattcattaaaaatgaaaaactaatgtaaagactaacataaattagcaaaattgctaaaatggtggcttttgtgaaacgtcctagcactctttatatattggaatttaaaaaaatcaaaaaataggatcccatttttttatccaaaaaatcggagcaattttataatttaatttaaattttattaaactaacaataagtaaaacattctctcttagtcaaaatgccaaaggagaagctgatgtcatcgcattgtccgtagatggcaccatgttgtaccttagcaaagtgatcagtttttcgtttgcacattttggcatggacaaattggcacggatcagtgttggccgtgtgccggaacaggacgggtttaaggtggattaatcagtctttcaattgtttctcacatttacatatttttgaatttttaaattttccagggctgcttgcgcaatgttcgtgccgggcccttgccaccgctcattttccattcgctgcaaaaagtgccgagaatggccgatgcaatggcacaggcacacctcacccattttgagcttcaacaccatgaaaatgttgtgccaagcgggtgccaatcgtcaaatgtttggtga

SEQ ID NO: 69836 - DNA, 864 bp, Heterodera glycines
  Genomic contig location: Contig_ID=SeqID_41789; Location=76..939; Strand=-
  SCN-specific regions: Sequence locations=1-7,29-362,392-456,478 -546,568-864
atgccgattgaggagaaggagaaaaaagatgtctatagaattgtcgtttgggtaagttttacaacaaaacaacaaaataggtcttgttttacaggattcggaaacgtcgcaggatactatttacaagggggaccagaaggagcatgttattaattatatttcggtgagagttacgtgtacggaatgctgtgatgacaaaaacaggacgaattgcaaaatttgtggggaggagaggatcaaggattggagcgaggcggagggacatgagccgaccaaggattttgtggagtggattttaactgcgtttacgaattacgatacgtacatatttgcacataacgccggacgttttgacggtaatgaaaaaaaaaattaatctaaatttttaaatcctaaatttttaggtcattttgtttttaattacctctgccgtaccgggaagaacccgttaccgctcatcaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaggaaaatagaaaaatttttgaataaaattcttttttttcaggtacaatgagaacaaggagacgcccttttatttggatgaagaattgagaaattattgcagaaacgacacggagattttattgttgtcgcttcttgag

SEQ ID NO: 69837 - DNA, 640 bp, Heterodera glycines
  Genomic contig location: Contig_ID=SeqID_41790; Location=65..704; Strand=+
  SCN-specific regions: Sequence locations=1-148,170-601,625-640
  Gene Ontology: Mol. function=ADP-sugar diphosphatase activity; Cellular component=intracellular; Biological process=cation transport
atgtcaaatgtggcacttttctccgttttaggcgaactcgcactgcccggtggaatgttgaacaaaggcgaaccgccgactgaagccgccgtccgggagtttagtgaagaagcaatgggagggcatcgacgggaggacaaattggaacatttttggaaaaaggggaaaactgtgtaccagggatacgtggatggtgaggaaatacgaaaaaagcgaacacaataataatttaattctaattgtaagaccaccgaaacacggacaacgcgtggggagaaacgacggcggtgaacttccacgacacggacggactcttggaagacatcgaattggaggtagagcaaacccattttagggataaagacacagactaaaacattttagggtggcgacgacgcagaaacggcacgttgggtcgacgtcaaccaagaactgaagctgtacgcctcacatgattatttggtgcacttatttcataaaatgcatgcaaatctcgcataaacgtctttttatactttgaccaaaataacaaattcttaaaatttattctatcatttgtataaaagttatggacggagaatatatttcatcgagatttcgcacaaaaattaagtaaaaaacaaacatttggtaaagagca

SEQ ID NO: 69838 - DNA, 230 bp, Heterodera glycines
  Genomic contig location: Contig_ID=SeqID_41791; Location=773..1002; Strand=+
  SCN-specific regions: Sequence locations=1-230
atgccgccaatttcactcttcgagtggacctttgatgcggacgggaaacaaacatatgatgtcagttatgtggacggtgccaatgtgccgatcagtgtacgtgtgctgaattgtcctggtgtcaatttcaacaaaaaattgggcaacagtttggacactttggtcgaccagttgcccgatgcaatgaaaatggatgtatttggtgtacgttttattggcacaattagggg

SEQ ID NO: 69839 - DNA, 682 bp, Heterodera glycines
  Genomic contig location: Contig_ID=SeqID_41793; Location=7..688; Strand=+
  SCN-specific regions: Sequence locations=1-358,380-682
atgtctgtgttggccaatcggtccgcggttttttgggctcagccaacactcacaacggttaacaattccacccattccgtttcgcaatacgccaaatttatacaaatcttttagattaattctgtcgatcggtctgtcggaagtgaatttgcggatgattttgaccagtcaaatccgtccttcgtccatttgtcgatcactgtcgtgctgacccatcccgtcgctttgactttttttgtggactttttgaacgaagttggcggtcaaaattacatcgatttctacttggccattgaggtgtggttgttttttaagcagtgcgtctcatttggttgtatcaacagggtttcaacgtgtccatggagcatcagttgagggggttggcctcgggcgacactttggacagcgacgcgcgggagacaattcgagaagcggctctcttcatgtaccatcagtatctgtcacaggaagtgaacctctaaacaaatttggtcttcaaaagacgaagatgactcaggcaatcactcgagttccgttgagcgaagcaattgtcaacaagtttttggcccgactgcgcaacgacgaaccatcggatggatggtttgagcaaattcaggaacaggcaaataaaccaagcccaaagcgcaatccgatgcccattttgataatgaacaccccctga

SEQ ID NO: 69840 - DNA, 502 bp, Heterodera glycines
  Genomic contig location: Contig_ID=SeqID_41793; Location=351..852; Strand=-
  SCN-specific regions: Sequence locations=1-467,489-502
tttaattggtctgactcattgggcagcacctgattcggccgactcggcagcgacttcgctccctccagtggtaattccgagttggtcgagcatccgaccgtacagcgcgtgtcttttgaaggcggggaaaaagcgctcttcactcttcagaatttcgacaatcttcagggggtgttcattatcaaaatgggcatcggattgcgctttgggcttggtttatttgcctgttcctgaatttgctcaaaccatccatccgatggttcgtcgttgcgcagtcgggccaaaaacttgttgacaattgcttcgctcaacggaactcgagtgattgcctgagtcatcttcgtcttttgaagaccaaatttgtttagaggttcacttcctgtgacagatactgatggtacatgaagagagccgcttctcgaattgtctcccgcgcgtcgctgtccaaagtgtcgcccgaggccaaccccctcaactgatgctccatggacacgttgaaacc

SEQ ID NO: 69841 - DNA, 793 bp, Heterodera glycines
  Genomic contig location: Contig_ID=SeqID_41795; Location=157..949; Strand=+
  SCN-specific regions: Sequence locations=1-325,347-741,763-793
ggcaggacaagaaaagaatgaagttgatgcctcatgaaactcggaattggttatgtttagtcgaaaatatgcttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacagtatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaatattaaagaggcgaaagaattcacagtatcgtttctaatagggaaatattgacaggatattcggctaaaaacgggttgatcatt

SEQ ID NO: 69842 - DNA, 245 bp, Heterodera glycines
  Genomic contig location: Contig_ID=SeqID_41800; Location=1142..1386; Strand=-
  SCN-specific regions: Sequence locations=1-245
atgaccccgacccgttcctattgcctcccatttttacataaattgctcacaataaaaagcataaataaagtaacacatgtgccagtggaacgcgctgaattaggctttggactcccaagcctcagaattccaatcattgttatgagggggtcctggggtgatcagtcccatttccctcccaaatccaactccatgttaggaatggctttatttcaggaaaagcatggaaaataaatataaataaa

SEQ ID NO: 69843 - DNA, 1060 bp, Heterodera glycines
  Genomic contig location: Contig_ID=SeqID_41801; Location=1..1060; Strand=+
  SCN-specific regions: Sequence locations=1-640,663-884,906-1060
  Gene Ontology: Mol. function=enzyme activator activity; Cellular component=vacuole; Biological process=signal transduction
gcaacggcaatcggactgggcaacaaagttttgtcttaaatattttaatttcagacgtttttgggattggtataaacctgatgaaaggtccttgcgttaaatgtagtacctgacggaatcaagaccccgagaggatttgaatcttggggtcgaaatcccggtaaaattttttaaaaatcggcgccatgagaaaaaaaaactagccattttcgccaaattatggccatttgagacaaaattttaaaacaaggaaattagaatctggcggtgccgttaggcgccgccgggaaaatttagaaaatttagggtatttcattaagaaaaatagtaaattaaaaaaaaaatcatttcaggataggaggcggcattccacccctggaatacggcctatttgccgacctatgtgcctaaggctcgttactcggttttgccatttttagaaaattgcttaattttaatctcgactaaaataacacccttatcttggatcccgacaaaatcgagattgaatctcggtaaccctacccctggacgatgccaatcccgaattccgatccagactcaaaattccaggttatagttaaatgattcatattttttgcagtatgctattccgtatgcccagctattgctggaaccagtatttgtctgtttttctgatactgattcgcgtgttcggtacttcgcttgtgaggtctgttttttggaaaaagaattgctatgctcacattagagtttctcttaaggcactttacaacattgtaaaaattattaaaatggctgccttggatcactttgaccaactgttcgatattctatggaaattgtcatcggaccctgatcaaaatgttcgaaatggctccgagcttttggatcgacttgtaaaagtaaacagaaaacattaacataaagtaaataaaataagtttcaggaaattgtcgtttccaagaatgacttcgaacttgaaactttgattttgctaattcgagaacgaatttactctgttaactcatcgaatagacgctttatcatctcatgggtaatcacaaacacttcttca

SEQ ID NO: 69844 - DNA, 899 bp, Heterodera glycines
  Genomic contig location: Contig_ID=SeqID_8968; Location=1435..2333; Strand=+
  SCN-specific regions: Sequence locations=1-198,221-227,250-493,515 -593,615-855,878-899
  Gene Ontology: Mol. function=ubiquitin-specific protease activity; Cellular component=nucleus; Biological process=pathogenesis
atggaagaactgctcgccgtcttccaattccattgccacccgaatctccgcggtgcgcccggacagtacccaatggcatttccgtgccatggacgcatttctgatcagaaagaaggcacactttcgatgcaaattgagaaattgtcggaatttgcgcgagaggaagtgaacagcaggcgattaagcaaacacttttacacaaagggattgccatggaaaatattagccaaaataaaaaccaaagaaaatagtactgagaaatggctgggcttttaccttttgtgcaccgctccaaaacaaggtggagagataaataaatttaacaatttcttattcaattaagatggaaattggagctgcaaatggagctgcaaatgttcggcaacccttcgaattgcctctcaagacagcgtaacggaggatttgataagaaaatatgaccatgtatttaacaacgaagtggacaagtggggtttctcaaatttcattgcttttacggtgagtggcagcaaaacttcatttagtggcttaataaataggatgaggattctaagaattttacttattttttctgcggctttaactcaacaagaatacacgaaaaacattttatttcgacaattttgcgttttagcgcccttatttgaccttagaaatccttattttgggtgttagccattaaaataagttctgcccttaaaaatcctcgccctattaataaacagtaaaaattaagcaattgatggatccgagcaaaggattttacgacaaaaatgaggacaaagtgacgctggcgattgatttaactgttgaagaagaaaaaggcgaattggctgatgaataagcgctcaccaatcactcattttcaattgataatgatcgtttggaaatattatgca

SEQ ID NO: 69845 - DNA, 709 bp, Heterodera glycines
  Genomic contig location: Contig_ID=SeqID_8968; Location=4318..5026; Strand=+
  SCN-specific regions: Sequence locations=1-272,313-459,481-491,518-709
  Gene Ontology: Mol. function=protein binding
atgtttctggatccaggcctaagaacaacgggaaaatggtcacataaatcaataataaaaaaaatcaatcagattctactaattatattaattagttttcaattaaccttgctcattgccataattatttctcaattagcctctgctaattgccccgtggaggtcactgatgttgaagtggcagcgttcaaagtgatgttgagcttcatttatacaggcgatttggccaaattgaacggatacaatgcaatggcagtgctttacgccggtggattatttttttatttgatttattaattatttttttaattagccaaaaagtacaacatccctggcttggtcgacgcatctttgcaagttccaatttcatcattgcgaaatgttttcttggcttatgcccaggccggtcttttcgaattggaggtgggaagaacaaattgaaaaaggccgaaagaatcaaaaatttattggtgtttaaccggctgggccagttactttatataactattttttattttcacatttcgaatttagaattttgccaatgattgtttggcttacattgacagaaatgcggatgatttgttcaaatctgatgcatttttgcaaattgaccaaaaattgttgtgtgaaattttgggacatgacgaattgcaatcgatggagaaattttcatttggaaagcagtaattttagaaaacagaaatta

SEQ ID NO: 69846 - DNA, 718 bp, Heterodera glycines
  Genomic contig location: Contig_ID=SeqID_8969; Location=116..833; Strand=+
  SCN-specific regions: Sequence locations=1-97,129-718
  Gene Ontology: Mol. function=ubiquitin-specific protease activity; Cellular component=nucleus; Biological process=pathogenesis
atggaaattgaaaaagtgtcggaattttctcgagaaatctttttgagtgaacgtaaaagcaaaactgtgcacatcaacggattgccatggaaaatatggacaaaaatagaaaagaaaaatgaaagcactggcaatgagaaatgctttggcttttacctttggtgtgatgctccaaaagaaggtgcaattaaatataaattaacataaatgattaatttgaattgagcagaaaattggagttgcaaatgttcggcaatttttcgaattgtctctcaaaagagcgatgtggcggatttcagaagagtattcgatgcccatgtttttgacagtaaaaagaacagctggggatattgtttcatttcgtttgcggtgagttcaattagctattttcttaatcgatccaattatggacaattaaggaattgatggatccgagcaaagtattgtacaacaaagaagaggacaaagtgacattggccattgatgttacagtgaaagaagcaaaaacggaggacaaataaatgataatcaatttgcaattttttgatttaaacatccttaattgacttattatttttcgtgttaacttttccaactgttgtattcctttactgttccaaaaatgtaaaactattaattaattttcggtttgagtgtgtgtccaaattgaaatttgtttaacttaacggaaacttttgaaaatttgcaggctaataga

SEQ ID NO: 69847 - DNA, 49 bp, Heterodera glycines; identical to SEQ ID NO: 51181
  Genomic contig location: Contig_ID=SeqID_41804; Location=182..230; Strand=-
  SCN-specific regions: Sequence locations=1-49

SEQ ID NO: 69848 - DNA, 213 bp, Heterodera glycines
  Genomic contig location: Contig_ID=SeqID_41807; Location=254..466; Strand=-
  SCN-specific regions: Sequence locations=1-131,209-213
atgaatggtgaagggaccgacggcggagaaacggcggaacgggtgaaaacgaagaaaaaagttcgacgggtgaaaatggattttgctgagcaaattaacaaattggtacaaaatgaaggcgaacaacagttgaagaaaaagaagaagcgaaaaatagtggaggaaaacggcgaggaaaagaagtcgaaaaagatgaagaagaagaagagcaaa

SEQ ID NO: 69849 - DNA, 662 bp, Heterodera glycines
  Genomic contig location: Contig_ID=SeqID_41809; Location=21..682; Strand=-
  SCN-specific regions: Sequence locations=1-28,52-662
atggtcacctccggtggtcaacgcgtacttgatgtggttggaggtggtgtacagaaaggcctcattgcccgcgtcccaagcgccgcttttcacccgagtcgactcctgcacagtgccgagcacctggagaaaaaagattgtaagacgagaccaaagagtacaacgccacctccaatctcttggtgacgagggtaacggtgtgtttgctgagcaaagcggcgcattccatgttcttggaccagatgacgtactttacctgaaagcaaaaacattgcggaaacagagtgacgatttaggtttatcgttggataaaacttcaatttcaaacactttttttcaaattttcagtaattttgaacacccagttttgtgttcaacacctttgttgccttgacactggccagcacacgcttctgctgcaagtcgtacatttgcacagagtccgcgttcttcaacagcaacagccccgtgccagcatagaaaatgtcgtcgacggcacccgtgtattcaaccttgaccaattggtgataaatataagatttaagtgaaaaaatagcatagcattaaagtatttttcttaaaaacaatttcgaaaatttctaggtaattttaggaagacaaacattttttaaattcaaattggcagaaatgtctgaaataaa

SEQ ID NO: 69850 - DNA, 1143 bp, Heterodera glycines
  Genomic contig location: Contig_ID=SeqID_8970; Location=4801..5943; Strand=+
  SCN-specific regions: Sequence locations=1-565,587-757,794-953,979 -1082,1104-1143
  Gene Ontology: Mol. function=serine-tRNA ligase activity; Cellular component=cytoplasm; Biological process=tRNA processing
atggctagcgccctcattttggctgggcttggaattgcagccgctggatttacgggccgatatatgatcaggtaatctgccaccattcactgcatcagttcctcatttttggtgtttattataaattaaggaataagcatctggtgaaacaggcgatgactttgcttcccacttattccatttacgagcgtggcggatttgctgttcgtttgccagaaaagaatatgcaaaaaaccgaaagttttaggcaaaaatgacacggcatgaagcggccaaaattttaggcgtttcgatgaacgcgcggactgaacggatacgcgaagcacacaaaagagtgatggtcgccaaccatccaggcactcaaattggcacagaataatcattctgattaacaaaaacaccattttagatcgcggtggttctccttatatggcagcaaaaatcaatgaagccaaagatttattggagcgataaaataattcgaaatgcagaaatttctttttgataaaaatttgtttaataattagtctctgttattcttatttgttagttttgggtagagttgagcgggaccgggacctggtagcggacaactgagtaccaaggtcccggttttgaccgggaccgggactagtcccggttttcccagccaaaaagtcccggtttttcaacccgattaggtcccggtcccggttttgctcaaaattcccggtcccgctcaactctagttttgggcaataaattatttaataaaatgcgtattttctgtttgttcgtggctcagtggttaatgcgtctgtttttgactttcgtttggattctctccatttgtttgttctgcctatgatgatagtaacacgacggtcttcttagactttgtttcgtgctgaaaatgttgttactgaggcatttcatccaatgtttgggcgaagaaataattttctctgactttgaatttaatttttttttttaatttaagcaacaatttattattccgaattacaaaaatggtattaaacattgatttattccgcgaagaaaagggaggcgatcctgaacaaattcgcaaatctcaagtgggccgtttcgcagatgtttcattagtggacaaagtgatttcggcggactccgaatggcgaaaag

SEQ ID NO: 69851 - DNA, 1052 bp, Heterodera glycines
  Genomic contig location: Contig_ID=SeqID_41813; Location=171..1222; Strand=-
  SCN-specific regions: Sequence locations=1-161,183-437,459-818,841 -1052
atgcatcgcgaaatccgcgaaacaatgcatatgcaactgcacagatgcagtgacagttggtgtggtcctagcgacccaatttacgggcggtgcaagaaggggttcccagccccttactcaaaatgtactgttttacgcccggataggcccgcgatgtatttccggccttcaccatctgatggtggtgcccaattagaggtaaacggcctaatatacgacaactcacatgtcgtgccgtataatccttatgttctgctgcgttaccgagtacaccataatgtactgtttgcatatggtaacaaagcgaatattaagtacgcactcaagtacccgtttaaagggccaggacattgttatgtcgagtgcaaagaagagtccggcaataaaatcggaattgatgagccggctcaatatgccaagatgaacttccgtggtgcaacggaagcatatgccattgttcattcaatgccatttgcccgtctttcacatcatgttgtcaaattggcaattcatttgccaaaccaacagcccattgtatatagggcattccagctggtgagcaaagctcaacaaatccagcaaggcgaactgccagaaacgcattgttcagcatattggaaacaatggcaaaatgagtggaagaatgacccaaagtttaaggacattctttttgaaaaagtcccagagcagttccgatgggcaaaggacaaatgggtcctgtacaaaaggcagcaaataaaaaggccacctatcggccgaattgttcctgtacccccatcggacccggaaaggttcgcgctctattcacttatgcgtcactttcctggagatccagatcatcttaagatggttaatgggttgctttgtacctcattcactgaggctgcaataatgcatggtcttcttgaagacggcaaaatttgggacaaaactctggcggaggcagctctgtcgcgctggccagatcagatgagatggctttttgtgagcatcatggtctatggccagccgagtaatgccatagaattgtggaacaagtacaaagaccaaat

SEQ ID NO: 69852 - DNA, 351 bp, Heterodera glycines; identical to SEQ ID NO: 53910
  Genomic contig location: Contig_ID=SeqID_41815; Location=900..1250; Strand=+
  SCN-specific regions: Sequence locations=1-20,51-351

SEQ ID NO: 69853 - DNA, 160 bp, Heterodera glycines
  misc_feature (84)..(84): n is a, c, g, or t
  Genomic contig location: Contig_ID=SeqID_41815; Location=1365..1524; Strand=-
  SCN-specific regions: Sequence locations=1-86,108-130
ctccagagaaggtgcaagacctgtccaactggcggtgcctacccatctttacgtgtctggagtcgggtgtttgggatcgcagcncaaatcaggtggtaaacttcatctaagactaaatacggccacgagtccgatagcgaacaagtaccgtgagggaaag

SEQ ID NO: 69854 - DNA, 740 bp, Heterodera glycines
  Genomic contig location: Contig_ID=SeqID_41818; Location=4..743; Strand=+
  SCN-specific regions: Sequence locations=1-56,236-259,585-601,623-740
  Gene Ontology: Mol. function=protein binding; Cellular component =axoneme; Biological process=N-linked glycosylation
aggaacagaagcggttacagaaagtggaagaggaacagaaagtggaagagaaagtggaagaggaacagaaagtggaagaggaacagttagagaaagcggaagaggaacagaaagaggaagaggaatagaaagtggaagagaaacagaaagtggaagagaaagtggaacagaaaatggaagagaaagtggaacagaaaatggaagaggaacagaaagtggaagaagaagtggaagagcaacagacgtggaagagaaagtggaagaagaacagaaagtggaagagaaagtggaagaggaacagaaagtggaagaggaagtggaagacgaacagaaagtggaagaggaagtggaagaggaacagaaagtagaagaggaacagaaagtggaagagaaagtggaagagaaacagaaagtggaagagaaagtggaagaagaacagaaagtggaagaggaacagaaaaagcaacaaagggaaagaggaaggaacaaaaaaagaagagagcaagagaaagcgagagtgatgaagtgaaatgggaaggtagaaaggagggagaaaggggatgagaaagaggaaaagtaagagattttaagcgatcatattaaaatttgagttttaagaaaacgttaattgaattcccggccattaaaaaaatcagttgccttcttacatataaaagttttttggcgcgtagcgccctctagagactgttaaatagcgaagctatttcaattttaaaaaa

SEQ ID NO: 69855 - DNA, 767 bp, Heterodera glycines
  Genomic contig location: Contig_ID=SeqID_41820; Location=96..862; Strand=-
  SCN-specific regions: Sequence locations=1-1,23-126,155-388,417-767
caaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacttattgccaatctaatttcttgcagatttaaagccatctattgcctgccggttctcgggacagcaaagcactaatagggtgtatgactcacttcaaaaaataattccttacacaaaagttttttaaaccacttattgccaatctaatttcttgcagatttaaagccatccattgcctgccggtctcggcacagcaaagcactaatacggtgtttgattcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgccaatctaatttcttgcagatttaaagctatccattgcctgccggttctcggcacagcaaagcactaatagggtgtttgattcacttcaaaaaataattccatacccaaaagttttttacaaccacatattgccaatctaatttcttgcagatttaaagctatccattgcctgccggttctcggcacagcaaagcactaatagggtgtttgactc

SEQ ID NO: 69856 - DNA, 2693 bp, Heterodera glycines
  Genomic contig location: Contig_ID=SeqID_104; Location=1172..3864; Strand=+
  SCN-specific regions: Sequence locations=1-846,869-1763,1785 -2207,2230-2595,2639-2693
atggccgcaccaattcaacagaaactcggcgctgcactcaaagttctctcccgcagccgaactgcggcggagctgaacatccaagccgaccaagcggcatcaaatctcgaaaatgccctcaacttcgaaattcaattggagaaagttcaaaaagatgccaaaacgatggacatcttcctcgacgatgtgcgcgaagcactcactgcatgggcagatttactgcgcaaactgcctgcactggaacgcgatccggcagaagcagacttcaacaaattcgagaaaaaagagcgaatcaacgacaaagtcgacgaagcagcactgaagctgcgcgacttgcgcgacttaatcggcacactcacgtttcaagcccgactcttccgcagcaaggcggacaaagaagaaagggacgctcaagcagcctatgcacaagcaacacaacataccgcacagcaacaaacaacaaagacgccgtccttcactcctccgttctaccaatttcaacccattcagctggacaagttcttcggcaacaaacgcaaatggccggagttctacgaatcgttcaaatcggcaatcggcacacatgcgctcagcaaagcggagaagttcaatctcctgcgcaacctgctcggaggagaggcccgtgaactcgtggccggatttcggctggaggacaacaattacgacacggccctccaattactgaaggacacatacggcgcaccggacgaacacatcagggcacttcatttcgaattggcaaacctcaagccctgcaaaaacctgcgcgacacaaaagaattcctcctgcaactcgaaaggctcacacgcgaactcaacaactcaggagaagacattgaaggcccaccaaccttccttatgcttgaaaagaagctcactcccggatttctacgcacaatcctcaccaaaaagggagaaaatccggcacactggaacaccacgaagttccgagacgtactcaacgaagcggtccgcaaagaaacacaaattcaagaagtcatgggcgagtacggacactcgcagcaacaacggccgccaccgcaaaagccaaatttctcggcatcgaaattccgagaccgcgcaccaatcccgcagcaaagggaacgtacattcatcacatcagcagtggatgacaatcacaaaaggctgtatggcagacagcctcaatataggccgcagcaacaaaggcctcgcgcaccacaaacgcaacaaagaaactcgcgcactttcaacaatcgaacgcaaattccagctcaacaggcaaatgcgacattcaatcaacgcaagcctccaagtccgtgtattttctgtggtaacgaccactggaacgaagaatgccggaaattcagcacaattcaacaacgaagagaagtgctgcgcacaaaggcattatgcttcaaatgcctcaaaaacaatcaccaagcaggaaattgcccgcaaccaaaaagatgcttcaaatgcaaacaaccacatccaacggcattgtgccacggcgacagcaagccaccaaaccaaatcacagcagcaatgtttggacaaccacaacaaaacgtgccaagtacaagccaagcggaaagcaacgaacccgcagcatcaacatcacaaatgtgcaatgccgtaaacggaagcgacactcgcgcactgctgatgaccgcaacgtcaacggtcttcaatccagcacaaccgcatctcagcatgactgcggcaattttcatcgatccaggcagccacagatcattcatttcggcaaaggcagcacagctactggacctcccggtggtccacaccgaagaatgccatttgaccagcttcggagaacgcgaaccgaagagatacatcagcgatctagtcaagctcggatttctctgcacaagcggggaaaagctcatcttcaatctcaacgccatgaaattcttggtcaacgacatgccaatgattcaactgtcagagttggacaagacagaattgagacaacaaaagctcaatcctccacatgagcaacgacaaccagacatcatgctcggaattgatgtctggcacgaactgcaggttcaaccaatcgaaaaactgccaagcggcttcacactgtgccgttccaaaatcggcaaaatcttaagcggatcaggacgcatcgaaatgcaccaaacgccgaacgtgacattcgtcatgtcagtccatggcactgaccaagaaggagccaatcaatctgttacgttcgaatcaaccaaagaagataaggaagtcttcacatccgaagatgatgtcaaaaaggacgagcagctcaacaacttcttcggattaaacctgatcggcatggacgacacatcaacaccaactgatcaagatcaagtgatggtctacttcaaaaagaacctcacattcgtcaacaaccgataccaagtcgccttgccttggaacgacagagtcgatgctcttccaagcaacatacatcaagccaaggccagactcgtttcattgatcaaaaagctgcgcagcctcaacctgattgacgaatatcagacaattttggacgaacaaagtcgacagtcggtcatcgaatacatcggcccacctgagtcaccatcaagtgcatggcgcactgcatttttgccacacagagcagtcatcagagcggataaagcaacaaccaagatccgaatcgtcatggatgc

SEQ ID NO: 69857 - DNA, 3618 bp, Heterodera glycines
  Genomic contig location: Contig_ID=SeqID_105; Location=114..3731; Strand=+
  SCN-specific regions: Sequence locations=1-85,109-1560,1582-2253,2283- 2341,2363-3618
atgtggacagacagtcaatgctcagtcgaacgacttcgagaaaacaagcgccaagatcgatttgtggtaaatcgattacaaaaaatccgagaagcgaacttccaagtccgacacgtcagaaccgactcaaatccagcggacatggcatcaagaggagcggatcctcaatgccttcgatcatcactgctttggcactttggccccgtttggctttcgaaagcagacaaatggccaaaatcaaacgtcatctaccggcccggagatgaattcaaagaagtggaagagccaccaatcatcgaactgacaacacctgttcatgtcgaagaacagttcaaaccatcaatccacttcgaacgattttcgaattggaacaggctgaaagccaccgcagcacacgctatgcgcttcatcaaaaagcttcgcacaatcgaaaacggcacaattagtgaaccgcatcaaaacaacaaaccactgaccatggcacaactgcaacaagccgaaaattggatcttgaaagaagcacagcggcttcatccaccatccaacgaccaaatccgagaattgcaactcttccgacaagaaggaatttggagatgcggtggacgactcgaggaagcaccggatctgccatacgacagtaaacacccaatctttctgccgccacacgcatggataaccaagctcatcatccggcattatgacaaacagctcaaacattgcggtccgagaatactcctgtcaacattaagagagaagttctggataccacgcggacgcaaaacagttcagcaactgctcaactccccgcaacacggatgtcttgaatgtcgtcgagaacgagtcaagccgtacatatatcctgaggcatcggatttgccaaggggaagagtcagcgaagcacgaccattcgacaaaacgggagtggactacttcggtccactcaaagtcaaacaaagcaatgacgtggtaaaaatctacgtcgcactcttcacctgcttggccatccgcgcccttcatttggaagtagccgaagactactcggctgaagcattcctccgagcctttcggagattcacggccagaagaggcataccatcacttatcatgtccgaccaaggcacaaacttcgtggcaggagcaaaagtcatcaaagaaaactggaccgacacgttaatgccggaggacatgcaacaacaaatggctcaaagcggaatccgttggattttcaacacagcccacgccccttggaaaggcggcatttgggaaagacttgtcggcatcaccaaaaacgcactacgaaggacagtcggcagaaaccttctcacattggacgagttcggcacaatgctctgtgaaattgaagcgatcatcaacaatcgaccactcacgttcgaatcggatcaggaaccgatcaaagtgttgcgaccaatcaacttcctgataccatacagcaaagcaaacaacaacttcccaatcatcaatgacgacacagacgatccaacatacgagccaaacccaacaaatcgcgacaaaatggtgacaacactgagccacgttaatgctcggctgaacaaattctgggaaatttggaaaagtgactaccttctttccctgcgcgaacacgaccgaccaaatgcaacgacaggactacaaaccccaaataacggcgacatcgtgatcgttgaagacgaccaaatgccgagatccttgtggaacttggcgagggttgagaaagtcctaataggaaaagatgggagagcgcgcagtgctttgataaaaatcaatggaaaattaagggatagggcaataaaccaattgtacaatttggaattgagccctaaggttccagagcaaccaattcaacaagtccactgcctcatcgcatcaatcatggaagactcagtctccttagccggcagtgacgacgaagaacaacgaccacgcaacaccgaagacttcaaaatcccaaaacgccgctcagcattattacgacccatcggagaacaacaaagtccactgcaaggacaacacaaacgccgcaagcaacttcacgactccggattgctaaaattgttccatgcaatcgcggaccaacaaggaagcagcaaggccacgattcaggccatcgcagaaaacagagaagtgcgaaaagcgccacaacatgagcaaatcgaacacgaacaacaaatggtgcagaaagcgcaaaaagaagctaaacgacaccttcgcactgagcaacacgaacgagaaatgccgcagccacaaaaagaagaacaacaacgagaagccgaacgtcaacaaatcgaaaggcaacaaaacgacgaacaacgtgccaccaatcaacaagcacacagcaaggcatggcaagaattagcacaacaatttgactatgatctgatggatcagccggatccaacagagaagcacgcggaagaaacggatcagtcaacgaaatcaaagcagcaatcagcaaaggacaaagagcttgaacgacatcgaatcggcagaaaaaagactatcgacatgcaagagaagcgacaacggtcaagagacgaatggccagaggaaaacgaaacgctactcagctacgttcaacgcatttacggaccggagaattggacgtcagcatggcaaagaggacgtgttctccgagaactccatgaactggaggaccaagggcgatggatgattcatcataaaaccgatcgacttcaactcagcgtctcacgactgtatggaggaaaacgaccattcgccgagttccgttttgtggacggcggatactactcacacatggtgccagaagatgtgatcttcctccaggccgtgccaaccgaagaaccggaaatcataacgctcgatgacacgccaacaacagaaaaaacggccaccgacaacgcaaagcagccaaaccaaccaaaaacatcggcacccacaatcgaagagtaccgaatggccgaccccaagccgaacaacttcaatgaattcaacctgtttgagccgtgtgacgactctcacacaacctgcgcaaaaacggcaacttacggatcaatcgccagcaaccgatttcaattggaagagttcaacaactgccgcgcgaccaacttcttccaagccctaatcttcaattggctcacccggaacatgaacctgccagctgatgaaatttgggcagctcacgacaactacacacaactcaacgtcgtaacggaagaaatcgccaaaaagtttcaccaacaacaagtcgtcagcaaaagacgacaaatcggacgcgaccagcacttcacagaggtcatcaatgtctggcgcaactcatgcgatcgcttcggcgagctctacaatcaaccggcacacaaacaagtcaagtttcgaccaatcataccagaaaaggagcaaccaagtgactacgaggaatggatcgagcgactcaacaaccgaacggcggaaatcctcacaaaagctcgagcaaaagtgcagcacccgaccttcttgaactacaattgcacaaccattctcatcggagacaacgtggcagaagtgtttaagccactcttctatgacgccaagtggttcacccacttcccagcagacgaattccgacttatcccgggaccaaag

SEQ ID NO: 69858 - DNA, 3702 bp, Heterodera glycines
  Genomic contig location: Contig_ID=SeqID_106; Location=67..3768; Strand=+
  SCN-specific regions: Sequence locations=1-537,559-1545,1568 -3006,3028-3216,3238-3702
atgattcatcataaaaccgatcgccttcaactcagcgtctcacgactgtatggaggaaaacgaccattcgacgagttccgttttgtggacggcggatactactcacacatggtgccagaagatgtgatcttcctccaggccgtgccaaccgaagaaccgaaaatcataacgctcgatgacacgccaacaacagaaaaaacggccaccgacaacgcaaagcagccaaaccaaccaaaaacatcggcacccacaatcgaagagtaccgaatggccgaccccaagccgaacaacttcaatgaattcaacctgtttgagccgtgtgacgactctcacacaacctgcgcaaaaacggcaacttacggatcaatcgccagcaaccgatttcaaatggaagagttcaacaactgccgcgcgaccaacttcttccaagccctaatcttcaattggctcacccggaacatgaacctgccagctgatgaaatttgggcagctcacgacaactacacacaactcaacgtcgtaacggaagaaatcgccaaaaagttccaccagcaacaagtcgtcagtaaaagacgacaaatcggacgcgaccagcacttgacagaggtcatcaatgtctggcgtaactcatgcgatcgcttcggtgagctctacaatcaaccggcacacaaacaagtcaagtttcgaccaatcataccagaaaaggagcaaccaagtgactacgaggaatggatcgagcgactcaacaaccgaacggcggaaatcctcacaaaagctcgagcaaaagtgcagcacccgaccttcttgaactacaattgcacaaccattctcatcggagacaacgtggcagaagtgtttaaaccactcttctatgacgccaagtggttcacccatttcccagcagacgaattccgacttatcccgggaccaaaggtcaaacacatgatctttgcctaccaagcaactgccgacaacatggcggctcaaatcgcaccgatgctccaccgatttctgcgatcagacatcgaaatcacactgatcgtagccaaggacgacaatgcgcaatggatcaacaacaagaagtacctgatcgatatcacccgcgaattgaaagcgggcttcttcgttttcaatcgagaaatgggagaagcaagacaaatcgccaaccggatccgacaagccattccggaaccaatggatttggaacaagagctgggaccatcgtcgtcaacaaacacgtcccgacaaggtccatcaacaagccgacaagtgatcagctcgctaatgctgatcagcatgttttgcctactcttcaccggcacggcacaaggactaccaagtcgacaaaagcgaattacgcaagtcaaagcatggcatggcggccatgtttcaaatttcctcaacatcttcacggagcgcgaccgacgggcatcaacaaaatacagtccttacgtccagcgatacatagacaaggttctagcactgaaccgaagtctgagccaatcaacaaatccgccgacatcgacaactccgccatggacaacgacccaacccacaacaaccacaagtcgtccacgcacaacgacaacaaccgcgactacaacgaccacacgcacaacaaattggccaaccagatcaaccacacggccaaccgcacgcacaaccacgacatcgccaatgccatggtcaatggaccaccgaacgacaacagtatcgagggtacggcaacaacaacggccccgtccaggaatcaaattgattcgctggcccaagagcacaatcacaaccgaaaaaggacgcgacgtcttctggtgctcgaatcacggcagcactctctgggaacttaaaggtccggaaaactcgccattctgccgtccaccaccggcacttactgcgcaatggacaccactgaccatcacactgtacaccaagatccaccggccggaaccaatcgcaacggcatggcactgctccatcaaaacgacgacggaaaattattacacaaacatcgtcggcgataagttcgtcgaaatcaacaaagaatttccgttggtctccaaacgactctgccaacgaatggcacatcagcaagaatgcccactcgccaaaacggaaatgcaccacgatgataacaatcgtatttgggcaacaaacgaccaactccaagtggatttccctggaccaatcaccggactcttcaaagggaaacaaaccagctcggcaacaaattgctttgcgcaaccagcaacactgttcgtcaaatggcacagtctccaactcctgtcgccaatccatcgcgcagaccactgcaattacgcctccgagtattgccaactgcaagacaacaactcactcatctggacttcagcatgtccaaacgacaactgcttcatgtgcgacttccaagaagccgaagaaatccacggagaattcaccaagctcaacggtcaaacaacagcattttggatctcggaagaccgacaaaaggcactgaccttcaccgagacacatgcagttcaagcatgcgacgggagacaaatcgtcctatcggagcagaacttcggcattccaaaagagcaatatgacatcatcatgagcaaccacacaagagagagacgcaacgtgcaacccgagcaactcgcttcgcagctttcagctgctcaacttgccacaacaatggcactctcgcagctctatttgaaggaatgccagcgtaatgtgcgtgtcagcaacccaacgcttcagacacggaaactcctcaagcgcgataatctgcaagctcgatggatcagcgaaacaacaatcgaagtgtttccctgcgttccaatctccctctcgaacatcagctaccgaacaacaaaggactgctacaagttcattccggtcacaatacatttgccaaacgcaacaagagatgcattcctcgacccggagatgcgcatcctctcactcatctcaaagatcgcaagttgctcaccatttcgctaccatcaccttcaagtgcaacaaaacccaaccttgtgggttcgaatcgactcacgaaatggaaacgtccaacgactgtcacaaacagtcatccatgagctctacgagacgatcctcaacaaaacggacaacgatttggatctccacccactgatcttccatcagtggcagctcgacaacgacaccgatttcgccagccttccgcacatcgacgaattcgaagattcggaagagttcaaaaacaagctggaacagcaaacaacgcaacgagcgcaagcactcggcgccttacccggcggaatcgaaggatggaccatcaaatggttccaagaacggctacaggaaaccattcaatggtggatacgtctcgcctcagcatactccacattcctccttttccgagacgtcatcctaccatgcttaatcgcctacttcctcaacccaatccgcatcacactcatgactctgattggatttcgaccaaaaaatcagccaacgcctcaaatccaaccacaatacgaggacatgccattgcgggagatgccaagcactccgatccggcggaaacgacgacaattgccagagcaatcgactccgccaatccgactggacacgacgacgggaacggcatcattccgaacacgagcgagagcgcacagcgcaacagaggacacgcccttcggacgcttgcgaccgatgaaactggcggacgactga

SEQ ID NO: 69859 - DNA, 594 bp, Heterodera glycines
  Genomic contig location: Contig_ID=SeqID_1202; Location=1333..1926; Strand=+
  SCN-specific regions: Sequence locations=1-594
atgagtggcaccgataggttgccaagtatttctgcaaatgaatcattttcgattgattctgatgttgccagacgtttttgtcaggaaaacagagaaattgttcaggtgattattttaacactagtctttgaggattttcttcatccggttgttcctttagatttgtgcgttgttggcgtacaacaaaacatatatcgaattgttggatgaattaattgccaaagctgacgaggccgtaagacataacagagatgcgcaaaaggtggtcaaggataagctgcttcgtcctgataacaagccgggaaaacgtcgacggagaaaggatttcggactgcactaccgatacccatacttcagagatgccagtggaatggtaccagcacaaaacatggagtctttggagttgtctcgcgtctgttctttcaacccactgacggaagaagaaaaaaagtgtcagttcattaagaagcttattattgtttttgccgggctcaacttattgttacacttaaattaattaattttaaagggacagaaaaagagttgagggggttgcgagaagccgtggcgcagtcgctcaatgaacaacaaata

SEQ ID NO: 69860 - DNA, 757 bp, Heterodera glycines
  Genomic contig location: Contig_ID=SeqID_1203; Location=174..930; Strand=+
  SCN-specific regions: Sequence locations=1-654,676-757
atgagtggcaccgataggttgccaagtatttctgcaaatgaatcattttcgattgattctgatgttgccagacgtttttgtcaggaaaacagagaaattgttcaggtgattattttaacactagtctttgaggatttttttcatccggttgttcctttagatttgtgcgttgttggcgtacaacaaaacatatatcgaattgttggatgaattaattgccaaagctgacgaggccgtaagacataacagagatgcgcaaaaggtggtcaaggataagctgcttcgtcctgataacaagccgggaaaacgtcgacggagaaaggatttcggactgcactaccgatacccatacttcagagatgccagtggaatggtaccagcacaaaacatggagtctttggagttgtctcgcgtctgttctttcaacccactgacggaagaagaaaaaaagtgtcagttcattaagaagcttattattgtttttgccgggcccgtccgggctcaacttattgttacacttaaattaattaattttaaagggacagaaaaagagttgagggggttgcgagaagccgtggcgcagtcgctcaatgaacaacaaataataaaattggatgccaagtgatttaatttttatcaaagtctttttcaaatgtttttgtttgatagaaaggaggttctctatcggaaattgcgaaccgctggagttgagacgacagacgaacaaatggagaattggcgtggggaagtggagaga

SEQ ID NO: 69861 - DNA, 1526 bp, Heterodera glycines
  Genomic contig location: Contig_ID=SeqID_1203; Location=2061..3586; Strand=+
  SCN-specific regions: Sequence locations=1-327,349-361,384-939,962 -980,1002-1526
atgaaccccaaaaaggacgtcgtctttcgtcattttgccaaaaattacttgtgttgtaaatcacgtcgaacatccgtcgttgacaaattccaacgctatctcgagactgaacagcaaagccaaaaaaatcagctgctctctcgactgggacttggtacttatatggtggattttgcagattatagtaagttgataagacttacaagcagaagcattatacttattttccggatagtttaactatgagttataaccacggtttattttatggaaatttgtattttcttctttaatcgtgtttaagcaaattaaaatttggttaaagaaaatgacaaaattcaatctattttaaaaaaataatacatttgacttaaatataaaaaggattctttcagttagcgccttaaaaatgccttttccccgaaataacagattttgacgctgatgcattaagcatacaataccgatatttagttcagtttggaaaacgagaataccaaaaattgcgatttctcaattttagccacggttaagaattaaccgcaagttagggaatgaggcctcagctgttttatttatgcacccaatttagcggacgtgaaaaaggaacgtgctgagaaatttggtcaatggactgtgaaggggtcaggaagatgggttcgagcgttgatgaaaaatccaaacgaatataacagtgaagatctgatggaagagttggacaaactgcccgaagaaaaacgggaagaggtaaaatgagggacaaacaaccattcccgtattacataatggcattatcaggctatcgaatggcttcacaaatcggatgaacgattagagcaagaaagacaaatggaagagacaataccggaagacccagtggaagcgaaagatttttacgagcgaatgtatcccaaagaacgactcaaagaactttcggaatttgttggaaaattactgaaaccgacacaaaagtatggttgtaaatgaacaaaaaatttaaaatatacgtgaactttgttaagtgatattgcctactttgagcggcacagagttcgaccaggacacatgaaattgaggaaggtaaaaggcacacaaaagaggaagggccagaagcggagaagcggagaaagaacgagaggttggcgaggaagctcaatggagaagacatcgaggaaagcgacgtcatcggaatgcgatggtccgatcggatgatcgctgaaatcaacaaaagtctcgaggaccttccgcaggtgttggtttatccaataattccaatacaaactcacaatcagctgatttccatttaggaaaaacgtcgtgaatttgtggtccgcagtctttgcaacgcggtccgacagcgcgtccatcaaacgaatgtcactctgctgaagtccaagcctgactacagagacaaagtaaagacactggtacacgattacattgaacaggtggtcaatttaagtcgtttttctgtgattttacaagatttaattcaggtggttaacgatccaatagtgccaaagcca

SEQ ID NO: 69862 - DNA, 260 bp, Heterodera glycines
  Genomic contig location: Contig_ID=SeqID_1204; Location=2235..2494; Strand=+
  SCN-specific regions: Sequence locations=1-260
atgagttcaattctcttcttccgaatgcgtgaccaatacttaaacttaaacccaaacttcgcgcaacttttagtgagcgtagaaagaatgttggtgaggagaattcgatcactgcacaacaatgaaatggttttgccttgggcgttttctttttttcgccgggattttaataaatggtttgtttttaattaaaaaaaactgaaactatataaaccaattttcagtacttcctgcttctaattccctatttcgtctattaa

SEQ ID NO: 69863 - DNA, 112 bp, Heterodera glycines
  Genomic contig location: Contig_ID=SeqID_1204; Location=3148..3259; Strand=+
  SCN-specific regions: Sequence locations=1-112
gctggttctccattgccttttaagcgccccctcgggatgggaggagccctatcggagagataaaatgtggggggggggaagggtaaaggccatttccggtcccggccttaca

SEQ ID NO: 69864 - DNA, 1504 bp, Heterodera glycines
  misc_feature (1497)..(1497): n is a, c, g, or t
  Genomic contig location: Contig_ID=SeqID_1204; Location=32..1535; Strand=-
  SCN-specific regions: Sequence locations=1-73,95-353,376-420,443 -656,678-702,726-776,800-879,917-1055,1077-1504
  Gene Ontology: Mol. function=bile acid:sodium symporter activity; Cellular component=integral to plasma membrane; Biological process =sodium ion transport
tttttgtcacttgtttggtgtgcttgataacaattgcaaatgttctcatgggatgtgaagtatgtcccatattgtaaaatcacatttatcaattaatataaaaatcaagtcgcaattcgtttagcttgacctcaatgttgttttaacatcggtaaaaagaccggtggctccagcaattggcttcttcactcagtttatcattatgccattggttagcctttcgaatttgtcaagaatttgttcctattttaatttgagtgtcttgtaactttagttgggctacaccatcgccctgtttctgttctccgatgataaccgtagaacccatttgctggcactcggtctgtttgtcactggctgttcccccgggggaggtgccagtaattattggactgtcctactcaatggaaacgccaacctgtccgtgacaatgacatttctaagcacaattggagcgttaggttcgtcatttggttcccctttcgaattgccctttttatcgtcttatctctcccatttagttgccatgcccttttggataaatgtgctcggaagtcgaattctcaagtcaatttacctgtctaccgactttgcgactccctccgaaagacgttccgtgtttattccatatgccaaaatagtggcctctttgctcatgttggtcattcctcttctcattggtctgacaatcgccaaatacaaaccaggaatggccacaaaagctaaaaaagtaagaaggaccatctatcaaaacattaaattttttgtaattaagctgatgagacctttcatcattttcgttcttgtgttcatcattatctttggcatctccattaatttatggctttttgctcaaattacttggaccgttcttttagcgttagttttttaatttaatttaattgcacttaaatataaaaatttgtcagtggcctgcttttgccatggtgcggcttcatgttcggctgtttctcttcaataattttggcacaggcgcctgctgatgtcactgctattgtaaaaacattcaagcgcatgctttaaccattttaaaacgatttatttaggctattgaaactggcgttcaaaatactgggatcgcaattatgctgctaaaagtaaacgattgtctcatttataatttttattcaaaattaagttgtcttttcctggcgccgactcggaccttgcttcggtaaaatggttccatttaattacattgtttggttcactttttgctactctcttaagcttttgccaatttctgtcgcctgttttacgcccggccctcttctgcttggctatgccatcccttcggcaattaaacgaattcgcgcaccgcggcacgacgattcggtaacaattcgcgtgtcgcccgactgtgacaaggtgctcatcaacactttgtcagcagccacaaaaaatagtgtcattgttcggtaggaataccaaagaagaacctcatgagcttttgacttcacacagatctgttgactntttgcgt

SEQ ID NO: 69865 - DNA, 2817 bp, Heterodera glycines
  Genomic contig location: Contig_ID=SeqID_1205; Location=595..3411; Strand=+
  SCN-specific regions: Sequence locations=1-228,251-714,736-761,810 -1004,1040-2423,2447-2472,2497-2627,2665-2817
aaaatgcgagaagaaattgagaagaatgaccagcagaagccggaaaaggcaattgaaacgacaattagcgcaaagaaaattttgatggccatcgattgcgaatatgttggagttggactgaatggagcggagaatatgttggccaggggtaagaaaatggagagaaattacttaattgcaaagcccatgcaaattcagtatcaattgtcgacgccgaaggaatcgctgtctatgacaaatacgtcaaaccggtgggtggccaacaaatttgaacttgacaattcgaaatggaaccgaataattctttcattttggttatttattggaagacaatgttttaagaccgaagaagtggtcgattaccggaccaaagtgagtggcattaggcccggccatttgctccgtggcgttccctttgtccaagtccaaagcgaagtgaggaagctgctctcagacaacattctgatcggacactcacttcgaaacgatttgactgtacgcatcattttctttatttggttgaattttcttttttctaaggttcttggcctcactcatccccccaaacttatcagagacactgccaagtttaaattgctcagagaaacgctcgacgactccacaaaaacgccttcacttaaactgctcgcgcacaatttgctcggtgttcaaattcaacagggcgaacacgactcaattgtggacgcaaaaattgccctgagaatttatttaaaatatcgagagaagtgggagagaacgctaaagaaaggaggcaaaaaatgaacggagagaaagagagagaaagaaagtcagtgaccgattattttgtttttgttgtttgttttgtcaaaattgcgattgcctttcattttcaaagtcagaaaaacactgtaaattataaaattcctaaaaaaaattcaatacaacgagaattataatcggtgaaatatttagagattttaatattttttacttatttcatgtttattttaaattgtaaggctatggaacaaaacataattttgaatttggaaaattcccgtcattttcaaaatccattcctgacaaatatagccgacagctcccgatacgttagtcgtgattggattttgcaaaagttaaatgaattggcgcaacgaattgtaaagcgaagaattccgacgagtgaatacgaagagggtaagacattcgaaatgcgcgcgattctttcccaattcattcccttcgttttcatcagatggtccttacgttggcccctcgggcattgcctatgctttggtcagagtgatgcgacgaattgggcaaaatcagtcaaattttggcgatggcattcggacaattttggcaacccaaaaagactttctaaatcatcaagcgaaggtgaagcggctgtccaaatttagttgaaacagtgaacaatcagatgaaatccgactccggcccgcacaaatgccgttatttgaccggcactttgggctttttaacggtccgaacggtcgtcgattttcacctgtccaacggggcggacatcgcctcgctctcggcacactttcgcaatttgctaccaattgttctccgtccgggttatcagcaaatcggggacgacgaaatgctcaatggccgtgccggctttctcgcctctttgcttgaacttcggtgggtgcggtagggtttcgtcaattcttacatttatggggctttttcagtttactttttggtcaacaattactttccgacgatgaaattcgttctgttttggatgctatggtttcttccggcagaaaatggtttcttccggcagaaaatactccaaaaagcacaaatctccggccaaactgatgttcgaatggtacaacactgaataccttggcgcggcgcacggcgtcagcggaatttaccaaatgatgttaaggtgagtgattggacagacgaagtgtgatcaatcaatcatccgtcatttggggctttattgtatgcattttgcagcttttgggacttgttggatgcttctgcaaagtcggatttgaagcaaagcgtcgattggctgttgagcacccaattttcggatggcaattttccctcgtcgtccgatcgaatcggtgcttttccatttgtgaaatttgacacattcttccattcatattttatacttcaatttcctccgcaattccaaaggattgtctgaggaactcgtccattggtgccacggcgcctccggcgttttgcatttgctcatcgtcgcctctttggtgtttaaggaggacaaatatttggaggtcatcgccatttattgcccttgggaatgccaattttatcaaaattcagtcggctgaacgatgtgtcaatctcatctgggcccgaggaattctgcgaaaaggacccggcatttgtcacggagtggccggtgaattgtgagagaatttagagagagagagaaagagagagaaatcgggcgggtgaataatagcactgaataattattaatttaattaaaaagcaaaggcatttccaatgtttgtgttgtcttttcaggcaatggctacgcttttcttctcctcttccgactcaccaaaaatgacaaattcctgcaaatggcccattggttcgccttcgtaatgatggccccctcttttgaggtgtgtctcttcctttgctgtgcctttctgttcgaatcgctccgtccctttcccttaggcgtccgcccgtgtccccgactgtccgtcgagtcttttcgaaggatgggccggcgccctctgttttctcgccgaccttttggagccaacgacggcgcaatttccgctgcttccgattcccttc

SEQ ID NO: 69866 - DNA, 481 bp, Heterodera glycines
  Genomic contig location: Contig_ID=SeqID_8971; Location=558..1038; Strand=-
  SCN-specific regions: Sequence locations=1-30,52-148,175-285,316 -366,391-481
tctcaattcagtaacatcggctaataattttgaaatgtccgcttgcatctgtccgctgtgtgatacgtcgcttgcggcgggcttggccaagttggcaaagtgccaacacattggccatggcccgtgtctttctgcccatgtcagcaagcatggcttttgcccatttttcaattgcgcaatgccgacgacggaggacgaagtgttgctcattacgcacaccgagggaaaacaatccaacaattttgctggcctggtttggcattcttttgagaaacggggaaatccattaatttattaattaaattgatttaattaccaaatttaattggccatttctaatttataccccctccccaccctaaggctatttaaaacattttttaaaagtaattgtcggcacagaaaaacgcaaatggcaaaagccgaattttctaacgaatttataaatttgtgcacagaaagatgccaaaaatgtacgcga

SEQ ID NO: 69867 - DNA, 513 bp, Heterodera glycines
  Genomic contig location: Contig_ID=SeqID_8972; Location=41..553; Strand=-
  SCN-specific regions: Sequence locations=1-246,269-513
atgagattattaaaatttaattttgtccattattcgacaattcgtcagagtaagttgtccccacagagatgttgatcgtttcgtgtttcgtattttcgtgttttagggcattttgtgttcgtgtttcgtattctgacacgaaacacgaatatttttatttactggcatgattggggggggggaaagacagaatgttgtgaattgcacgaacgcttggccaagctaaaagtgtatgaacgcttggacaagacaaaggtggccaagaagaagaagaagccgaagccgaacaatttcaagcagcttgacgccgacttcggcaaggccatgatgacgaaaggcccggtgtttgtggaggatttcatcaaagctatcctcctctgaaatctgatcacttgctaatgacgtgctaattaatgggggagaaggcggtaaaacatacaaacataaaatgaaaattgaaattttcaaaaaatgaaaacccgtggaaaaaaattgaaaaatattttcattaaa

SEQ ID NO: 69868 - DNA, 220 bp, Heterodera glycines
  Genomic contig location: Contig_ID=SeqID_8972; Location=3669..3888; Strand=-
  SCN-specific regions: Sequence locations=1-220
atgccgtcgtgtttggcaccgttcgttggcaaatgcgaaccctgcgtccccgagcagtgcaacatgaagagcatcgaactgcactatgcaaacaaatcgttgccccgacagccgggtgataacggaggaggcaataagaagaaggacaacagtgggggccacgctgagggcgtggctgtcacggcaattattggcatcgctttgctgacgctttttggcg

SEQ ID NO: 69869 - DNA, 1133 bp, Heterodera glycines
  Genomic contig location: Contig_ID=SeqID_8972; Location=590..1722; Strand=+
  SCN-specific regions: Sequence locations=1-253,275-505,527-1133
atgccgaggtgcgcgagcgaaggtcggagcgaagcgtagcgacttgccaaaaggttagagacagccgatagcaatgcttgaacgaaaccgcctattttctattattttaaaaacataattttggattaaagttttctcatgccatttttctgtgtttcaaattttcaattatttctggtttttgagcctcaaaacaccattagaattcattttcgagttctaattcgaaattcatccgtgtctgaattgccgaaattgtaaaaatgtcagaatttttgcaaatttagcgattttaatttgctgctgactccccttgccacctgtcttctccttctccttatgcttacgtcaggcttctttcgtttcaaaatgccaataatattaattatcaattttccatttcgcattctctcggcgattctttccatccaaaaataatatttattcattcatttacaatttcctatcataatgaatctatttctgcgcctattaatttttagtcaaattttgaaatttaatttttcgaaaggggcaaaggtggagaaactccgaattcgcgttgaatgcaaaagtgagaactcaaatcgggaagtcagaattgatttgcgcgtgatttacgggatcaatggcaaagtgtctggaaaaacacaaatgaacataaattgtgccgaggaatttggcatttatttgaacaaaaaagttgacaaagacagattcaagttcaattttgacatttttacgaaaccatttgacaacgaaattgtgccgtcgaatgaaagcagcgaaaatccccaaacagagggagaagaacagcaaattgtggacgacatcctccgctaagcgatacacagagtcgtcaaagtcgagctgttcaggccgaacttctcgcggctgtacgtggtcaatttgggcagtgccgaccccccggggcggctcaattggaaccgaagggtttttgtagaagcggaaaacgatacgggcaattaccacgcttttgtgtatgctgctgtggacaaaaatgagcgaattctcctgggatttgcgccatttgtgaaaattgagaatggcaatgagtcaaacgcaccgcaggcaaaaaaaacaaaaaaaaacggatgaaaaaaaattataaa

SEQ ID NO: 69870 - DNA, 885 bp, Heterodera glycines
  misc_feature (588)..(588): n is a, c, g, or t
  Genomic contig location: Contig_ID=SeqID_8972; Location=2442..3326; Strand=+
  SCN-specific regions: Sequence locations=1-122,167-214,236-348,370 -403,425-660,685-706,728-761,810-885
atgttttattacaaggcacatttaggtttaaacaggtccaatttccgatatgtccgttgtgcaaacaaacggccaaatatgaaacggtaaagaaaacaagccaaaccattcataatagcacattttaaaatgtaaaatttcagagttattaaatggcaatttatttctaaatttaagtccggcacattcccaccgatttttgagagttctgccgaaacattttcaaattttcatatgaattcaattggagaattatttcgaattgggagagaagatgaaaatgagtttttaaggacacaagcaaaacatcagattcaagcaatcgttgaccagttaaataattcggcaaaaaattacaaaaattttctgagcaacacaaatttgaaacatttggtgccctttttggaacaaaagttttttgaaattggaaccgatggatttgtggagacagaaattgtcagacaaattcgaaatttgttggaaaattttattaatgaacagcagcagaagggtggaaaggaggacattgcaattgcacgatatttgttaaaattggcttcagcctcaaaaattgccccaaaattcgcnaggcgaataacgcaattgaaaagctgaaaattataagggaagagcaatgaaaacgaaagaaagaacaaatgagcattttttgttgttaatttttaagtttctgttgagaaagaaaattttcaacaatttcattttccatattttatgataaattaaattcattcaagcgaatgattaatttaaaaatggaaaaatatttaaaaatttatttaattaaaaatggtagataaatttagggttgggcccgggcagacgacacctttgtcgggggcaaaattttcataaagtcggaaaaaa

SEQ ID NO: 69871 - DNA, 775 bp, Heterodera glycines
  Genomic contig location: Contig_ID=SeqID_8973; Location=1636..2410; Strand=+
  SCN-specific regions: Sequence locations=1-132,154-189,224-643,676-775
atgacaaaacctagaagtaccaaaaattcttttaaatttagttttcccaaaaaatatttaggaataatttcatgttaaactaaatttgtttactgggaggaggcgaattgcctgctccttcattaactacaccaccttcttttcctccaggaaccgttttgccgacaaatccgcgtcaacgccgtacgatgggtggcactgctgcagccactggaaagcagaaaattcaaatagataaacagctgattcaaggggcccgttaattggagagtccaggtaaacaaattagtgaaatataaggggtaaaaattaaagctgggcgaaaaacccgggctttcaataaatgccctccgccacctccatgccgtcgatgggcgaaatggtaaaggaacaatgccgacggcgacagtctaaacagaagcagcaccgtcgcccattgttgtggcggtcgcatgcttcggtgccgttttcgtcattgatttggtgccaaagtttttgtgggccatcgaccggcgccgccgactttgccgattgttgagacaaaagctccatcaaatttgtactgttgtgcctttgcataaaaaatgttcaaaaagaatcgagtaaaatggaaaaataaatatttgaaagcaattaactgtccataaaaataacataattaaattaattattttaggaggaatgaaatcgaaaggaaaaatgaagtgaacaaaatggacaggaaagaattacaagaaaaacaaatattttggctcatctgagactgatcgacaga

SEQ ID NO: 69872 - DNA, 319 bp, Heterodera glycines
  Genomic contig location: Contig_ID=SeqID_8973; Location=1771..2089; Strand=-
  SCN-specific regions: Sequence locations=1-231,266-319
atgcgaccgccacaacaatgggcgacggtgctgcttctgtttagactgtcgccgtcggcattgttcctttaccatttcgcccatcgacggcatggaggtggcggagggcatttattgaaagcccgggtttttcgcccagctttaatttttaccccttatatttcactaatttgtttacctggactctccaattaacgggccccttgaatcagctgtttatctatttgaattttctgctttccagtggctgcagcagtgccacccatcgtacggcgttgacgcggatttgtcggcaaaacggttcctggaggaaaagaag

SEQ ID NO: 69873 - DNA, 442 bp, Heterodera glycines
  Genomic contig location: Contig_ID=SeqID_8973; Location=2305..2746; Strand=-
  SCN-specific regions: Sequence locations=1-93,118-316,338-442
gaggagacaacgcaaggattgtttgaagacaacggacttggctgatgatcgaccacactctaatcagatcagcagaaaaagcagtagcatcaatcattttccaacttttttcttccctaattaacccatttttcgtttcaatgtccaacaaaagttgtattttgtgccaaaacaccttaaattttcgtttatggcacaaaatgacaaaagcattttgttcaccgtcccttaattacctgaaaatgtttttagttcacaccaagcctaatgatcactaattctaattacctatcatttcttttccgtgatataattgcactgtcttttttattttattctgtcgatcagtctcagatgagccaaaatatttgtttttcttgtaattctttcctgtccattttgttcacttcatttttcctttcgatttcattcctcctaaaat

SEQ ID NO: 69874 - DNA, 338 bp, Heterodera glycines
  Genomic contig location: Contig_ID=SeqID_41824; Location=717..1054; Strand=-
  SCN-specific regions: Sequence locations=1-338
atggaaatggcacaagatggattgaaaaaggcaaaggctgttaatgatgggcataagaaagaggtgccggcggctgacgctcaagagtcttgagtgccaaaaatggattttttcaattaattattatttcaggcagataaatctcatgccagtccaaaattagatgcaattggagtttaatgaaattattaacaaacgaggagtcacgggggttaattagtgagcgcggtctcgaagcgatcggaattttagagaaatgccaaatatggtaacgatgagagtaatgatgctcgagagtctcgtagaagggccacatttcgaaatatgtgcccattaaa

SEQ ID NO: 69875 - DNA, 288 bp, Heterodera glycines
  Genomic contig location: Contig_ID=SeqID_41825; Location=23..310; Strand=-
  SCN-specific regions: Sequence locations=1-27,134-288
atgccaacagccggagaaattgtgcacgaagaaaggcagcaggagaagatgaagaagacgaactttgaagaagcaaaggaagaaaaagggagaaaaggaacgattaaagggggaggaagaagaagcaaacgaaagcgatgccagcgcaaccgaactgcttcatgttcatcggaaaaggaaaagcaaacgcagcaattcgatggcattggcggtgccacaccgccgcgacagaaacggcactttcctcaagcggcggtggtggacaatggcgccagaagagtgacaaaa

SEQ ID NO: 69876 - DNA, 627 bp, Heterodera glycines
  Genomic contig location: Contig_ID=SeqID_41826; Location=190..816; Strand=-
  SCN-specific regions: Sequence locations=1-49,71-94,116-434,485 -501,523-627
atgatcattgtgaatattgtagagtaagtgacaaaaaaaatgggtgaccacaaaataaaacaacaaaaatatgaattgattttaatctcttacgaataataataataataattttcacataatgcgaaagtttttacggtattaaaaaagtattaatgacacctcgtacaattgctaaggctaggcctaggcatagacttaagcttaggctttattttgtaaaatctgtgttgacttttatacgagttgccattggccccttaaaaaagttaatttccatggcccaaataatgacctaataattgcaaaaagggaacaatgcgtgtttagttaacaaaaggtcaatttagcaataaaaagttggaatactctccgaaaagtttggaattcgtctttaaaaagcaaaaatttcattttcattcaccaattttacgatttatttatttaaaaaatcattcattttaaaattatttatttttttttacaataaccagtaataaactacaaattattatgaattaatgaaattttagatcacaacgatcacataaaaagaatattttttttctaaaaatattccctttttttataaactacaaattataaaacgtaaaatgtgttaataaa

SEQ ID NO: 69877 - DNA, 512 bp, Heterodera glycines
  Genomic contig location: Contig_ID=SeqID_41828; Location=99..610; Strand=-
  SCN-specific regions: Sequence locations=1-110,133-395,432-512
atggattttgcaggctgcaaaacggatcagattttggacatggacatgttcctctacgacacacaaccagctgtaagcaattaagcgaagaaaaagcatcggtttgaccaccccaattattttttaaatttagactctgtccggactgaatgaagaattcatttccggcgctcggctggacaatttggtctccacgtacaccgccatcaaaggacttgtcgaaagtttggaggacaccgacgctcttgacgcggacccaaatgtgcgaaatcagtaattgtctcaaaaatactgaatccggtcgtcccctcccctccccccccccctcgataatttctccctcccggatcatttcctccctgaaaacttacatttaaacagaatttttttttcactaaaaatttttgtttaaaatttaattttaaaaaaaaccgggtgaaacaatgtgagcgaaatgaaatgcacccgtattcggggacatgttcagaagggatttgggcttggacaataaa

SEQ ID NO: 69878 - DNA, 401 bp, Heterodera glycines
  Genomic contig location: Contig_ID=SeqID_41830; Location=329..729; Strand=+
  SCN-specific regions: Sequence locations=1-29,68-301,330-401
atgtcaaaagaaagggccactgctattgttgtgttttgttggtcagtgttttgtgcttttctttctttcccattgtttttctcttacttccatttttcttcagtcttcttctcatcgctgctgctattggacttgttttgcttacgctgtatcttttacagaggcgccaaagaaaggctttagctgcgaaactgaacgctctacagcaacatgcatttgacccagtaaacgcagagtcgtcaatgtcgcttaatgctgaacacggagtggaagtgccggattccttacgctcgggagattccgatgaagacgacgacgaggactacgacgctccacctgtaatttcgtctcgtgcaaaggcagcgccgccacccgttaatgaaaaggcaaagaaaggatag

SEQ ID NO: 69879 - DNA, 673 bp, Heterodera glycines
  Genomic contig location: Contig_ID=SeqID_8974; Location=100..772; Strand=-
  SCN-specific regions: Sequence locations=1-13,56-351,373-376,418-673
atgaatttgtggcatttattatttattatatttttctttatttttgtaattaaatccggcaaaatccaaccaaattttgaagaaatatttggccaaagatgggacaaaaatgaaagtgaagaaattgtgataataaaaattgaacaaaacgaccaaaaggagcaaaatgaaactacgggcattgatcaaattggtggagaaaatggaacggacccaaatgatcaacaaaaaagacaaataattttgaaatttgaagcaattaaagaaaagctgaagcaaaaaggaaaatacaaaaggaaagaccaaggcaaaattgagagaaaaattgcaaaattattaggagcaaatctgcaattaatacaaaaatggaaaaatgaattaaatttaaataaaaacaaaataaaaaaacaattatatgatgagaaaaagagagaattcattgaaagatttgatgaatttaaagaattatatggccaaggcaaacagaaagaatttgcgaaggaattgggcatttctgaagacacatttcgaaagtggaaaaaagaattggcaccaaaataccataaaagtcaaagtagaatataattttagtaaagttaaatctaatttttatttaagagcaatataccaatgcggacaaactgaaaaagatgaagcaatattttaaaataaa

SEQ ID NO: 69880 - DNA, 513 bp, Heterodera glycines
  Genomic contig location: Contig_ID=SeqID_8974; Location=1270..1782; Strand=-
  SCN-specific regions: Sequence locations=1-181,204-230,358-410,434-513
atgggacaaaaaagaagagaagaaaaagtgataaaaattgaactaaatgaacgaaatgagaactcacaatcagcagttgatcaaatgggtgaagaaatgggaaatgacccaaatgatcaaacgagaaattacacggacagaacctttttaaaagtgatcagaatataaatgatcagcaaaagagagaaattgtcaaaaaatttgatgcaattaaagaaaaattacgtgaaaaaggtaaatacaaaagaaaagatcaaagcaaaattgagaggaaaattgcaaaattattaggaacaaatcggcaattaatacaaaaatggaaaaatgaattgaatttaaataaaaataaaataaaaaaggaattttatgagatgaaaaagagtgaattcattgaacgatttgatgaatttaaagaattctatggaaaaggcaaacagaaagaatttgtgaaggaattgggcatttctgacattgataaaatggaaaaaagaattgttgcctaaatacaataaa

SEQ ID NO: 69881 - DNA, 164 bp, Heterodera glycines
  Genomic contig location: Contig_ID=SeqID_41832; Location=310..473; Strand=-
  SCN-specific regions: Sequence locations=1-164
atgtgtcaagaattagcagaagaggccaaacaatcaatcgaaatagccaacaattatcggcaagaaattgggcatatttatcggaccgcttactcgcagccagatttaggtattggagatttggcaaataaactaaaagaaacaatgcgcgaaaaccaaatacg

SEQ ID NO: 69882 - DNA, 458 bp, Heterodera glycines
  Genomic contig location: Contig_ID=SeqID_41832; Location=862..1319; Strand=-
  SCN-specific regions: Sequence locations=1-458
atgcaaagaatcgctgaaattaaaaatttcgagattattgaaggcggaagagtttttattgtgagagtgagaattgagaacgtagtacatgtagagtacagggtttgtattaaaaatgaaaaaaatatatcagttttttaaggcttgcgttttatgccgtaagggggtgtgttcatgtggcgttgagaaggcactgacaccttatttgaaggtgtctgtggcagatgatactgggattttggaaaatgtggcattttttgatgtacgtgggaagaaaaacggaatggtaatgttttaaagaaaaaataccattctaatttaaattcaggaggagttgagaggattgtctggggccgtgtgcaccatgaaaatcggcgcgagggtgaaagaattcggagggaagaaggggatctattactctttgattgatattgtcagcctttaaatctataaataaa

SEQ ID NO: 69883 - DNA, 59 bp, Heterodera glycines; identical to SEQ ID NO: 52421
  Genomic contig location: Contig_ID=SeqID_41833; Location=181..239; Strand=-
  SCN-specific regions: Sequence locations=1-59

SEQ ID NO: 69884 - DNA, 59 bp, Heterodera glycines; identical to SEQ ID NO: 52422
  Genomic contig location: Contig_ID=SeqID_41833; Location=311..369; Strand=-
  SCN-specific regions: Sequence locations=1-59

SEQ ID NO: 69885 - DNA, 59 bp, Heterodera glycines; identical to SEQ ID NO: 52421
  Genomic contig location: Contig_ID=SeqID_41833; Location=441..499; Strand=-
  SCN-specific regions: Sequence locations=1-59

SEQ ID NO: 69886 - DNA, 59 bp, Heterodera glycines; identical to SEQ ID NO: 52422
  Genomic contig location: Contig_ID=SeqID_41833; Location=571..629; Strand=-
  SCN-specific regions: Sequence locations=1-59

SEQ ID NO: 69887 - DNA, 59 bp, Heterodera glycines; identical to SEQ ID NO: 52422
  Genomic contig location: Contig_ID=SeqID_41833; Location=701..759; Strand=-
  SCN-specific regions: Sequence locations=1-59

SEQ ID NO: 69888 - DNA, 59 bp, Heterodera glycines; identical to SEQ ID NO: 52421
  Genomic contig location: Contig_ID=SeqID_41833; Location=831..889; Strand=-
  SCN-specific regions: Sequence locations=1-59

SEQ ID NO: 69889 - DNA, 59 bp, Heterodera glycines; identical to SEQ ID NO: 65013
  misc_feature (48)..(48): n is a, c, g, or t
  Genomic contig location: Contig_ID=SeqID_41833; Location=961..1019; Strand=-
  SCN-specific regions: Sequence locations=1-59

SEQ ID NO: 69890 - DNA, 628 bp, Heterodera glycines
  Genomic contig location: Contig_ID=SeqID_41835; Location=324..951; Strand=+
  SCN-specific regions: Sequence locations=1-191,213-248,270-306,329-628
atgttagatttaaggaaatttgtctcttttgcgtacgacaaatccccctcagggttagtcgaacgtaatgcacggccctttccttaatctctacgttccctcttctcgctttttaataaaattctcccatttatttgtaagtgatgaaaagccaccgccaaagaagtatctgaagactgagaaggcacccgtggccaaaaaggagagaaatgcaaagaccgcaaaaccagcgaagaacagaatcgaatcagactctgaagaggaggaagtgtcgttgagttcggaaagtgatgcctccgtttctattgatgatggcgacgacgatgattatgattgataacaactgtttaactcttccctcccccatattgcttgtgtattttcgattaaatcttcgatctcttttggccagctgacttatttcgattaaatttcttttttttcacgtcgaacctggttctatacttccttagtttatcgataattggtctatatgttttggtgtggcacacttaattttatgggcccatctctgctggttacgtcttcgagtgatcgattcatatttccttccccccatttattcgtcactcaaaacgactaaaaatgtaaaaatggggagaggaga

SEQ ID NO: 69891 - DNA, 569 bp, Heterodera glycines
  Genomic contig location: Contig_ID=SeqID_41837; Location=83..651; Strand=-
  SCN-specific regions: Sequence locations=1-139,162-355,379-430,453 -521,543-569
atgcgccgcataaaagtaagtgaaaagcaacaaaaaacgcccctgcctcgttccatggatggtaaaaaagaaaaaaaaattggcaaaaaatattttttatggataattatagaaaaaaattggccttctgtcatatttactttttatctttatttctctcaattttatgtactatctcttcgtttttaataatgtaatgaacaacatttaggtacttcatcttgtttaactttttttctgcttgttaaatccacaccaaattttacatatcgatagagaaaaggaaaatgtgcaaactttcagtgttttgagtaaaaattttggcctagaaagttattcaattcgcatttatctgaaattttttaaattttttattatggctaaaaaaataattgcttaagcttcaaggcagaagaggtgctgaacaactgaaaaggcgagaggaaagaaaagctcagacggagaaggcgagacaagcctatctggctaagaaaagtatgtttttcaacggatttttaggtcctaaaatatttcaaactaatttcagcagtccaatagcaacaaattga

SEQ ID NO: 69892 - DNA, 139 bp, Heterodera glycines
  Genomic contig location: Contig_ID=SeqID_41838; Location=1..139; Strand=-
  SCN-specific regions: Sequence locations=1-139
attattattttcggaatggcacccgtcaaaaaaaggaaaaaactttcctccaccgaccaccgccgccccatttctgcaactgttacaaatcaacagaaaccgttgggttcttttgtgacatttggaaaaccggcgaagt

SEQ ID NO: 69893 - DNA, 138 bp, Heterodera glycines; identical to SEQ ID NO: 50950
  Genomic contig location: Contig_ID=SeqID_41841; Location=518..655; Strand=+
  SCN-specific regions: Sequence locations=1-138

SEQ ID NO: 69894 - DNA, 640 bp, Heterodera glycines
  Genomic contig location: Contig_ID=SeqID_8977; Location=291..930; Strand=+
  SCN-specific regions: Sequence locations=1-16,38-58,80-640
atgcttgcaccttccgttttaatcattcttttatttggacttagtttttccatcaaagtagaaaagaagaaagagggcataattgtgactggccagtaagttaatgttatttttttacataataaatttagtccaaaaaattatgaaacactaaaacacgggctgacaaatctagaaattatatcaataaaaggcttaagcataggaccttctctcgctttaaacgtgctataacattttcgaaatagatgctaattatcagtctcggatgccattcgaactttattgtcattaatcaattcacagcccgtcacaatcgccaaaaatgagccctacaaatgttttggtggcaccggcttcaacacagccattgactccatcattggtaacaatcgcttcgccaacaacagtctcttccgggttcgatgttggcatcattatcttgctcttttgcattttgataatcgttgtcattgtgatgtgcctactgtgccgtctcttctaccgtactcgacaacaacagttcgtgccatcaaacattgtgccatcgccaactgtttcttcgccgcggatgccttctgctagtgtgctattgccaataacaagttccgtgccaatgccaatcctcatcggctgctga

SEQ ID NO: 69895 - DNA, 1322 bp, Heterodera glycines
  Genomic contig location: Contig_ID=SeqID_8977; Location=2499..3820; Strand=+
  SCN-specific regions: Sequence locations=1-168,198-297,324-359,396 -506,542-746,818-871,914-942,1060-1300
cttctaaaaatttatattgcaatatttttgcaaattgtctttaacaatttgtttttgtcatgccatccaaactcagattattcagaatgtggcatttcggactttgagcctctgttggccaatgtgccaaaaatggaaatcggaacttataatgtaaagacaaagaatttaattagtttaattgaaataatttattctatttctttttgaatgaattaattaacaggtatacttgggacaagcggttgagaatgacaattctttgccgtggatggcctcgcttataaaaggaggaagtattaattttattataattaatatatctccattatgaaaaaataatagctaaaaattgaccgtttttaaaatttaatcaaatttttaagaatttaaatgctccgcaacaattatcgggccaaatcacattttgacggcgatgcattgtgttaagggcagagattttgatattggtgagaatttcagaaacattattattaaatggaaagtattttataaatttttaaaaatttattcaattttagggttttaaaatagtttaaaaaatgccgaattaaatttttaacagaaaaactccgaatttcatacgggaatgaatatgtttcaagccaaccgtataaatctgcagttgtttccatacaattgtatccaaatgcgaaatattatcgaatttatgataattttggcgatgaaacatcaagggcagatttaattttgcatgacattgcaataattaaagtaattgattaattaaatatttatgaataaattaatcattcaaatttatttagattaaaaacccaattaaatttacatcaaatgttcgaccaatttgtttatttggtattggtggtaatttttaataagtttaattcaattaaattaatattttttacccaataagtcttaacacaataaactcccaaaataattttatatttaaaaaaaaattattttgttagttttttgtaaaaaaaaatgtttaattgatgttaatatattttttgtaatatttttacaaaatgatttttaataatatttggttttcaatgaaaaaacaaaactttaagattcaacgcgcgcaaaatttctggtgagaaattcaaaatcagaaactaccaaatttattattgccggttggggaatgactcggccacagtgcgcgaaggaccaaaataagactcgaaatgatcaattgaattatggcaaaatgcgaatgatttcgacacaaaaatgccgagaaatggccaatgaacaaaaaaataggagttgttagatttacttcatttttaattttaaattat

SEQ ID NO: 69896 - DNA, 650 bp, Heterodera glycines
  Genomic contig location: Contig_ID=SeqID_8977; Location=792..1441; Strand=-
  SCN-specific regions: Sequence locations=1-650
atggcacggcacggccaattggcgatggtgcccggtggtcacggaaaggcgaagcggaacaacttggagcaatcatttgcggacgatggtggtcaaaagcatatggcattgaaggtggtggcaaaaactgttgttcgttatgccgagatggggcaaaaatttgagttggaattgggcacggtgagtagtccgatgatgaagagcagcattttggcatgggaatggccacacactgaatgaaagttttaatcgcaaaatttactaaaaaattttctctggcgggctgtaaaataacaaaatttattcaaaaaagtaacaaaattaggctagatcaatattagataaaaagttttaaaatccaaaattcttgtcaaaaaatagaaaaatatatttaaaaggatttttgatgaaattttcattaaaaaacctaaaaattggagccctattgctaacctgatgctgaagagaggctgttaaagtttgaattggaatttgagactgtgctgaatggtcagcagccgatgaggattggcattggcacggaacttgttattggcaatagcacactagcagaaggcatccgcggcgaagaaacagttggcgatggcacaatgtttgatggcacgaactgttgttgtcgagtacggtag

SEQ ID NO: 69897 - DNA, 952 bp, Heterodera glycines
  Genomic contig location: Contig_ID=SeqID_8978; Location=96..1047; Strand=+
  SCN-specific regions: Sequence locations=1-35,81-130,157-171,325 -540,595-952
atgccaaaggcaactttgcttttgcatgacattgcaataattaaagtaattaatttaaagtataattatcattataatttctgttaatttaagcttaaaaagacgattgaatttgcaccaaatgtccgaccaatttgtttgtttggttttggtggtgattttgaaagtatgtataataaataaaaaatcttattttattaaatatatttaatttaatataaatacttttaataagatttggattaaaacccaattttatttatttaaaaaaatcaaaatctaaaacacaaattttttttttatataaaataatttgaaaaatatgtggacctttgcatctatgtaaattttaaggttcatccgacgaaaaatttctcgaggataattcaaaaataaaaaattcacaatttattattgccggttggggactgacttggccacagtgcgcgaaggaccaaaataagactcgaaatgatcaattgaattatggcaaaacgcgaatgatttcgactcaaaaatgccgagaaatggccaatgaacaaaaaaattgtaaattattttagttttattttaaatttttaataatttaatttagcatttgaatggtctgctggcgatgacgatgcaattgaatcgattgaatcgctgttaaatgaatttgaaacatatgggttggacgacaaaatttgtgtggtgcccgagccgagcattggcgaaccggtacggtagaattaatactgtacaaacttactgtatacaattagtaggggaaatgtatagaatgtgtaaatctttaattgcgattaattgtttactctagggtgacagcggtagtccattgatgctgaaaattggcacaaacaattggatccaattgggcgtcgcaaccaaaacgagctgcaattccaaagacccaacaagtaccgaaggactctttggtaaatgcatttaa

SEQ ID NO: 69898 - DNA, 986 bp, Heterodera glycines
  Genomic contig location: Contig_ID=SeqID_41842; Location=13..998; Strand=-
  SCN-specific regions: Sequence locations=1-301,323-468,490-776,808-986
atgaagcgaaccaacgcatcaaacatcactccgcctcgcgcaaaacgttcaatggcacctgcacaggacctggacccaaacgctgtcgcactcgcggagcaagaacgacaacgcaccctggtcttcattggcctcccggaaagcaatgccattcgcccatcggaacgtgttcaggaagacagggaagccgccacaaaaatcctggaccatcttgaagttgaggcccaaccaaccgccgtctttcgactcggacgttacgacccgcagcgaacaacaccacgcccgctcaaggtggtcatgccaacaaccacacaccaacacatggcactcggaggatggaagcgcgagcgtgctcgactccgttctctacaaaacctgaaccgcctgttcgtccgcccagcgctgaccaaagaacaactcaaggaagaatatgaagcgcgcttccgaaaacgtcaacaaaaccctgctcccgtggcaccagcaatgcaacctcgccagacaaatgttccgactcccgtcaaagaaaatgcaccaaaccagaaggaggccagcgacgacatttacaaaccgctggaagtttttgaccaaacaatcctcgtatgttatgaagcattaaaatcattaccaccaaacgacaaaattgttcaccaaattcaatcactcgaaaaacaataccctcgtcttttcaataaataattctgtcagacctccaaacatttcctcaaaaaaaatacatttattccagtacttcacttttctcaccaaaatttttcctcaaaaaaaaaaaattttttttattttttttttctcctacaaccctaaaaaaaaacaaccacttttccctttgttggaagtctgacttttctaatttctgcttctccattcaaaatttcaattcttttatcacggctttccatttcacctcatttccgccaaaagtgtaagtggcacattgtcttctttttgtatttttatttttgaataaa

SEQ ID NO: 69899 - DNA, 467 bp, Heterodera glycines
  Genomic contig location: Contig_ID=SeqID_41845; Location=29..495; Strand=-
  SCN-specific regions: Sequence locations=1-115,137-195,217-218,240 -254,282-467
atggattcattcggaactgtcgcctggattctgcgaccaacggctcagacgacaggcactgctgtgggctcaatggagtacgaagaggaggaaaacgggacaggaaagttggtccacagtgtcacagctactgtcaccacacctaccaccgccgagtttagactggaaaaagaagccccctcctccgagaaggacggtgatgaagagggcagcggcggccacggcacactgctgttcatcgaatccgatgatggggaggaggaggaggaggaggatgaggacattgaagacacccccgtcgccacagactccccctcggctacgacggcaaccgttgtggatgactcctccgacactgttaaaggggtggagcagcgctccagtgagcacagcgacgtgacagacggagcggaaggtggcggtggaagcgaaggcgcaaaactgctcggcgttagaaggaagaggag

SEQ ID NO: 69900 - DNA, 493 bp, Heterodera glycines
  misc_feature (316)..(316): n is a, c, g, or t
  misc_feature (478)..(478): n is a, c, g, or t
  Genomic contig location: Contig_ID=SeqID_41846; Location=662..1154; Strand=+
  SCN-specific regions: Sequence locations=1-40,63-208,234-436,463-493
atgtcacggagttccgaacattttggtgcctcggaatgccatccctggtgtgtaacattagaataagaacggcccattcttcgtgagttttcccatttcctgtcaatgtcaacctattgagctgaaattttaatcatacgtagcaattctgaaaatattagaaaagtgagccaaatctcaacaactatcaaaaagaaactgatgaaacaagctaaataacaaaaacaaaaatttgtcatatttctctctgtctcttaggcagagctttgttgagttttccaagttctccggagaaattaagggccatgaggcttanatcaactcaaatttgtgaccaattgaatcaagctggtcagcagcaacaaactctagatcacgtacagatagataccctacataagctcaaaaagttagagcgtactgaaaaattgtccccattttaaaaattttataatattttttcagtcaccatttaccnttcttgctttgctga

SEQ ID NO: 69901 - DNA, 519 bp, Heterodera glycines
  Genomic contig location: Contig_ID=SeqID_8980; Location=28..546; Strand=-
  SCN-specific regions: Sequence locations=1-23,45-302,381-398,432-519
atggccacttacctattcatcgctgctgctggtggtgctctgcttggtggagccgccacggtaagctgcgcttttttaaagatcctttattttcctaaatttgatttttggtcaaaacttttttgtaaacagaaaatatattgaaattttgcaccatatttgaaccaaaagtcgagaattcatttttcacaaaaatttacatttattgaaaaaaatcgttttaatgtttaatttagttgataatgagaaaagttttagcagatcaatattttcagctggccggccaacggctgctggcggctgcagcagcaccaccaccaccacaagtagctgcagcagcagcactagcagcagcagcagcagcaccaggcagcagcggcgggcaaaaaggagcgcaagaggacggggaggagcggcggcggcggcagcaagaaggacaagcactggaagaaggacgggcgcagcacgcgcaggaagaaggacaagaagggcaagacgaaggacaagaaggagtcgccc

SEQ ID NO: 69902 - DNA, 70 bp, Heterodera glycines
  Genomic contig location: Contig_ID=SeqID_8980; Location=516..585; Strand=+
  SCN-specific regions: Sequence locations=1-70
cagcagcagcgatgaataggtaagtggccatagcgttgcgttgcacactgaagcggttcgttggttggag

SEQ ID NO: 69903 - DNA, 192 bp, Heterodera glycines
  Genomic contig location: Contig_ID=SeqID_8980; Location=1115..1306; Strand=+
  SCN-specific regions: Sequence locations=22-192
atgtgcagcagctgcaggaccaggtggaccagctgaacaccgaacgggccaccttccagcggcgccttcgtgcattggctaaccaatttgggcgcgattgatttggtcgcagaatgtgcgcgagtttttcatgtttttgcgcgtttgactgaacacaccacaaaaaatgctaacgaattaatttaagatcag

SEQ ID NO: 69904 - DNA, 85 bp, Heterodera glycines; identical to SEQ ID NO: 65905
  Genomic contig location: Contig_ID=SeqID_41853; Location=700..784; Strand=+
  SCN-specific regions: Sequence locations=1-85

SEQ ID NO: 69905 - DNA, 56 bp, Heterodera glycines
  Genomic contig location: Contig_ID=SeqID_41854; Location=32..87; Strand=+
  SCN-specific regions: Sequence locations=1-56
gctatagggaagctattcccgaaggattcggtctccccataaatatgagcgcatcg

SEQ ID NO: 69906 - DNA, 377 bp, Heterodera glycines
  Genomic contig location: Contig_ID=SeqID_41854; Location=795..1171; Strand=+
  SCN-specific regions: Sequence locations=1-1,24-162,192-328,358-377
aaaatctataaaaaatttaaaaatgagaattcatgcgagattttctggaaataagcttatttgggcctagttaagctgtaaaaaaaatttggggcgatttgaatgagaatagaaagagccaggttcgatgatgttttggtaagccaaaaaaaaaatccaaacatttaaaaatctataaaaaatttaaaaatgagaattcatgcgagattttctggaaataagcttaatagggcctagttaagctgtaaaaaaaatttggagcgatttgaatgagaatagaaagagccaggttcgatgaagttttggtaagccaaaaaaaaatccaaacatttaaaaatctatataaaatttaaaaatgagaattcatgcgagatttt

SEQ ID NO: 69907 - DNA, 888 bp, Heterodera glycines
  Genomic contig location: Contig_ID=SeqID_41856; Location=1..888; Strand=-
  SCN-specific regions: Sequence locations=1-6,28-127,149-888
  Gene Ontology: Biological process=reproduction
aaattcaaaaaaatttttaaattttttctaggcccttagccgtcccccggggcgttggctaccgcttctgctactgctcgacatcagcgcattgctggcccagttcaccgttttattggctcaaccggcagcaaagcaacatgaacaggcatatataaataatacagtattctttggttactgtattttccgagagtgtaaagtataagaaaatacactaggtgttgtattaaagtatattagattactattttctgtgagaattattgtgcttttgagagtacagcatcaaaatctacggtatatgtttttctgattaggcaaaaattcggaaatacaacatgtcaatgagtagctctaatttgctgtgtttatacagtacgccaggcacagtgccgtctacagtatgccgggccttgcgtttgtctgtgcggtgtgcgtttcatcagcgtggtggcaaaactttgtgcatcctcgctcatttttggcaccaattcggctgctatcagttgtcggtgcacgactgcgcgagtgtcattcaaaaacctatgtggtaagaaactttaaatcgaagaacggcacaaaaggaaagtgccttgtttcagcttgtctcgccctggaaatgcgtgctgttcattttgtgcatgctgcactttgtgccaccgcacgtgccgttgcatgcactgctccagcgtgacccgttcgcggaacagctgataacgatcagcgctgatcatctgaatgacagtcaaatccgtgcattccaagaacgcatgcaagactatgaacgtggagcgggtgcgtggcgaaaaatgaataatacatatttatacgtaaaatacaattacggtatttattgaattatagtcccccccccccgaattagag

SEQ ID NO: 69908 - DNA, 272 bp, Heterodera glycines
  Genomic contig location: Contig_ID=SeqID_41857; Location=139..410; Strand=-
  SCN-specific regions: Sequence locations=1-106,148-272
atgggagatggattcgatggaataaggcttttgtttaacacatggcaaacagatttggccgaccgtgttcgaaaactcggactcgagccccgacaaaatgtcaaccccttttttgtctttgaattatttaatgcattttgttttcagaagaatcgcctctctgaaatgcaacagcactttgagcagtacgtcgatgtgaagattgttgcagcacatttgggcgtatcggcacaaattgttggacaaatatacaattattgggtgtcaaaaag

SEQ ID NO: 69909 - DNA, 1984 bp, Heterodera glycines
  Genomic contig location: Contig_ID=SeqID_8982; Location=2659..4642; Strand=+
  SCN-specific regions: Sequence locations=1-566,588-589,624-687,709 -1009,1043-1420,1442-1689,1740-1963
atgtttaagcccagccagatagtcggtctggtgtggacgggggcccttcactcgctggccttgagggtgaaggtgtgcctgttcctagcagcgggggtggcggttcctagccctaatgtgccctgcctacgggctgcattggtacagcgagagaataaccgggactggctggcccggaggaccgtgagtcactgagcagtgtcgaacgcgcagctgctcaaactcaacaccccggattaaaatccgcgttgccggaactcatatgtgctgtgggcgttggcgcaagtgccttatggagggagtaattaaccaacatagggaggcctacaccaaaccttgcactttgggatggtagtgccacacactttgagttccatgagcggttccataatcgcttgctatgatagtcatagttggtgggcatgccctccaatgtgatggcttgggccggaaggttaacaacacgtgtagggggtgacctatgcgcgtttttagccctccaaaaatggcctaaatcatcgctcaggagaggggtcatgcccgatttttttttggcagccattttctttgtcattttagctaaataacgggtttaattttccttttaatttaagaaagaaaataaaatgagccaattatctgacgattccctcccccctacccttgatggaccgtactcccctgttcgggacggtgcggatttgtttgatgatgcaccgccgctcgaatccgtcctcagccaactgccggcttcagttagttataaaaaaagggttataaattcttctttgctaattttgtgagaatatttcaggcaccatcgccgccaccggaacgaggaaatcgcactgctcgcaaagagcccagcatcagcaaggagctcgatcccgagcaatttgagggcgaaggctttagctgtttggcagcagcccaagcggaagctggccgttttaaaggtgttttaaactgcttcaaaatattttatagccttacaacattttaattgttcttttaattttatttaattataattattatttttcgttttctctaatcgttttgagtgttttctttagcatttcgttttatcggacaatttttgctgagcctctcactcactggtgtttttccggaggaaattttgcgcaacatttttaccatgtgccttgcctatgctgccgaaggggcggaatcaatgaaacttgcggcggatcacttcattttcctcctcacttcaaagcacatggactacgaaatcgccattcacttaaaaaagctggaccacactgcaaccgacaagattctgtcgcgctttgagatggtggatcaaagcaacaaatccaaggaacgaccgtcgatccgcgatgaaccattcgtcatcgacataacagccatcgaaagcaaaggagcaaaaccgaagaaggccggcaaaggccggcgggacctcaatgtgatttaccgtatcgctgacggagcgacgtatgggttgcacaacgcggacaacctctgcctcttccgagcctttgaatttttgcggatgaaattcgtattgcctcgacagcgtttcgcggaatacaagaaggacgaaagaagacaactcgaaaatgtgcaagccctctgccgagcatgcaatattgacatgaacttgcctttttattgcgtcgtggaatacggcgataggatccaggcaaaattaaaaaaataataataataatttaaaaaattaacaaaaaaattaaggcttattatcagcgtcttcatcccgggttgttttggctttactgcttcgaaacgtccggtcggatgaagccatcatggaagtcatgtgccggcgaccgcgagcatgaactttgtgttctttttactgaggatgtgaatggtgaaaatgggcattatgacgctgtgaaatcggttggaaagctgttcggcacacaaaattattgctttggggtaacaaacaaacaaaaaatttttttaaatatta

SEQ ID NO: 69910 - DNA, 403 bp, Heterodera glycines
  Genomic contig location: Contig_ID=SeqID_41862; Location=114..516; Strand=-
  SCN-specific regions: Sequence locations=1-53,91-403
atggaaaagctgaagcaacaaacagttgttccatctgccaatttcgatgacggtattttaaatacattataaattaatataattaaaatagaaaatgacaatcaaattaattaccaaaaaaaaatttgaaaagaacagtaaattaaatacatattaaatttaagccgaaatctgctggatctcttggcttggctatgagccacccagcaatttggaagggggtaagtcatttaagggcatttctgagatatttttatacaaatttaaagctgacaaatgggacaattggcatgccttaaacaacggatggccaacggaggagacggacgaacaaaaggaaagggtgaaaatttgggtttttggaatttttatccttttttgtatttttaattggtttaattaa

SEQ ID NO: 69911 - DNA, 54 bp, Heterodera glycines
  Genomic contig location: Contig_ID=SeqID_41864; Location=1213..1266; Strand=+
  SCN-specific regions: Sequence locations=1-54
atgtcaatgagatgtaagatgatggaacttacccggagatatgcgatgacaaaa

SEQ ID NO: 69912 - DNA, 707 bp, Heterodera glycines
  Genomic contig location: Contig_ID=SeqID_41869; Location=105..811; Strand=+
  SCN-specific regions: Sequence locations=1-707
tttgggtgcgctttagagcactttctgaaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggtgcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatttggtctccccataaatctgggcgcatcggttcggggagactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcaattttttcaagtgtccgtttggggtactcaaacaattatggggagcaaaaatccaacgcagaattaaagtacaggctataggaaagctattcccgaaggattcggtctccccataaatctgggcgcatcggttcggggggactgccccgaaaac

SEQ ID NO: 69913 - DNA, 60 bp, Heterodera glycines
  Genomic contig location: Contig_ID=SeqID_41871; Location=649..708; Strand=+
  SCN-specific regions: Sequence locations=1-60
atgtgtgttatatatccaacggattcgctcagttgggcccgtcaggtttgggccggcacg

SEQ ID NO: 69914 - DNA, 2114 bp, Heterodera glycines
  Genomic contig location: Contig_ID=SeqID_8983; Location=379..2492; Strand=-
  SCN-specific regions: Sequence locations=1-68,91-224,246-636,659 -1329,1351-1356,1378-2033,2055-2114
atgggctcggacaacgcactcagctgcatgatgagacgacagaagaggaaaattttggggaacgtcgactgcacagaccctttggcattcgtgatccccgacaaattgcggctgaaaaacggagaggacattgtgctctacgacagtcgcactgtcagaattggagaaaaggacgtggtgcttgtgtttgggagcgaacgggtaatcatcaggggcgaaaacagaatttaaatttaaattttttagactttggacattttgagcaaaaacagtgcaacttggcatttggacgggacattcaaggcagcaccaaacatgtgggagcagtgctttgttgtgggcgcgtctgtcaaccaccgaatgtgcattggagtctggggtcttctgcccgggaaacatcgacgctactacgaggaagtgctgaactttctatgtaaccgaatttcaccggtcgcaccgagaaaaggtgaaaactaacacataaatttatgtgaaaatctagttttcttttagtcatttgcgattttgagaaagccgaaatgaacgccgtatctgctgttttccctgcaacaaacatcctctgttgcatgttccactacgggcaaaacctcttccgaaaaatgaaggggcttaaactggtgcaaatgtatggggaacagtctgtgcgtggtgaagcggtccgacactctttcaggtaaaacaattcaaaaattgacctgacttcataatttttttagaaatgtcctatctttgccattgttgccaccaacttacgtcagacgagcattcagcgtcattgtcggcaccgcccctatggagatggagcagtttctcctctactttgcgaggacgtacatcggaatgacgcagcaacagctgcttgacggtgacaatgcgtttggagttcgtcctggtggcatttctccacttttttcgtgtttgtttttacatttactctttttattttcttttatttgcatttaagcattcacggggacatcattttcttctgttgaatccgaccacacatactcacggcagcccttacaatttggcatcgactcgcccgccccctcaacactatcatggccgtcaacagtggagcaaaactcgccgttggtgcagtactcattgagttcatcgtcaacgacgacattgcagccaggcacagcaaaattcacaaaattgttgatttaaacaattttaagtccgtccttgggaagaacccgtcgtccgtcgcgcactatttccaattccatattggaacgtgcactcgcatgcggcttctgccctcgcgcggaccaacaatggcctcgaagcaacccatcttcatttctctgtatttattacttataaaaccccaaataaaataattttagaagggtctttgtcatcacccagccctttccgatttcatttctgaagtcagcggaagcatcgacagacaagttgacgcagcgaggtcagcaaggaacttcatacacaaacgacacaaacgctacgtgctgcaggacgcagtcatcatgagaattttggcggatgcaacatacaacgacgatgccgaaattcacgatgttatgacggctcttggtctgcaggtcgaaggatatgcaggaaaattgaaggactacgaaaacacggaagattcaatcatgaatttcgcttagacttgttcgatcccaatttttacccttttttattcattcattttttgaactattcctttttcctgcaaaatttattatttttgttatttgtttatgctattctgataaatcgttaatgaattatgtgttatgaagccttaaaatgtaattttccgactttttcactaattttttagcttggcgacattttgactctttttagcttgggcgacatttcgacgcggcgacattatgacgcggcgacatttcgacgcggcgacattatgacgcggcgacatttcgacgcagcgacattatgacagaacgacattttttgacagcgcgccggcaaaatctcccactcattttgctgtattcattagcaaataacaagcatttggatttgtatttgtgtaactaattttacaccaaaatgctgatgttggagccttgcaagcttagaataaa

SEQ ID NO: 69915 - DNA, 440 bp, Heterodera glycines
  Genomic contig location: Contig_ID=SeqID_8984; Location=45..484; Strand=-
  SCN-specific regions: Sequence locations=1-13,35-440
atggaccgtaacaaaattgaaattctccaaaaaagtcgtaagcgtaagtttttggacaccaacgacaatgagaacgaaacgacttctgagcatcatgaaccaaacgacgaaaacaatgaccgcgacgacgattttgaagaagaacacgccatcgtgaacttcgaactcgggaaaactcaaaagggaggcgtttgtctttggtctgaaggtgggaaatttgctagaaaaggatgaaaatttgtcaaaggctttcggtacacacacgaaaaaaacgaccgatggaggtgcagtgtgcgtgactgccctgcacgcgtgacaatcaccgacaaaagcgacaatggaatggccggatatttcggacaaaaagtccataatcacctcccagagccacaaaaacaacgggtttcggacaatcattgctaattaagtaaactaataaa

SEQ ID NO: 69916 - DNA, 878 bp, Heterodera glycines
  Genomic contig location: Contig_ID=SeqID_8985; Location=457..1334; Strand=-
  SCN-specific regions: Sequence locations=1-225,266-437,459-461,483 -525,549-878
atggctggggaaggccaatgcaatgaggcggaagaagtgattctgcgcagctccgactatgccttcatgaagaaaacggaaacggcattcgaatttgtggtcggaatgaatggccaaacggaggacaaaacggcgcccggggccaatgccaatggggcatttttgtgctgtaaggcaacccaaggtgaataaaagcacggagacatttatttatatgagtaattgaattttatattgatttaaataaacaaaaataatttaaattccttcacaaaggaaccgcaacacttttcatcgtcggcgtggccaacaaacggctgatgttggccaaggacgtggtcaattacaaatttcatcaaaacatctcaatcgatgattttgaacgggaaaagcaagtgttggaaagtgtttcggcgcagggacaaaaagccggcattggggacaattatggagaaaaattcttccaggaccaaatggacgccaacaaaatgattcaggtgaaagttggaaatcgtttaaacgtcattaatgaatatagttgtttaaacattttgtagaaaggctatgtgaagctgtggaccgccaacaaatcgttgcctcctcaaaatgtgccggatttacagaaagatacccggcccaaagtgacggcggcgacagaagaaatgattttggcactgaaagtgtttcaacagtttcgaaacaacaaaaattgttgggcatctgtggaaaaggaactcttaaagtcgcaaagctttttgagtttggccgaacccaacggaaaggacgcaatgcgaaaagcggcggtgcgattgtgcgcagaaatggaagcgaaaattgaggcacaaattgacgaaacggcaaagaaattgttggcctga

SEQ ID NO: 69917 - DNA, 614 bp, Heterodera glycines
  Genomic contig location: Contig_ID=SeqID_41879; Location=138..751; Strand=-
  SCN-specific regions: Sequence locations=1-116,194-195,217-280,302 -422,444-484,506-571,605-614
atgtttaagattgactttgaaaacaaatctgtcaaaataaatggtcaagaaacagaaaatgtaacggaacagaaaatcatgaacaacaccacgcctattattgatatgcttaacagtaataaataattaattcaatttttgtaaaattaaaaataatcaaattaaaaaacataatttaataatatatttatttgtagatgatgaagtggataatagtgcttctgaatatgatacatcatcaacaagttttagatcaaaagaattgacgaaaaattcttccagtaagttgaaataattgaatataaaaaaatatttcggactgaacataaactatgattttgcagtttaaaaaaaacggtgtaaaatttgaggaacgaattttttggcaccaaaaactgccaaatgggtgggatacaagaactaaaaaacctaaatatctttaaaaattttaatgggtttagaacttaaaaaagtaagatcctataaaaaagaaggaaaatcaagagttttgatcaatttcttattattcatgttcttattaggcttgtaaaatgggaaaaacctagctccctaattatatttaaaaaaaaaaaaactaattaaagtagaataaa

SEQ ID NO: 69918 - DNA, 473 bp, Heterodera glycines
  Genomic contig location: Contig_ID=SeqID_8986; Location=268..740; Strand=-
  SCN-specific regions: Sequence locations=1-312,392-418,440-473
atgcgtttgacaccaaaatggctgtgccaaaattacccgtctcggttggtcccaaaaaaataatgagaaaacttaaatatataataaattacattgcagcgaattgagtcacttcattgaactttgagccaatgttaattgaaagtgatttttcatcaacaataatatattcatcaaaaatttccatcgcttttctaaacatttaaatttagttaaattatttataagcgcaagtaaattcaaaatttagagtcagaagagtgttaggggtcatgagatattaaattcaattaatataatgggaatttcaactttttataaattaaaattaaaaaaattaatagttttaaaaaagctataacaaaaaaaagattaaaaatattttttatttgtgtttttttttttgtaaacaaaacgattttttagaattttgaatgctcagaacatttgaactcttcgaatatacaaataaa

SEQ ID NO: 69919 - DNA, 1620 bp, Heterodera glycines
  Genomic contig location: Contig_ID=SeqID_8987; Location=913..2532; Strand=+
  SCN-specific regions: Sequence locations=1-622,658-861,883-1061,1179 -1620
atggcacagtcaagtgccaacaacactgtgggcggaacgccaaagcttcaagcccaaccgaatgccaacactatgggcggaacgccaacacttcaagcccaaccgaataccaacactatgggcggaattccaacacttcaagcccaaccgaatgccatgggcggaatgccaacgtattatgccgtacagcaacagcagccatatgcccaactgcagtttgtttcccagcaggcatgttagagggatggggagtactttggtggtatgactgttagtgctgttcgagagtctcgacttgagaaaagtctcgggttttcggtctctgtgtcaggtctcggtcttgaatcggaaaattttcgttctcgaacagcactaatgactgtggctcggttttttagttttttttttttttttgacaattttttatgcgagagatctcccagggcccatccaactacggggcccaaaatttccagcagccggcgacggtaagacttggcactccatcggcgtcagtaaagcctggcactaatcaacccatgatgcccatctcacccacacaatcagtgctggtacggattctcaaaaaacgcgaaaacatggacgaaaagtgaaaatttccattaaaaatatattattatttcttttttaatttttctccagtccatgccctccgctgagttcgccggccgacgatttgaccgtgcatattggtaacagaaaggtgaagcgacaattagcattaatcaatcactaatagggattcgtttttaggcaaatgcctaaaatttttcgcatttaatacatgtagctaaccacgaaaaacgcgttttccgctcttgtttggggtgtctacgatgaattttataatgcccaattttgcctattttgggctttttgtgcttaatgcctaaacgcctatttttgtgcctatttcgccacttttggtgcctttctcagaattttctgaaaatcctataataaaaacgaaaatacacacctatgaatcggcccaaaaattttctgaaaatacgcccctaagaattggaaaaaattttcccaaaaattaattacaaaaataaaaatttattttggtaatctttttaatttaaaattttgttcttattccaaaaaaaaactttaagatatttaattattcatttacaatttaaatttaaccagatttactttatttttatcaagttttacgttttgctaccttaaaagcgttaaagaaatttctatttgcttattttagtgaatatttgaggatttctgtgcctatttagtgcctattttgcaattttgcgtttttaggtgcctatttcgcgatttttagtgcccaaaaaacgaagccataataattcaaaaaaattgcttaatggatactgtatcaattttcaggttactgtgtctgctgcttggcttatgtgccaatcgccgatggtccgtcaaatgctcagcgtggaaatgaaggaaaagcagcagcgatcgctcacattgaacgaattgggcatcgacatggagcagttcatggattttttggaggcaatttcgaccaatgctcttctgttcccgattttgccaaatcgtaaaatgagattaacaattaattaataa

SEQ ID NO: 69920 - DNA, 288 bp, Heterodera glycines
  Genomic contig location: Contig_ID=SeqID_8988; Location=975..1262; Strand=+
  SCN-specific regions: Sequence locations=1-43,77-198,250-288
atgaaaatgccaaatgtctcacaattattttgtattttaattgttttttcaacatttattgaaaagacaattggtgtcaccaaaaaaggaactgcttctccactagaaaaagcagagcaaaaagacgacgaaccaaaattgggaaaagaagacaaaaaattggtgaacaacaaaaaagaattgctaaaaaaagaggtgaattttaaaaatatattttaattgaaattgaaatttaattttaatatttttgagggaaaaattgcaaatgcaaatggaccaaccagttga

SEQ ID NO: 69921 - DNA, 498 bp, Heterodera glycines; identical to SEQ ID NO: 61407
  Genomic contig location: Contig_ID=SeqID_41882; Location=106..603; Strand=+
  SCN-specific regions: Sequence locations=1-107,134-217,239-263,292-498

SEQ ID NO: 69922 - DNA, 501 bp, Heterodera glycines
  Genomic contig location: Contig_ID=SeqID_41884; Location=164..664; Strand=-
  SCN-specific regions: Sequence locations=1-107,134-260,289-501
atggagaaggcctgcaaaatttggagagattatatcgattttagtgcgctaggttcgatgaaactttttaaaatataagcctaaactttttggcctgtttaaaaaggaattaaaaatttttaaaaattttattcatccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaaacctaaaatttttcgcatatttaaaaagcaattaaaaatttttagattttttattcatctccctttttgatagtgaaagcatctgagtgcctaaaataacttgcaaataaa

SEQ ID NO: 69923 - DNA, 782 bp, Heterodera glycines
  Genomic contig location: Contig_ID=SeqID_41886; Location=198..979; Strand=-
  SCN-specific regions: Sequence locations=1-135,157-414,436-669,691-782
atgcctgtgggtgaaaacaatatttcacattcactccataactttgtgagttcggcacggatcgagaccgggataagaccactggaaagagcagctcgagctctacaagaaggtatggaaagaaaaaatagttatttctgggactttttcagaaatcagaattaattctccaatgtggcccaaattttaggcccccagccacagccccttgcttctctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 69924 - DNA, 132 bp, Heterodera glycines
  Genomic contig location: Contig_ID=SeqID_41887; Location=377..508; Strand=+
  SCN-specific regions: Sequence locations=1-132
atgaaaaaaacatgtaagccccaacatttttttctatccgaaatatgtcctccaccatcccagaacataactctttttgccaatgtgagcaaagcgcccgaggggatgcaattgtgtggtgccggtgccgtt

SEQ ID NO: 69925 - DNA, 383 bp, Heterodera glycines
  Genomic contig location: Contig_ID=SeqID_41889; Location=71..453; Strand=+
  SCN-specific regions: Sequence locations=42-275,297-383
atgcccttacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 69926 - DNA, 1028 bp, Heterodera glycines
  Genomic contig location: Contig_ID=SeqID_8989; Location=218..1245; Strand=+
  SCN-specific regions: Sequence locations=1-132,168-298,320-397,512 -539,572-610,632-699,721-782,851-1028
atggaaaatcgacaagcatttcgggatgaatttccattaatatttaaacgaaatgtaaatgtaattcaagtttctccacaacaaaatgtaagcacattcgctggaagctcaggacaacaacacgaatctttgataaaaaaatttttttattcattttaaaaatataacctttcattcttttcaccgtattttttttaattgtcccctaatcgcaaaaattggtcattttggacaaaatctatcaacaagttgcactcaaattttccaaattttcctggcggcgccgcctattctccataaattttttataaaaacgcgccgcaaaaaaaccggctttgaaaaagtagagttgctttaaaataaaattttggtcattacccgattcgcgagggtgactgagagagagggggaagaaaacagagagaatgggagaggaaagtgcgagagagagaaagaaagggagggagggaaactgaaagagaaagagaggagggagggaaagagagagagacaaatccaattcatgaagtcaatcttcctcctttcttggctttttcccatttttgtctttgactgaaattctcttaattatcaaccatatgggaatatcggtaagtatccgccagttgccggctctccccacaacacatcgcttcccggcacattggccacaaaccaatggacgaatgtccttaaatgaaaaaaaaaattaaataatttgtatgaaattctatcaataagtgccagagatcatgaaacaattaaatggctatttatacatgataaattagtaaataaaacaataattaaaattatgaaaaatattgtagtaatatatgtattattataacatgaattttaagaagatcaatcgagttctagcgatttggaagcgtctctcgagcgtttaaacggtttattttaagttaaaaaaatgaaaattaatttaccaatttaaaaccatcaaattctgcaaatctgcaaatgaatctgatgattaacgttagtaagataattttttgtgtaaa

SEQ ID NO: 69927 - DNA, 733 bp, Heterodera glycines
  Genomic contig location: Contig_ID=SeqID_8990; Location=634..1366; Strand=+
  SCN-specific regions: Sequence locations=1-69,106-304,403-453,503 -533,557-733
atgaacgtgtttcaaattgtttggtgtttcgctgcaattttatcaatgtccaataccgctccaagtgcgaaaaatatatttaaacgtttaaaaaataaaaaatatgtttctttagacataaaagcaaaagatttaattactaaaaatgaatcaaattcacaacatgctgaaaccagtgacaaaactgcatcaagctcacaaaaaaataaatctgatgagaattgctcaatttgcttggacagcattgctaatgatgataattcttcactgaaaaccttacttaattgcaaagttagcaaaagccatataaagtttaatatttaaaaattcatttataatttttaaattcaattattaatatttttattcaaattattgaaaaaaatatattaataatataatcttgttttatagcacagctttcaccacagttgcattgatcaatggtaattcttatttataaaaaatattaaaatttttatttttcaacaatatataattagcaaattagcataaaatttcataagcccaacaaaaataaataaataaatattttcaggagttctagcccttctctaatatggaatttaaaaaagctaaattcgatgattagtccattggttttcattttgcaattttttcaaaattccgataaccttatttttttcgcttaattttattgggttaaggttacaaatcaaaaaacgatgtcctgtatgtagaggagaagtta

SEQ ID NO: 69928 - DNA, 372 bp, Heterodera glycines
  Genomic contig location: Contig_ID=SeqID_8990; Location=2633..3004; Strand=-
  SCN-specific regions: Sequence locations=1-10,32-305,327-372
atgtgcatggttaagtgggttgttgtgttcttggttattgtcttcattttagcgttgatcactaccatccctccaagtaattactttttcttataatttgtaaaaattattcctttttcagggaatttaatcacaattttaacaattaaaaccataaaatcttgtcatttttggactaaatctattaagaaagcgcactgataaatttcaaaattttacccggcggcgcctatcggcaccgccggagctccaaaataccctttctttttttaaattgactcaaaaaccgcgaaaaaactaacgaatttttgttttgtgcgtttttgaaatgataaatgttgtaccaaattgaatcaaaattaaaaaaataaa

SEQ ID NO: 69929 - DNA, 683 bp, Heterodera glycines
  Genomic contig location: Contig_ID=SeqID_41893; Location=110..792; Strand=+
  SCN-specific regions: Sequence locations=1-10,32-321,343-683
  Gene Ontology: Cellular component=mitochondrion; Biological process =polar body extrusion after meiotic divisions
atggtcacactaattcaggaaatgaaaaggatccaacccgagggtccttaccgactgatcggctattcctacggcgcttgcgttggctttgagatggccactcaactccaacgcagcgatgggaacgaaagtgtggagaagctgattctgttggacggttcccacctttacatgcagacgtacagaaacgtgagtgaacgaagggagaagcagtttctcgtggctttgctcagaagctcaacaaatgaattcttaggtttaccgcgttgcgtttggagtcaccggcgacactttggtcaacaatccgttgttcgagtccgaaattatgtgtgccatgactttacgcttcgccaacgtcgattacaagcgtttccgcgtggaaatgctgcagttgcccagtttcaaagagcggctccagcgcgtggtggacacggtgatgggcactgggctcttccagcggtcggacacaatcgcattcgcagtggacgcaatgcgacacaaatttgtgatggcggacaagtgagtattgctgcttgttggccattcccggcattcgcgacaatttataatcacttctcaggtacaaaccgaaggagactttcaagggccacataacactcgtacgcgcggaacaaggcgcggcacgggaagaggacgtcggcaaggactacggcatcggacaa

SEQ ID NO: 69930 - DNA, 65 bp, Heterodera glycines
  Genomic contig location: Contig_ID=SeqID_41895; Location=1..65; Strand=+
  SCN-specific regions: Sequence locations=1-65
agtttacaatataaagataatattaaaggagcaattagtgaaaatgcatataattagaaatgatc

SEQ ID NO: 69931 - DNA, 224 bp, Heterodera glycines
  Genomic contig location: Contig_ID=SeqID_41897; Location=1..224; Strand=-
  SCN-specific regions: Sequence locations=1-224
aatggggtttcccatcgccgatggctcgtccgtccgagatgaagtatgccgagaggattggcgttggcgggagtgaggtgggtatgaccgcgatggtcgatgtttccccacttttccggcactcccgggtgaagggtaagccgttgagtctcgatttggccgttgtttgtctcgatttcgatccatgcgctgagttgtaggtccccattcgatccagctgaact

SEQ ID NO: 69932 - DNA, 280 bp, Heterodera glycines
  misc_feature (46)..(46): n is a, c, g, or t
  misc_feature (59)..(60): n is a, c, g, or t
  misc_feature (111)..(111): n is a, c, g, or t
  misc_feature (136)..(136): n is a, c, g, or t
  Genomic contig location: Contig_ID=SeqID_41897; Location=736..1015; Strand=-
  SCN-specific regions: Sequence locations=1-280
aaagtgggggtgaaatttgatgaagacgaaaagcgccgcccaagcngatgattccgagnnccacggcgataagccaccattgtcccgtcgagagcaatcgaagaaagtganaaggggtcaaatcccccaaatttgnccatgtcagggtgaacgtgctgcccggctcgatgtgaccgctcgctggatctcgctggctaaagccgaattgctgctgtttggggatgaaagcaagcccccctttaagtttaaattttgttgtccccgccgggcatttcacttg

SEQ ID NO: 69933 - DNA, 847 bp, Heterodera glycines
  Genomic contig location: Contig_ID=SeqID_41899; Location=490..1336; Strand=+
  SCN-specific regions: Sequence locations=1-131,178-212,234-238,260 -341,363-448,470-496,531-539,561-702,725-778,829-847
atgattaatgatcatcagccgcctattcacattcacaggtgagttgcaccgaatgttgtgaccatgacaagtgcaacaacaatcacacgcttgattattattatgcggtgatggcacaacaatttacatcgtaaaaatttaaaaaatataaaattagaaaataaaaattatttttaagttggacaaaaccggtgaagaatgaagctaactacaataaaaagaacaatttgaaatttccttattaatttttagaatttttcatatgctttttgaaaagtattatgtattatcattagtcgctaaatcaataagctcttttgctgctattttggttgaatttcatatatatttttaaattttatcaccaaattataatttagaaaaattcacaggcaacattcattagtattaaaaaaactgattttctggcagacataagatttttaaagttaacaaatttttggaatttacatgcttctttgagtgaacattaatcatttttagttaaatttttaaattaatttaaaaatgcaaggaaattttcaaataatttaaaaacattaagcaatgggctgatggggaaggggtttatgtaattgaaatttcctgttttctaaatgagtgatcaaaaatgcttttacccgctgcagtgatcagttgtgatcaggttttatgggagaacacacacgtcaattgaccggccaaacaacagcagacaacagagtggaaaacctgtgataattgcgcaatgtcaacattgagttaatgaagctaaaacaatttatgtaattttgatttttatttatttattttcaaaaatatatattaccaaaaatatagctaacaa

SEQ ID NO: 69934 - DNA, 501 bp, Heterodera glycines
  Genomic contig location: Contig_ID=SeqID_41900; Location=260..760; Strand=+
  SCN-specific regions: Sequence locations=1-51,73-107,134-265,294-501
atggagaaggcctgcaaaatttggagagattatatcgattttagtgcgctaggttcgataaaactttttaaaatataagcctaaactttttggcctgtttaaaaaggaattaaaaatttttaaaaattttattcatctcccttttgatagaaaaagcatcagagagccttatttaacttttaattaacattttgggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaa

SEQ ID NO: 69935 - DNA, 168 bp, Heterodera glycines
  Genomic contig location: Contig_ID=SeqID_8991; Location=315..482; Strand=-
  SCN-specific regions: Sequence locations=1-21,46-168
atgcattccttctccgctcagtcctcgtcggtgtcctcctcgctcgactcggccaaggaggaatggctcatctccaactttgaccatgccaacccatcccaacgcgtgatggtgctgccacggccggcatcccttcacaacgacgattatgaggaggagacggcgaag

SEQ ID NO: 69936 - DNA, 938 bp, Heterodera glycines
  Genomic contig location: Contig_ID=SeqID_8992; Location=733..1670; Strand=-
  SCN-specific regions: Sequence locations=1-134,156-611,633-748,771-938
atgccgacaaatggtagcaaaggcgatgaccagcagcagaggatggtgctgagcagacatttggccagcgagggcaccgccaatcggccgaacgccggcacttcgaccggtaaaacgcccgggcggatggcactcattcaaaaacaaacattttgtgggacgatcattgcatttttattattttggttttttgatgccccgaggcatgggccaatattgttgcaccaattactaattcctcattaacttttcacctcggcttccgctccccccatttttgtgctttgtcgtcgcttcggccgtgtgtgggtgccaaaggggccaattagtcagtttgtgccgtccgcttcatcccatcccccgtgggttaattgctcacttttctcattggcaaagcggtgattattcattcgaataagtgccgtatttttcaacaaattggcttcaattagtcaacaaattttgttgttggtataagtgttcgttttttgtgctgtcctttctccaacttcgtaccgacaccgcctcagggctcttcagagaatttcggtgccaattcgagaaaaatctcggcttttcgagttttatttcggtaaattttcccttccccatgggtcatttatttatttattgactcggtttatgccaagaatatcacattggctaattattctctctcgacctttagattggctgtccatcacttacccaatgggtaatttgtcgtcaagtttgcgtcgctcaatgccatcagtgaattcgtccgccgatggcaccggtgccggtgccgaacacctcgtccagcgggtgggcaccgcccggcatagcagcttctccacggaggatggcgccgccatgtgccaaaaagagaagcaacaaaattcagttggcattgccgactccgaaacaaagtgcgagcaattaacgttgattgaccc

SEQ ID NO: 69937 - DNA, 757 bp, Heterodera glycines
  Genomic contig location: Contig_ID=SeqID_8994; Location=687..1443; Strand=-
  SCN-specific regions: Sequence locations=1-401,426-514,536-679,732-757
atgaacccaaattggatggaacagcggttcatcagcagcaaagaagagggggaggaacacggagaaaaggacggagaaaccaaaggtaaacagccgaattttatacgtgagacattggggcacaaatggcatcgattgtccaaaataagacacactcatgaccagccaggctaatgtccaaatccaaaattgtaaccgttttatatatttcacataaaaatagtaaataaatgcatcatttaagtggaaaaggaaggaacactcagcgcaacggccaacttttcgtcgacgtatgtgcaatattcggtcgatgggacaaacaatggaacatcccggccaattggggtgccaacaattgacgaacagacacaaattgcggcacaatacggccttttgactgtcgaggatgaggacgaggaggacaacgacggacagaaaaaggtgcggcaaaaattattttgcgtgggaattcgaagaattatggaacattaaaaaggaaatttggacaaattagtaatgtaaaacaaaacagtgtttctcctactataataattcaaaaattaattggtttttaaaaagcgaaagtttttcaattttagggttttccattttaaatttttagcagtcaatggaagagacaaatggtgcaaacggaaaacgctatcatttgctaatggtcgaagaggaggaggacgaagaagaagaagaaattggtgacgaagagaggaaaagcctggaagacacagttgatttctga

SEQ ID NO: 69938 - DNA, 492 bp, Heterodera glycines
  Genomic contig location: Contig_ID=SeqID_41902; Location=463..954; Strand=-
  SCN-specific regions: Sequence locations=1-136,225-460,483-492
atgatttatccgagcttaacgcaaatgggtcaagataatggcgaagatttgtcgctttatcgctacaaatttgcaactcgtcaagcaaatggaatagacaacgacactcaaattgcgcttgagccagaaaaagcaaaagtaattaattgattaattggtttaattagttaataattagacttaatttaatcaccacataattaaaattaattttccaattcattcagatggttgatctttaccatgcataccttgtcagaaacaaaacggacaagcaggaaattgcattgcaagttgaagcatttgcaatgtcattgcaaatgattcatgtgaatgaattgacaggaagtgatcaaagtgatggttgatttgtagcgagggtatactgtatggaatattgttgtatttccaaaatagatcgataattttgtctagttattattattcccatttgttaactctgtttttgcttgactaaattcaaacaataaa

SEQ ID NO: 69939 - DNA, 503 bp, Heterodera glycines
  Genomic contig location: Contig_ID=SeqID_41903; Location=249..751; Strand=-
  SCN-specific regions: Sequence locations=1-503
atgtcatttctccaaaatgcctggccaatttggcacattctgttggaattcactaaaagcaagcaacaaataatgcattctgtttccatggagattatgtgcattaaatggacgcaaaacagaagagatacagtgaaatggcggcagcaagtgtcaaagaaaagatgaaagaaattggcgagtaaaagcatttgcaacaacgaaaattacaccttaataacaaacaaattcaccgatggaaaagttttaccaaaggccaaaattattaaacataatttcttagctataattaacctaaaatcactcttttgtcaaataattgcttaatattacaactatcacagcaaaaaaaaaataataattacccttatttaagggatcagattcttcattggattcaaagtctgtagaaaccggtgataagtggttcgacagagaaattagcaaataaatagctatcaaagattgtgcttggaaatctgcgtttaaaatttcaaaataaa

SEQ ID NO: 69940 - DNA, 914 bp, Heterodera glycines
  misc_feature (902)..(902): n is a, c, g, or t
  Genomic contig location: Contig_ID=SeqID_41904; Location=742..1655; Strand=+
  SCN-specific regions: Sequence locations=1-30,52-130,152-348,370 -430,452-840,863-914
  Gene Ontology: Mol. function=peptidyl-glycine monooxygenase activity; Cellular component=integral to plasma membrane; Biological process =peptide metabolism
cgactcggttcagaaacaactcgcccggctgcttcagctccctcccccaattggacatgttgtcggcatggctttggacccacagaatcggcttgttttattccatcgttcgggtcgcatttgggatgagcagtgagtgggcaaaaccacaaataataatgagtgagtgctgatggtcattcccttttagttccttcgacgagaataatcggttcaaccggtcagtgacttatcagtgccaccgttaattggtaggctaattggactgacttttcctcatcagttcactcggagcaattcccaacgcgaccattgctgtcgtggacagcaaaagtgggcttctgttggagtcccatgggcagaatctcttttacatgccgcacggactgaccattgactcggagggcaatttgtggcttactgatgtgggcagtcaccaggtgcacaagttggacaagttcttccgaccgacgatgagtctcgggaagaaacttacgcccgggtgggctcattcagctgagaattcgcaatcgtcgccttttgttcagttcggatgctgaacacttctgcaaaccgactgacattgctgtgtcgaccaatggcgactttttcgttgctgatggatactgtaacagtaggataatgaaattcgaccgcaatggcaaattgataagccaatttggccaccaaaactgtgagtttgttggtcggactatgaataatcacacatttagcgggaaatcctcctaaatcgggcgaattcttcgtgccgcattccatcgcactaatcgaagacttaaaccttgtctgtgttgcggatcgtgagaatgaacgcatccaatgcttctcagttgggcttggaaggcacaactcacaaaccgaaggggcgtatgtgcccacgnggcacatttgtg

SEQ ID NO: 69941 - DNA, 623 bp, Heterodera glycines
  Genomic contig location: Contig_ID=SeqID_41906; Location=103..725; Strand=-
  SCN-specific regions: Sequence locations=1-358,381-394,417-431,453-623
atgactaatggctcaggtttaaactacatatttccgcataactacactgtggacaaaattgtgttttttcttttgttgaggatgttgataattaaggtaaatgtgggaaccaaaataatggcactgtaattagtgtatgtttctaaacataggtcgagaattgccaattatatttattagtaaaatttagcgaaaaatcaaaattttcttacttgtattgcaaattttataactttgttgcaattgcgatcaatttgttgtggaaaagaaaaataaatcgattttatggcatttacagttgacaagattcccggttctaatctatttttaaacgcgttctaatacaaaaagctgcaattaataaaaataaaacctatttaacatcagttttgccgataaaaatccaataaagacagaaggaaatttgtaataaaatagagcatatatgaaaatttcagaactttctatacgagtatgtaatattcaatttaacgagctgatcttcactttgtttagttaaattcttgacctttttaaagggtggttgtatacatgtagaaacaatcgaatgttgattactgcagaaaagatagaccgtattacgaaaaataatgaaaaataaa

SEQ ID NO: 69942 - DNA, 873 bp, Heterodera glycines
  Genomic contig location: Contig_ID=SeqID_41907; Location=186..1058; Strand=+
  SCN-specific regions: Sequence locations=1-125,147-291,321-407,429 -659,681-733,755-828,850-873
atggcccaacccccagcaagcgtccctccacccacagagtatcgacgcgaaaattcaaatttgaatttagcgccaaaaggggcgacaaaagtacaggggtcactactggtgttttctaactaaaaacactgtatatttttggaacattttttcaattaataatgtattaaatattcgcaggacaaaattgctggcgatggttattcatacacggatgacaatgtgtgcgtgttcaacaatgtggtgacaagccgtggacctggtgagagaccttgctcaacaatttgattgaatttaatttaaaaattattaatttatttgatgaatggcaaccgattttttgcagggattttttgagtttttatgtatgattaagtttttattttttttaatctaacccaagttgcataaaatttggggtccgtttagcgtatggggtagctaaagcgcgaaaattttgagtctgactatttttaatgcatttttctggaaattttccaccccttcccccaatatggctgtaaaaaagccctagaaatcatcaaattaagaatgaatttctagcatagcccccaaaaaaaaaactgacaggaacccacggattttaattgtggcgcaattgtctggcgcctaactttcaaatcagttaaaaatttaggaaaatttaatttttataatttcaattgcaggcactgcctttgaatttgcgctgcaacttgtcgaaatgttggtcagtgaggagaaagcgaaagaaataagcaattctttgcttgtccattgatcagttgctcttatcaaactagtcaagatgagatgatcaaaaagcaatggaatatattcattgaatttgtgtgatggatacaattttaccaa

SEQ ID NO: 69943 - DNA, 1102 bp, Heterodera glycines
  Genomic contig location: Contig_ID=SeqID_41908; Location=15..1116; Strand=-
  SCN-specific regions: Sequence locations=1-78,100-480,502-607,643 -777,813-940,967-1063,1095-1102
aaaaattttattcatctcccttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaatttttttgaataaaaattatttaaatgaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttattgaataaattatttaaatgaactgactagataatatttaaaataggttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaagcatcagagtgcctaaactagcatgtaaataaaatttggtgcgtttcagagcagtttctgtaaaaatacttatgaattaattttgtaaaaaaataaataaataatgaaagact

SEQ ID NO: 69944 - DNA, 432 bp, Heterodera glycines
  Genomic contig location: Contig_ID=SeqID_8996; Location=215..646; Strand=+
  SCN-specific regions: Sequence locations=1-432
atggctggaagagatacaacaatggtaagaagaggtacaacctcgggttgaagaggtgctaccgtggtacaaagaggcacaaccatggttagaagaggtacaaccacgggtggaacaggtgcaacatgattagaagaggcagaacaatggctgtaagaagtacaacaatggttcgaaaaggtacaacattgggtggaaaaggtaacactttggtctgcagagacaccaccatgattatagaggtacaaccacggaaggttcgaaaaggacaacattgactggaaagataacacattggtctgcaaatgcacaaccatggctagaagaggtacaatcgcgggcggaacaagtataaccatgtctgtaacaggtacaacaattgtaaggtggaagagttgctaccgtggtataaagaggcacaaccatggttag

SEQ ID NO: 69945 - DNA, 859 bp, Heterodera glycines
  Genomic contig location: Contig_ID=SeqID_8996; Location=743..1601; Strand=+
  SCN-specific regions: Sequence locations=1-337,359-604,626-631,741 -828,850-859
atggttagaagaaatacaaccacgggtggaagaggagcaacaatggttcaaaaaggtacaatcatggttagagaggtacagccatggttggaagaggtaccatgtctgtaagtggtacaaccacgtatcacaagtgtaagaggtgcaacaatgattcgaaaaggtacaatctgtgctggaaaaggtaacactttggtcttcagaggcacaccagttttttgctgttccatttcagcttaaatatctcaaacatttattgataaaattttacataattgtatgctaacagggcagattttgggttataaaaattttttagaacaaatttaattggccaattattttttgcaaaaattatcaacgaataaatttttaatgtttggaacgagattttttgggtgagtgtagaacattggttataagtacagctatggtcgagaataggtaaacccatggttagaaaaggtacaaccgtattctcaagaggcgcaatcatggtgagaagataaacaaaacaatgtaattagaatcggtacaactatggttaaaaacctcctctcggccgcctcagacgcgcgcttctccccccccccccacccaaatagtgttttctttttaaaaataactcgccttttaatttttttgataatattatttatttttataacattaaaagaatttatattaattttatttttatcgaaaattatttaaaaattaaaaaaactaaataatttaaactgaaacattttcacctccaccattgcttgggagcattgtgtaaacagcagttgcgagtaatttgcattttgtgtcatctccctcagttggacaatcacagcttcaacagcataagcta

SEQ ID NO: 69946 - DNA, 823 bp, Heterodera glycines
  Genomic contig location: Contig_ID=SeqID_8996; Location=1846..2668; Strand=-
  SCN-specific regions: Sequence locations=1-235,336-368,398-461,486-823
atggcaaatttaatcactaaaaattttttgttagccaccatcttcataattgccgaagctacactggaggatgatgcttcaacgggtatttaacggattcatttttcttattagggcgcggtagcaatttgaatcctcgctctacagaattatgtaacccataattacgggaccggaaatcgtcaaaaacgccgtaatttccaatctctattccgtaaatgagtggaacattgacatttttattttttgaaaaatattttgattatgtttaaagaaaaaattaaatatttttattatgtttaaagagaaattaaataaaaattaattaaattattcaaattacaaatttccctggcggcgcctatgccattattccttattttaaaattttctttatggtatggttgggtcttcgaatgccgatgcaatgcaatttaaatgttttcacaatttttggtcactatttaattaattttaatttttttggcactaaaatttctcactttaattattttaggagagacttctactaaatgccatgcaagtaaaaatgatggcacgagcctgtttcgagaagacaaccaggaggacatttgtaattttttctaaataattttgaagagttttttggacccttaaaaatgattaaaacgatagtttgtctgggcagtgccaggcactgtcgaagctccaattaaagcccaatctttttcgaagtttgaagttgaaaaaatgtgaatgttggaagaacaagttttcaaaatcaatcttcccaattacggacaaaagttttttcataaaattaaatgacggagttaataaa

SEQ ID NO: 69947 - DNA, 574 bp, Heterodera glycines
  Genomic contig location: Contig_ID=SeqID_41912; Location=136..709; Strand=-
  SCN-specific regions: Sequence locations=1-131,153-355,384-574
atgatatacccgggtataacgaacttcttcaactctttaaacaagaatcccttttaaaacgcagaacaaaaatcgatttaaaacttttccatgatataattttgggaaagatccatattcagcataatgattctttttcaaaaatatattcaggactgaaaaacgattatattataaaaaccgcttattgttcaaccaatgttcggtttcattcgttttttattcgtacctctcgcctctataggagtttgcctaaagaggcgaggttacttaattctactgagtttgctaaacttcttgacacctatgatattgatgttttacttttgaaaccgccccatctcattcagtgaccaattttattttatttattttgttttaatgtcggttcacgcttttgcgtataaattgaattgaatttcccttgttgcttttttggatggaatcggccttgaatttctccgaatatttataatcataatttgatattcctccgccaggctttttgtgagaaaaatctgaacaattaacgaaaactattttggctcttaattttggcaaaatgtttaataaa

SEQ ID NO: 69948 - DNA, 49 bp, Heterodera glycines; identical to SEQ ID NO: 51181
  Genomic contig location: Contig_ID=SeqID_41918; Location=421..469; Strand=-
  SCN-specific regions: Sequence locations=1-49

SEQ ID NO: 69949 - DNA, 2171 bp, Heterodera glycines
  Genomic contig location: Contig_ID=SeqID_1207; Location=20..2190; Strand=-
  SCN-specific regions: Sequence locations=1-843,936-991,1213-1229,1253- 1263,1360-1360,1466-1626,1648-1801,1824-2171
atgcctttgttcagtggccttcgcgcattcaaccgcaaaatctgttacgaactgttgatcattgcctatgagaagacgggacaattcgggatgaaaccggacgaaaagggccgtatgggcgagattgtctacgacagcaaagccactatgtactcatccatgccgttccaccttgagtgtccgaagattgaaattacgcatgaagaaattgttgacgactacgtgcgagatcataccgcgatggacagctttttggtgactattacgccaaaccatcagaagcctgtgttggacatttcggattatcgtcagtattattcggttagtttttgaacgctagacctcaggttgcaaatgtttacaatttagaagaagtctctgttcgacgaagatcgcactgtgcgcacttttctggaaatgtgtctttcccaattctcgatcaacaggtattgtaatacacacagaaagcaatatggtatgctttgttttttgcagagacatttactcgccggttggagccggcaaactctacgaagtgtccccggaggaacgagtctctgctggcaatggcattatactccgtcccggagttgcgaagggtattcaccttttcgctcaatatcagtgatgggttttttaggagttcgagtcgtgcgcaactatggagaattggcgcctgcgcttgttttggacagtgcgttttagagtcaatttcctagccaaatgttttgtcttttagtcaaagtgtcgccattctacgagtccaatggacttgtgccaactatttttgctattatgaacaaccgcatgccgcagatgaacgattggaaccatatccgaagagtgctggtcgatgtgcgtgtgaatgtgatgtatgcaaagcatagatccttcggtattgggcggttcactgatcaaccgatgtcaaagctgtcgtatgttttcgttgttacagtctaacacagatttatgtttaatgatttcgctttagtgtcaaatggcagggcaaacgtgtgtcgatgcccgagtacttcaccttgcgatacggcatcaccatcgacttccctgattttcctgccgttattccgaacactccagtgccaaaaggtcgtccagtagagacgttccccattgagcaattagtcatcatggaggatcagcgcgtgcctttggagaagatggactcgggcttgtctggaaagctcttgaaagtccgttgctgcacagcattacattattttttgattattaacaaatgtttaggctaacaccgttcctccgaatgaacgaatggacaagattctgcagtgtgcgttcaaaatgaatgtgttcaatgtggataacccagtgctgagcgcttttggtatcaccgtcgaccaaacatcaaatcgcgtcgtgatcggtgtgcgttccagtccgcgtattctctacgccaagaatcagataatcaacccatgtccggacaatgtaaatttatgttttttttcctatcaaaacagcatttttagaccgaatggaccaagttgggcgcacaggcgcaatatctgcaaaccaacgaattggtgaattggattatccttaccgaggagcgccatttgcggcctgacaagcagtcgaaggaaggccttgtgaaggtgtttgccagcaagctgattgataaagcgcgaaaacgtggcttggagctgaccaacccgatcttcatggtgtttagtcgaagtggcattcagggttgggtggagatgcttgaacgctgtttgaactcgaacatcgaattcatcatgttagtagtcgccaagggaattatatttattttaatgtttaacaggcttgttgactacaaaaccgaggactcacatggactgctgaaatactacgaagcacgttaccatgtgccaactcaacatgtgtccgttgagaaggtcaccgaaattgtgcacaaaggcaaaactcagacattggagaacatcatcaacaaattgaactgcaaaaactttggcctcaactacatgccgttggtggagcgctcggctgaacgttttgcgttggaaaaaggaaacgtgctcgtgattggctatgatgttgcgcatccggcacccaccacgccacaggaacgtcgtatgcttcatgtgaagggtgccacatgcgattcgtttgacccatccaccgtcgga

SEQ ID NO: 69950 - DNA, 840 bp, Heterodera glycines
  Genomic contig location: Contig_ID=SeqID_1209; Location=820..1659; Strand=+
  SCN-specific regions: Sequence locations=1-295,317-840
atggctacgactgactggggccaattcgacgctaacggaactgactacgatgccatctacgacggcacagatgacgaagcgggcactacggacaacgggcagggcggcaacgtgctcaatcacttgctgactcaggtggaacattcgcgacaattgctgtttctgtttataattgaaatcccatttcaggttggcgccggaatgactcttcagaatctgacgctgccggcctctgttctggaaaggcgctctctcctggaaatgtacgccgactttttcggtgaacagcatcggatttttggattttaaagaaaaattcccatttttcagcccatccagacgaattggtcagcgcggcttacgaaaccacacctgagaaaaggtgtttccttttcgctgacaaccaccctaattctttttttaacagattccttgccgtcctgaagtactatctgaactccttcttcccggctcgcaaaagtggcgtcgccaagaagccgtacactccgattttgggcgagacatttcgctgccgctggacgctgccggacgtgcctttgaacacggagcaaactacccgcggaccgttcccgggctctgccagcaatcaggtcgagtttgacgcaagtgccagggtcatcattttaaacgaccaaaatttttcagttgacattcatcgcggagcaagtcagccatcacccgcccatctctgccttctacgctgaacatccggcctctggcgtctgctgcacttcgtacatttacaccgagtcgtacgtcgccggcctttcttcccttggcgtccgtaacatcgggagagcgactgtggtactaggaaat

SEQ ID NO: 69951 - DNA, 2264 bp, Heterodera glycines
  Genomic contig location: Contig_ID=SeqID_1210; Location=1..2264; Strand=+
  SCN-specific regions: Sequence locations=1-103,127-708,731-1039,1062 -1073,1095-1562,1584-1635,1657-1998,2020-2264
  Gene Ontology: Mol. function=oxysterol binding; Cellular component =cytosol; Biological process=Golgi to plasma membrane transport
ttttttggtaaaccccatcggatttttggttttaaaaaaaaaattccaatttttcagcccctcccagaggaattggtccagcggggctttaggaaacccccccttgagaaaaaggtgttttctttttcgttaaaaaccaccctaaattctttttttaacagattccttgccgtcttgaagtactatctgacctccttcccggctcgcaaaagtggcgtcgccaagaagccgtacaatccgattttgggcgagacatttcgctgccgctggacgctgccggacgtgcctttgaacacggagcaaactacccgcggaccgttcccgggctctgccagcaatcaggtcgagtttgacgcaagtgccagggtcatcattttaaacgaccaaaatttctcattttttcagttgacattcatcgcggagcaagtcagccatcacccgcccatctctgccttctacgctgaacatccggcctctggcgtgtgctgcacttcgtacatttacaccgagtcgtacgtcgccggcctttcttccattggcgtccgtaacatcgggagagcgactgtggtactaggaaatgtaagtggacagaattatcggacaaaaatctgctgatttcccccattttcctttcagcacaatgagacttacaccgccactttccctgacgccgtcgcacgaaactgtcacgccactccgtggttcgaactcaccggcaaagtgaacaacattttttgtcttaattcatttccagccatttttcccccaaatttcaggtggaagttcgctgcgcgcagactaaatacgtggccaaaatcgacttcctggcaaagcccctggtcttcggacaagcgcatcaaatcgttggccaaatcttccacgggcctgaacggaaggtgccgctgatgacactgaagggcgagtggaacggcgaaatcatgctgagacgcactgcgcgcgggtcattccatctgttcaccaacgtccgggccaagccagatgtgcggaaggtagagatttttcaattttcactaagctgattattctttttatttttgtcaggagtgcgttccggtgatggagcaggaggacaatgagagccgaaagctttggcgtcatctcactgcagcgttgtacaccaacaacacacagatggcgactcaaagtgagttttgaaaggaagggttcaaattgcattaattaaggttttccccgtttagttaaacagcacttccaacaacgccagcgggacgaggaggcggagcgcaaacgacagggacgtccatggagcgcgcgccactttgtcagagagggatccgggcttccgacagacgcctggaaataccgcgatgcaccgtgatagcgaacccgaaattgtctgtatattgtatattagcccgaaattgtctgtatattgtatattagcccgaaattatctgtatattgtatattagcccgaaattgtctgtatattatgtactaatatatgtgtaaatatgtacttgacagaccggagccagaaactcacaaaaccacttataggttttttatgtgctgaaatcgagaaaaattttaaaaaaggtctgcggcaacgcgtttaaacaattggttttttcaaccggttaaaaatggggccttcctgattagaagctttttctaacctattgcttagcgattagacaattaccaaaaaagttataacatgaaataacaaaaaaaccaaagttttggaagttttttcctaataacttttttagaagctaaaatttttgtttgttttttgcaagggctggcgccaaaacgaccgattccccctgggtccatgccatcgtttggcaacctggatttacctgggttttcgtcccgaaaaaccaggtccagccaggtcaaccatgcaatccaggccaggcaaattccgatctctaacactccacaatttaatgagaatgcttaagattcataatcgcaattaaaataatacaaaattatcaaaaaaaggaaattacaaatttaaccaaacaagtcgaattaaattaagaattttcatttagaagaacaacattagtcttgctaaattatccttcagagttcagcatgttccccctttagctcttccgggttagcacaagcggtcggagattttgccaaaaagtgatattcgcacttggacggttcgctggtttccacaagttcgaactgttcaccgcactcgaactgcaccaaagtggacctacgaaatgaaacaacatacaaggaatatgaat

SEQ ID NO: 69952 - DNA, 713 bp, Heterodera glycines
  Genomic contig location: Contig_ID=SeqID_1210; Location=4468..5180; Strand=+
  SCN-specific regions: Sequence locations=1-12,35-112,200-210,239 -247,310-313,431-713
atgacagccatttcggctattcctcaccctcctccggtccccctaaacaaagttaggtaatttctctgcgttctgttctgacccggctcgtcgcttccgtccgcgcagtcgcaatagtcgtcgttgacctgttcaaatgggatgctcttcttcccgtccaaacactcaaattgtgaccgcgtttggtacaatggagcaactaaaaataggaaaaaaatttaaaaatactaataattttgccatttacgttggggagagactcctcgtggccgagttggtaattccttttcctccccttttgagcacaccgaagaaaaatggacagtcaaaacaacaaaaagagagagcagcggcaaaaaacaaatgcaattactcataataaattatttgcagaggacaaagagaaattgcttaattgttgttgaactaatagatggaaagaaatgaacaaacggattaaagcaaatgatcaagtcgcgaaaacgtgtgacgtggaagtggaatcaatcaatgaacaaaaatagaggatggactaattgatgagcattccgaatatacaattaaggtacagctggaaattaagagcttggtcaccaaagtaccggtttttaggtccttaaatggaacttcagtaccgggtctgtaaattttccgtaaagaattgaaaaaccccgaacgattcggtcaacctcgacggtcggggtctcgtccta

SEQ ID NO: 69953 - DNA, 2700 bp, Heterodera glycines
  Genomic contig location: Contig_ID=SeqID_1210; Location=3679..6378; Strand=-
  SCN-specific regions: Sequence locations=1-348,370-424,446-690,712 -1030,1064-1179,1201-1481,1548-1602,1665-1673,1702-1712,1800 -1877,1900-2001,2023-2497,2519-2546,2648-2700
  Gene Ontology: Mol. function=nuclear localization sequence binding; Cellular component=cytoplasm; Biological process=NLS-bearing substrate-nucleus import
attgacctccttcttgcgcagccgggcctcgtcaccagcatcgttacactgctgaagagcgactcaatccgagctttgactggcgcacttcggacggtcgggaacatcataacgggcacggacgagcaaacgaccaccattctcgactttggagtgctcgatgactttgtgagtgtgtttttggcggcgattatactcccgcatcattgttttattttcagaaaatgctcgtcgattcggacattcatcaagtctcgcgggaatgcctctggattctgagtaacgttgcggccgggacagctgagcacgtgacgcgcctgttctccgtggacggactgtccgacagtgttttccgcctttgccgtgacccgagcccacggaagagaaaggtgtgttttgactatccgatttccttccttttcactttcatttttgacattttcaggaggcttactgggtgctggtcaatgcaatgatgggagctcctatgccgctgtacgaccatttgctgagcggtgggctggcaaatattgtggcgcagctgcttcgtgagaatcctgacgcggcgctgctcgaacggacactgaacacaatccgcgcatcactcgaggaccgacctcagtccaaccggcacttcaccatggctttgtttcatcacgtcggcattgtcgggcaactgctgtgcgtcgccagaggagcaacaacaaacaattcggcgccgtcacttatgaatgcactttcggtcggtcgaaacttacacaataataaagttcttggtaaaacggactgcttttaggaacaggcgtcgtccattttgaggcagcattttggcatttcggctcatgactgtaccagctgcaacaacaaaaagaacacgaggggcacgtcaattcaagtgcgaatcaaaaggacctaatcgacggagggcgacacagatgaaacgcgacgacatgccatttctgattgattataatgttcatatatgttggcaaagctattgtataattcccacatttcatatggctgttcgatgtatgtatgtgtatgtatttattgtgtacagtataatttgcgcataaaagcaatttaaacaattcaagaccaaaataggtctacctaattcgaacaaattgaattctgaaaaattgtgacttccgtctttttgttcgctgaaaaatttattttttgaccattttattaggacgagaccccgaccgtcgaggttgaccgaatcgttcggggtttttcaattctttacggaaaatttacagacccggtactgaagttccatttaaggacctaaaaaccggtactttggtgaccaagctcttaatttccagctgtaccttaattgtatattcggaatgctcatcaattagtccatcctctatttttgttcattgattgattccacttccacgtcacacgttttcgcgacttgatcatttgctttaatccgtttgttcatttctttccatctattagttcaacaacaattaagcaatttctctttgtcctctgcaaataatttattatgagtaattgcatttgttttttgccgctgctctctctttttgttgttttgactgtccatttttcttcggtgtgctcaaaaggggaggaaaaggaattaccaactcggccacgaggagtctctccccaacgtaaatggcaaaattattagtatttttaaatttttttcctatttttagttgctccattgtaccaaacgcggtcacaatttgagtgtttggacgggaagaagagcatcccatttgaacaggtcaacgacgactattgcgactgcgcggacggaagcgacgagccgggtcagaacagaacgcagagaaattacctaactttgtttagggggaccggaggagggtgaggaatagccgaaatggctgtcattttcgtgtcatcatttgcccgggaacccttgtgaaggacttacttatatgggatgcgtttttcatttcgatttttctttagggacgtcggcgtgcaaaaatggacatttttactgcaccaatttcggctttaggccgcaaactttgccgtcgagccgagtcaacgatttcatctgtggtatggatttaatgtgtcttatttggggctttttgtagcgataaacccgctttgtctttccccaaagattgctgtgacgggtccgacgaatgggactcgggcaccgaatgtccaaatgtgtgcgattcgctgggtgccaaagcgcgcgaagatgccaagcaacaggccgaagtgcagacggcaggctatgccaagcgcaaagagttggccaaggaagggggtcagtttggaaaaaaaggatggggaatggttgaaaatgggaaaaggggggggggttgaaaactggggcctttttgggggaattggaagtaatgcgatgcaataactggcgtaatgaaaaacacactatttttcgcaaatgttttgacaattttaggcaaaatgttgtcggaaaagaaatcggaagttgaaaagaagcaaaaggagttggacgaattggccgaactgaaaaaagggacggaggaggcgaaaaaagcggcggaagagttggaaaaggaggcgaaggacagggaggaaaaagagtgggaggaggcgaaaaaggagcggacggaggccgaggcaaagcaaatgttcgacaaaatggagaaggacggggacggaaagtgcgtttaa

SEQ ID NO: 69954 - DNA, 899 bp, Heterodera glycines
  Genomic contig location: Contig_ID=SeqID_8998; Location=35..933; Strand=-
  SCN-specific regions: Sequence locations=1-82,106-387,409-416,447 -571,593-633,655-662,685-825
atgtatctgatcaccacccttttgccaacccatggatcagtgccacaaaatgggaatgcccagcaacaacaacagaacggtgtccaccaccaccacaacaacaatcacagccaatcaaacgggcatcggcgcaacacatcattacagcatatgccatccgccgcgttgatcaaccgtattctgccaaccgaactcatactacggtagacatttggcatataccttcttttactgtgttttattttgcattcgaatacggaactaataaaagaagactacatattctcggtagcagtataggacaattagcgaccattaccgtatgtattacttgactggtagtacgatagttttgcatactgtcgtccttggctacattttacattcaatatgggcaaatataaacatactttttgaattatattaaaaaatactattaaaaaattcttacagtaagctttacatggatttttaagaaaactgtttttgtttatggtaaaacaccgtataataaaaatttactacagtttcatggaaagcatgcaaaaaagtaaatcaattatattttttcgatttctcaaaaacatttttatgcattctaaatattgtacatttgttattttaacttcctaaatgccattgaatttactatttcaaatgcctaaatttaagtgccaatttttgcaagggtcttttcctacttggacatcacatcgcttggccgttgtgcgcaagtttgtcgaacatggaacaaattggccatggacggcagcaattggatggaggtggacctgttctcatttcagcgtgaagtaaaggtgaaacaaaattttttaagtgtattatttatataattaaaaaggttttttatttaatttaattttaatttaaataataaa

SEQ ID NO: 69955 - DNA, 981 bp, Heterodera glycines
  Genomic contig location: Contig_ID=SeqID_8999; Location=112..1092; Strand=-
  SCN-specific regions: Sequence locations=1-142,164-320,344-347,733-870
atgcctttgccctccacttcaaccatttcatctgttgctgtgcaaaacattgctgcgtatgttgctgatgacaatggtgccatggtgtgtttgcgtgccgtttacgcaatggaccgtaccgcgcattttgatcataccgtacgccatgatggcatactgtgggatttgcgtttcgcgaacccggaccatccgcccgagcggccaatttcggagcagccgcttgggcgctatcgtgcgccaaggtttggcgccgccaccattgcgccaatcgaggactcaaaatgccagcgtcaaaaattttggcgctggcgccgccgtagccaaggggtaaaattgggaaaagcaaattttttcttttttttaaatttattattaaataaattctttaattttattaatttatttttaattttataaaaaaataatttaatgaaaaaaattgtttaaaatatttcatattccttttttaatttaaaatctttataattatattatattgcatttaaattaatattttaaaactttttttaattaaaaaagatttatttttaatttttcattaattcttttatttcttaaatattaaaattaatttaataacatttttattattgtacatttttaataatttttaattaatatttaaaaataattttataatttaaataaattccattaatttgtatttcttaaattattatattaatttaataatacaatatttaatttaatcccttttatcaattgttccccaccttatcagttttcatttgtgtcaattatcatttgaaacaaaattttgtttttggttccaattctcgatgcatatttattctcaccaccccttccgtttgatcggatgttgttttcaaaattttgtttatctatttaatataattatcataaattgtttaattaattttacagtcttttattttaatttttcaaaaactataaatttaatttatttaatttaataaa

SEQ ID NO: 69956 - DNA, 508 bp, Heterodera glycines
  Genomic contig location: Contig_ID=SeqID_9000; Location=700..1207; Strand=+
  SCN-specific regions: Sequence locations=1-508
atgaatcagactgatgaatggaatgcatatatgaatgaacaaaaaatacgtggcatggattgtgcaaaaaagtgtaaaattattgtctccatgatacagtatgacacaaaatgatacggtgtcacaatcgaatttgagagcattttgaatgttccaccggaaaattttttttattttttgaaattatgcaaaataatcattatgccaatctataataaaaaattatttcctgaaaatactaaactccatttaaaagagcacaaaagttaaattttaaccttggcattacaatcccataaaattcttgataattttcataattttagacccatccccccccccaaaaaaaaatctatggaaaacccagatttcagcgaaagccggccggtggtccaagctctagcgataaaatcggaaaattattttgacacaaatccaaacaatcccacgggttgatctgactgatcccattggtcatccgtaaaggatcatcagcagcagaagcaaa

SEQ ID NO: 69957 - DNA, 145 bp, Heterodera glycines
  Genomic contig location: Contig_ID=SeqID_9000; Location=1070..1214; Strand=-
  SCN-specific regions: Sequence locations=1-145
gatttattttgcttctgctgctgatgatcctttacggatgaccaatgggatcagtcagatcaacccgtgggattgtttggatttgtgtcaaaataattttccgattttatcgctagagcttggaccaccggccggctttcgctga

SEQ ID NO: 69958 - DNA, 1615 bp, Heterodera glycines; identical to SEQ ID NO: 41925
  Genomic contig location: Contig_ID=SeqID_41925; Location=1..1615; Strand=+
  SCN-specific regions: Sequence locations=1-315,337-440,462-589,612 -650,687-752,774-1003,1039-1067,1112-1466,1501-1615
  Gene Ontology: Mol. function=extracellular matrix structural constituent; Cellular component=basement membrane

SEQ ID NO: 69959 - DNA, 774 bp, Heterodera glycines
  Genomic contig location: Contig_ID=SeqID_41926; Location=14..787; Strand=+
  SCN-specific regions: Sequence locations=1-774
atgcaaggcggacagccaccagcaatgaacatggaccagcattacgagcatctcggcgttccaaccggcttccaacgagcacaatccgccgatcacgtaattcagcaaatgtcagaccacgtcgacaacattgatcgatcgttgcttgccccgtggcagaaatttgacgcggtgaacactttcgtgctgccgtcgattgccttccatctcaaaaacggggaagtgcgcaaagccccactgaatgcgctggacaaaaagatcgtccgtgtggcaaagcggtggctgaatctcccacagcgtgccggaatagagccgctctacctgagcaatgccatgggaggcctcgcactgacaccactcaataccctcgccgacctcagccaacttgttcatggcctgcggctcctcacttcccgcgacttggccgcaacaacaatggacctcctgtgcaccgtcgttgccaagcgtctgcgccgggcaccacgacagcacgaattggccagatacctcaacggttcgatggacggcgacatgaacaacgagtcgacggacatctcttcgacctggacaaggctcagaatggcaacgaggcgactacgaacaaaaattggcgtcgaatggtcggtcaacgacggctcaatgcaactgctcctgaacgggtgccaaatccaaccaaaatcagccgaattctgcctgcgctcagccatccgtgacttctaccaccgccgattgctgtccaagccagaccaagggaagacacacagtgtgacaagc

SEQ ID NO: 69960 - DNA, 276 bp, Heterodera glycines
  Genomic contig location: Contig_ID=SeqID_41927; Location=155..430; Strand=-
  SCN-specific regions: Sequence locations=1-276
atgtcggcgtcaattccaaggcgttcttctcaggattcgctggcagaaaaagtgaaaagcaaggagctgatctacgaggccagaatgaagatccaggaacgactgaaggaactcggtttccccgtccaaaacacaacggtcaaagggccaagtggcagcgaacgtttccgagaaacggtgctcaaacccgaggagacgagcgcattcactcagttgcacatggagaatataaagcgacttaacgaggtttttgaacacaatttgtgtaattactga

SEQ ID NO: 69961 - DNA, 989 bp, Heterodera glycines
  Genomic contig location: Contig_ID=SeqID_41930; Location=51..1039; Strand=-
  SCN-specific regions: Sequence locations=1-390,412-500,522-704,726 -809,831-989
atggatgtgaaggattcggttggcccatctaaaatcgctgtcaattgtaccatttgtgtgcccgtttggtttggttttgtacgtgttgaagcggacggcgaaagtgtacaaattgaggacaatctgtcattgaaaacaacacagttcaaattgcctacgaatggcgatgacaaagtgagaagagagagggcgacttgtgccgattctatgggtcccttcgctttttcagagagtcgtcatcgctgccaatgaatgctttgtgtttttcttagtgggcagttacgcactttactcgttcgaattgcgtactgagatgagttttttggggtgttcggcagatgactcaccgaccgtccctttttaaactctcttccgaattgagtcgcaaagttcggcggatggtcctcctccccttggccgggaatggcttcctgtggaagtccaattggtccattctgaattccctcctccgtccgttgccctaagccatcaatttgaccattgggacgccctcaggggacggaagggaattgacaaattcgaagtgagtttttggcattcgcttaatcgtgtatccatagtttcagcatttttctgccgcttcctccacaaaatccaatcgttttttggtttgcactgcttttggcgcttttttggcaacgaatttcgaaaattgcgccgttttggagaggtaaaagcacatttaaccaacaaaacaaagaaaatatatttaagaatttgcgattcgcgcctcgggaaaaatccgaaggaagtgaaacgattcgaattgccatttcgaataggaaaagtttgtgtgatgttttttaacaaataaaaagtgaaaaatttcattaccagatcagtgccggaagggaccacctaatcattttggactctttgaacggagagatttggagtttcgggacggggacgaggggcgaattgggcacggggcgagtggaggcggacaattgggcggaggggccgag

SEQ ID NO: 69962 - DNA, 429 bp, Heterodera glycines
  Genomic contig location: Contig_ID=SeqID_41931; Location=350..778; Strand=-
  SCN-specific regions: Sequence locations=1-197,220-292,334-429
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcggcggccgagtgagtaccttcggtgcaggaaaattattaaggaagagagttcattatttatttgttttttgcataattaattcataaatatttttttcagaaactgctctgaaacgcaccaaattttatttgcaagttattttaggcactcagatgctttcactatcaaaaagggagatgaataaa

SEQ ID NO: 69963 - DNA, 757 bp, Heterodera glycines
  Genomic contig location: Contig_ID=SeqID_41931; Location=644..1400; Strand=+
  SCN-specific regions: Sequence locations=1-183,205-256,278-347,369-757
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaaggatcggcctcccc

SEQ ID NO: 69964 - DNA, 1919 bp, Heterodera glycines
  Genomic contig location: Contig_ID=SeqID_9002; Location=822..2740; Strand=+
  SCN-specific regions: Sequence locations=1-470,498-560,614-1806,1840 -1863,1893-1919
atggtgttgctgagtgtcttctgcgctgagctgctcaattgccgtgttcagcaactccgcgaccgcctcaatcaccctgaagaccgcacatacattttcaattcactgaaaggtcgtaaggtgaccacaacttataaggatcgaaacggcatgaccaagactttcttcattggcggtttgtctgaaaagggagcagcactcactatggcctatggtcgcctctcgtctcccttcaatgtcaacatagcggcccacttctatgcgcggcaccgcataaagctccatcacccttacatgcattgtgttgttgaacggttcacagctggaaaagaggaccgattttatccaatggagttgcttgagttggccgatgacaatccaatgtggaggcggtgggcaggcccaatgtttaccgagaggatgtccacaccacctacacgccccgatgttcaattcaatcttggatattgtgatgatgatgatgatgacgatgatgaactaattggagacggacgcgaccaatgtacacaacaatcatctcccgacatgtaccgctggtgacacacacacacacacatgcgcatgcatatatgcgcacatatacgcatgcgcatgtaaaattctctaatttacagcatttttatgccttttttacaattgcttcttctaatccttaattatgcattttttctacccaaaactgaccactcccaaacattaattatgcttagcttttaaaattgtgtcttccaatcgttaattttttcaaaattgtgtcttccaatcgttaattatgcactttttctacctaaaagtgacaacttccatcgcttaattattttcaaattttatcttccgttgcttattctgcatgcttttaacgtccttaaatatgcacttttctacctaaaaacgacaacttcgctcacataaaaatagtatcttccattccttaattttttcaaaattgtaacttctttctcttaattatgcactttttctacctaaaagtgacaactcccacgcttaattattttcaaatttcatcttccattcgtttattatacatacatttttatgaaaaacatgaataacacacaaaaaaaaagataaaattacagaaattgttataaaataaagggaaattggggtatataacatttatcggttgtggttcaccagtctcagcatattttaacaccttgtccttgaacgtgtcgtagcgcaacccctggttctggggcaattcaaattgtaaatagccccgcgtcttctgccgtcctttgttaaaaatcccatttctgccagttgagtttgcccctttgtcccattttgtaccatcccttcacaaaaattcaaattcctttcttcgcccggctcaactccggccaattttgtgcaaaaaatttttttctcacaaaatttttcttttgttcaattcgttggctaatttgcatttttttttgttcgtccattttttgtgcaaatttttttcccatcttgccagatgcgcttatttgtgcccgcccctcgcaaaaaattttcctatttaagcgcctccggccaagggatcgctcattttcacttttctgctgctccctctctctcctctctctttctctctgaatccaataaattttacaaaatttgcccccccccctctttgtttgtcatctatcatttttatgaggcgaccaatttttaaatttttcatttttcagtttcaatggctttttcaaaaatcgcagctaatgcaattgccatcgacctcggtacgacgtattcgtgtgttggagagttccagcgcggaaaggtggagatcatcgcgaacgaccaaggtggagcaaaaaggcgcaagttcgacgacccggcggtgcagtcggacatgaagcgctggccgttcaaattggtgcaggagg

SEQ ID NO: 69965 - DNA, 833 bp, Heterodera glycines
  Genomic contig location: Contig_ID=SeqID_9003; Location=1326..2158; Strand=-
  SCN-specific regions: Sequence locations=1-348,374-403,427-792,814-833
cgccatccaattgtcggcgaactgtcccccaaggccaccgtaatggcacgaatgctcatccgcgccttgcaggtacttacaaaaccatttccaccattcaatcaaaatacggtggtggtggttgaatactgtacaattccaagtccaccgtttcttcagctgctcctctgggccggcgagcgcagtgtgctgggcaagcgcgagcgggagaagcgattgcagcaaatttacggcacgacgggtgggccaaacaattttggcattttttaatttgttttttaatctaaaaggtgatggcacatgccggaagagacggcaccaatccgtgcagtcatcagccggtaaatgataattaaatttttataaattatttgaaattcaaagcaattttcttaacacattgcattaaaattctcaaaattttcccgacggcggcgcctaacggtatcgctgtctctcaatttaccattacctactcatcattgttggaattgttggcttattgtattgcccccccccccttcatctttagggtgttcagccgctcgtcaccccacccccaaatttttttcttaattttcaaaattcgaattttttagaaaaaaaattttgaaaaactttttcagaaaattctaaaaatagtgagaaattttctagcgattttctgggaaattttgaaaaaagttaattttcataaaatttcaaaaaatagcttgaaattttttcaattttagtagagaaaatttttggcgggctggcgcgagaaacgtagtgcaaacatctttagaatactttaaaaataatttttattttcgaatgaatggtataataaa

SEQ ID NO: 69966 - DNA, 383 bp, Heterodera glycines
  Genomic contig location: Contig_ID=SeqID_41932; Location=392..774; Strand=+
  SCN-specific regions: Sequence locations=1-20,42-275,297-383
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagcttgagctctacaagaaggtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 69967 - DNA, 764 bp, Heterodera glycines
  Genomic contig location: Contig_ID=SeqID_41933; Location=87..850; Strand=-
  SCN-specific regions: Sequence locations=1-188,210-461,484-764
atggccaccaccgcaccggcgccgtcgtcggctgtcaccgccgccgttgcaccgtttcttccggaggcaaaatgtgccgctaaccatcaccatcatcggcacaaagcaaatgccatcatcgtcaatgtcaacaatatcaacagaagcagtcatcatcgcaaaaaagtggcggcaccgaagcggaagaggtatttgttgtgcttgttgttgattggggatgccgccaggattcaaattgaaaaaaattttgaaattttcggcattttttaacaaattttgccacaaattggtgatgctaggcagataattcattggaactttttttttcaaatttacttttttagaccttcaaaatcaccaggaaacatttcttccgttgcttttcatcatcaacatttgtcgtcgtcgttgtccaccgccgccactcatcctttgaatttgtcagaggcgacggcaaagtgcattttcatttattttttgctatttctaacggatcaaaaaaaagccaccaaaactgtggttccgcaaaagtcggaccccattttcggacagcaaaatgcccaattttagttggggccccaaaagtgttcgggccgcaagtgtcgggacatggcttttatggtatttgcaaacttccaaattgcaggaccaacaacaacaacaacaattctggtcttgttgctgcagttgcgattggaaatgcgcaaaatgatgggcaaccgttggtaccgccgccgccacttcagtgccataaatgcaaaaag

SEQ ID NO: 69968 - DNA, 248 bp, Heterodera glycines
  Genomic contig location: Contig_ID=SeqID_41934; Location=515..762; Strand=+
  SCN-specific regions: Sequence locations=1-77,99-248
atggaacttactgaacatgttgtttttctcgacaccgctctcaaagagtaattaacacttaattagcatttactgcctattaattatataatttatttgcccttggatgttccaatttaagcatttccgagttcgattctcagcaaaagcaagtgaacggagtgaatgttcactcggaagaccaatcgaagctttacattctcttcaacaattcatttgttgttttttacgacattacttccgacgag

SEQ ID NO: 69969 - DNA, 727 bp, Heterodera glycines
  Genomic contig location: Contig_ID=SeqID_41935; Location=60..786; Strand=-
  SCN-specific regions: Sequence locations=1-80,104-395,519-529,557 -678,709-727
atgatcagatattacatccaaaaaagattaaaaattttcactttaaaattcagcgatattggccaatctgaggctgatgaacaagaagaagaagacgaggtaggataaacaatagtgaacgccattgaagaaaagtgttatatgatatctcttaatcgattcggttcgatgagtttaagcacgaaagaatggaactcgggttgtggaatgccaaaaaaccggtttttgaaccggttaaaaactcgaaaattgacgaaatttggcacttttaacttctttttttttaaataatcgaatccttacaaattttgtatcatttaaagctatttacagctaattgtaagtctaaaaatcagctggtttcaattctaaatattttttgaaatgattgtttcttaaaaattctttttttttaatgtttatgtttaaaatgtaaattttattttttatgattctaaaaaattttcgtaattaacaataattttttaaaactaataattttaattaatttataaaatgctaaaggatgacgaacaacaacaaaaacaacacttttcggccgctcaattggaccttttggaacgcctatttgagaagacaaaattcattgacttttctacgcgttcagaagtggccaagttggtgggcattacgccagagcaagtcaaagtgagagggatttttaattaaataatacaaaatttaatagccatatttaaaaaataaa

SEQ ID NO: 69970 - DNA, 561 bp, Heterodera glycines
  Genomic contig location: Contig_ID=SeqID_41936; Location=362..922; Strand=+
  SCN-specific regions: Sequence locations=1-95,285-295,369-422,482 -508,535-561
atggcacaatttgtgatattcaacgcattggaaggcccactgccaaatatatccggaaaccgattaagagcgagtcgaccgtaggtttttttaaatttttcttttttttcttttttacttttttttctaatagatttttttttgatatttttttatcgttttttttcttttaattatttttttttttattaatcttttttttctatttttttgaattttctatttttttaatcattttttactttattttttttgtttttctaatttaatttttttttatttttattttaagaagaatttatttttttgttttataaggttaaaataaaaaaattagcttattttattttttttagaatttttttattgcttattaaaggatcagctagtgaaattttcaagtaaatgtttattatatttcgaattatttttattttaagtttaaaagatttttcatttattagagtttttattttattatcagaatttttgtttttcattcaaagggaaaaaatttaaatatttttttttttagttttctaaactaaattttcctattaa

SEQ ID NO: 69971 - DNA, 387 bp, Heterodera glycines; identical to SEQ ID NO: 52041
  Genomic contig location: Contig_ID=SeqID_41938; Location=1007..1393; Strand=+
  SCN-specific regions: Sequence locations=1-82,116-138,160-387

SEQ ID NO: 69972 - DNA, 247 bp, Heterodera glycines
  Genomic contig location: Contig_ID=SeqID_41938; Location=1443..1689; Strand=-
  SCN-specific regions: Sequence locations=1-247
cacgcctgtttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcaga

SEQ ID NO: 69973 - DNA, 1892 bp, Heterodera glycines
  Genomic contig location: Contig_ID=SeqID_9005; Location=106..1997; Strand=-
  SCN-specific regions: Sequence locations=1-581,749-823,845-1276,1299 -1635,1670-1892
  Gene Ontology: Mol. function=structural constituent of cuticle; Cellular component=extracellular; Biological process=cuticle biosynthesis (sensu Nematoda)
atgacaaaattggaccgcaggccgctcggcaatgatgacaatgagctgcaacaggacgacccgaaaagcgcgttgcgcgagtcagcacagctccgacggtcggcattcattggcgttgccattggcaccgccgcgatgcttactgcagtgattgcagtgccaatgctgtacaattacatgcagtatgtgcagtcatcgttgcaggaagagctggcattttgccatcaccgaacccagggcttgtgggatgaatatgccaaggtgggtggaagaatggatcaattttaatcagtttttaatgttgaccagatttagaattgcaaagcgtaagtataatggtacaaattcggccctcataaaaactgttattgtatttttattccttaacttcgtctaaatgatccgataatattactttgggcagaactacctttcatgatcagtgatattttatataaaaatgcgtcctatagtttttcgatatttaataattttccttgtgtgctctaattaattactttttcccttttaggtccagcatctgaccggaaacgaacgggccaaacggtcttcctacgctcgcgctggcggaaccggcggtggtggcggcgggtatgcccaggccggaggcagcagcggcggtgggagtggcggctacgcgcgcgcaggcggaagcagcggaggcggttacgcgtccagcggtggcggtggcggaagcagtggaggaagcggcggcggaagcgctggctattccaaatttggtggctatgcttcctccagcagtgcgacttccggtggcggccaacaatgtacgtgcactaccggcccacccggtccacctggacagcctggcacggacggacagccgggcaatgacggacagccgggcggaccggggcagcccggtgcggacggacaagcgccgcctcaggagtatggtggcagctgcactccggaatgccctccagggccgccaggtgaggggaaaacgtggagaggaaggccaatgatggcacctggaggaaaaaaatcgtattataaaagacaaaacgaaatgtctctgatcggaactgatcagcaaaatctatcggcaaatatggccactaaaattataaccgtgtggggaaggaaattctaaaaaaccttaatcactgattagataaacctgatcataggctcttaatcatattggccaatcaatttcgtttgctgatataagcttcagctcaaatcactcttgaatccatacccttgggctgctgatttaaacaacgcactcataaaaccatttcaggaccgcctggacccggtgggccaaaaggtccgcctggaaacccaggagcaccagggagcacgccggagggcggatagtaagtcttgtttttagtgctctaaatgttttaaagaattttatttgccattattgtaattttattgcaaattatacattaatgaattggaatgttcagcggtgcttctcctcccggaccgcctggaccctcaggcccgcctgggccacccggaggctcgggcacgccaggccctcccggaccccctggacaaatcactggcggtaaaactgaattttttttaacaaatttacccctgttctttttgtttttcagggggtgctccgccaggcccacctggccctcctggaccacctggacagcccggacaagctggccaacttggatcacctgtatttttttttatcaagatttgttgtatcattcaaactgtcatttttctagggcaacgcacagcctggtccgcctgggccccctggcgatgcgggaccacccggatctcccggaaacccgggcgccccggggggacctggccaagcgggaagcgccggcagtggagggggatgcgtaagaactttttga

SEQ ID NO: 69974 - DNA, 951 bp, Heterodera glycines
  Genomic contig location: Contig_ID=SeqID_9006; Location=80..1030; Strand=-
  SCN-specific regions: Sequence locations=1-30,52-398,420-420,442 -743,794-815,837-951
atgacaaagaatgactttgccattgtgggagaaaatattttagcgcttttttggaggacacgacaaatcggaccacgaggcggtagatgaacttaaaaagcgccacgatgaaatttttggcacggattaagctcacaaatggcgaattgatctaggatgaccaatttatttgattgtttccattacagattttccattttcgggactttggtcaattttcttcatcgaacactctcttttcgtgcccaaatttaaaattcaaaaggtattagttatacaaccaagcatgaaaatattcatggatctggaaaaaaattttctcaaggataagccccactttgtcccagtcccgatcgaaaatccaggtcccggtcccggcgtttcaggtccggcaagtaccggtcccgaaaaattcccggtcctgcttcctgctcaactctttgtacaataatatatggaatccatatttttttcctgtctgatctgtgggtgccctgaaatgaacgaaaaacatgtattagcttgtttggagtttttgttatgagttcgatattccatattttcgtatttttctttcgataaccatattttcgtatttttctatgtttcaggatttatgtccatatgttggcattatttacatgttttatgtcaattttttggatttttcaaaaaaccgctattactaagtagaacgtcccctcagctaaatggcctgtttaacctcattagaaaactaacagaaaaaaattttttttacaaaatttctcaaaaatgttttttttatttaaatgtttctttaatgttaattttgtgtaaaaaataagcaaaaatgtggaaaagttcatattttaataattatgatgaaaatagagaatatttggctgaataattgtaaaatagcatattattcaaaatatatatttgaagaagttagtatattaaaataaa

SEQ ID NO: 69975 - DNA, 211 bp, Heterodera glycines
  Genomic contig location: Contig_ID=SeqID_9006; Location=1035..1245; Strand=-
  SCN-specific regions: Sequence locations=1-155,191-211
atgattgtgtggaaaatgttcttgcgttggccaatcgttatctgttggaatctgttgaaaatcgttgtgttgactttttgatgaccaaaagtaaaaaattggccattttcaaattccgtttggcccatcagtacggtgttattggcatgaaggtcaaattaaaattagaaaattaatacatttaaaattagtttcagagaaaaattcttag

SEQ ID NO: 69976 - DNA, 850 bp, Heterodera glycines
  Genomic contig location: Contig_ID=SeqID_41942; Location=12..861; Strand=+
  SCN-specific regions: Sequence locations=1-86,108-200,222-368,401 -770,823-850
  Gene Ontology: Mol. function=protein binding
atgcttgtgccaacttcccaatttccctttgccaatgtgtttttggcatttaaccacgcgcgccattttgaagaaaaggtaaaaaattattgtcatcagcagagatgagattttttggaaataaaaaattgcctaagggtagccaaatacagaggaaaaacctcatccccgatgactctttaggttagagccctaaattgtatgttttcatttttcatggtttaaaatgattttgcactgtctcaaaatttaatggtttaaatttttgagtgcttaaattcatttttaaaaaattttcatccatattttgggatttttaccatattataaaccatttttcgggtattttttatatataaacatttactctaatgaacatttacatataattaattataaatatgtgcatttccgttaattcgtaggaatttgctctccgttgcttggatcacatcgatcagaatgcgtactcattgctcaaatccgatgcttttcttaaaattggcacaaattacctctgtgaaattctggcccgtgatcagcttcaggctgaagaaatcacaatttggaatgcggtaaattaaacatttggtgattttggcactatttcgaatttttgccaaactataggctcttcgctgggcggacgaacaatgccgtcaaatgggcaaggagtgttcggcggagaatcgtcgtgccatgcttggaccggcacttttccaaattcgttttccgttgatccaattggaagaatttccaagaaacattggtaattaattaaaatttatcatcacatataaatattttcattttatattaattggaacagacaggtcggcactgcgtttta

SEQ ID NO: 69977 - DNA, 58 bp, Heterodera glycines
  Genomic contig location: Contig_ID=SeqID_41943; Location=30..87; Strand=+
  SCN-specific regions: Sequence locations=1-58
ggctatagaggaagctattccggaaggattcggtctccccataaatctgggcgcatcg

SEQ ID NO: 69978 - DNA, 157 bp, Heterodera glycines
  Genomic contig location: Contig_ID=SeqID_41944; Location=162..318; Strand=-
  SCN-specific regions: Sequence locations=1-157
tcaaattctttgataacgaaattgagagacgagtcgaattgagaaaaagtgccgacggatacagcggagacggcacttttttggacattttggaccaattcattgaccaaatggaagagcaaacggaggaaaagcaaagcgaaagcaatttcataaa

SEQ ID NO: 69979 - DNA, 107 bp, Heterodera glycines
  Genomic contig location: Contig_ID=SeqID_41948; Location=461..567; Strand=+
  SCN-specific regions: Sequence locations=1-107
atgcgtcggatgtgcttcaaatggggagcaaatgccaacccgaagactgcaacggcaaaggcatttgcaacaacatgggcaattgtcactgcgttgcgggatacggg

SEQ ID NO: 69980 - DNA, 162 bp, Heterodera glycines
  Genomic contig location: Contig_ID=SeqID_41948; Location=1..162; Strand=+
  SCN-specific regions: Sequence locations=1-34,67-162
ccggtggcgcctatccggcacacgccggacctacattttccactatttttacaagttttttgccttaaaacggccaaaatttggtcatttttagtgaaaaagtccagttgttacccagccagggaaaaaaaattattggataaatttgcaaaaaaaaaaaaa

SEQ ID NO: 69981 - DNA, 133 bp, Heterodera glycines
  Genomic contig location: Contig_ID=SeqID_41949; Location=83..215; Strand=-
  SCN-specific regions: Sequence locations=1-133
atgaaaaatgagtataagcaaaaaggaagaaaatattcgagaaaagaatggcaccaaaattatgccgaaattagcaaaaaaattggaattagtcgcagaataattgatgaatggaagaaacaattcggaatga
